United States Patent 8,781,750 (CELL-TYPE-SPECIFIC PATTERNS OF GENE EXPRESSION) - sequence listing, part 60

SEQ ID NO: 38667 - DNA, 127735 bp, Homo sapiens
acgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgaggtaaggccgccctcgcgttgtttggtctcaggctgcagaccaggtcaggcgactcttgcagtttctccagcttgcctggtgcgtgctggtgtctcgccgcttggtcctctcctgttcttcggcccccggttgccagattgcttttcttccaggcctcaaccaggtttattaagcgaaattctggagcctttctcgcagggggaagaaacgtcaggggcgggcaggagagtggagggggaggggtaaaaagtataccttctccaggactgggccacggccctggatcgctgggggtgcgagtagttcagggacttaggtaattgtctagagacaccttgagctacgccaggacgggccgctgaggctgagcctccttggctgcagagttccagcctggcccagttgaagcctgttttttcctgggccctgtcgttcgcgctgcccagggttgtttatacagcaaatcttcagatacagagattaagttccaaattgattaagatcgttggaaacccggaatataattttgggtaggattttaacttctttgtggccatggccgtgaatttatgttttgcaagtggcaacctgtattttgctttgtgttaaaatcagtcgtttgtatctggaagtttaggagtgagaattacatagaatttcattattgtaggttcttgtcgtccagccagaccgccattgttggcttacctaaattgtaatatgtatttgttctaaaactttctctccgaattttgattttgcaaatactatgaattttgtttgaaaaggaaagcactgtcttctaagaaattatgttcccactttgtgtattttaatttgagtaattttcgaaaggacttagaatttttaatgtgccacttcaaaatgatgcttagtaaatgtttataaaactagccttatccgtactattcatattcttattgtttctctatgagaaaagttaaccacaattgtataaatttacaatttttcccatatttatacctattctatttaatcatgatttctgatttcagtatattaggtgattgctttaaaaatcttactgcagtgttagtgccaataatgaaaaaaatttttctagaaaagcaaaagcctaaagaactcttttatggagcagtggacaatatttgaaatataatgatactttcagacttaggacatttaatatttgagttgaatgcctggggagattaaagtgatcacgatattcataatcataatattaatagttgtaaaaaaaagaaacacctcgtattctgtttttaccttgcatcaaaattgaagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagtaagtaccaatttgctgtgaatcatggacagtcatatgcttttgcatcagactttttcatggtcatgcttctatgagagaaatacagggaaaatactgaaaaatgtggaagaaacacttcctcttcagaataattagctgtcttagggagttaagtgtagtggggtggaaacagcttggcgccctagtggggaagcagagcggcttatggtgcttttgaccttctctggctgcctggggaagtacttttggaataagtgggaaacataggaggaatgtccttgggctaacggagggaggaaggggatgaggggcaaaacctgctagactggtctgatatgccctggcaatcagcatgggggcaggtggcctttttagagtggtgcatacaactaataagaagcacagatatttgagttgagagacttggatttgagttttggttcttgctattagtttggtgatcttaagcaaatcacttaacttctctgaggctcaataaagtaaaatgtgaaatggggagacataccccacaggcttgttgctgaaataatgtatttattagcacagtagaatacaagcattagtatgttgaatacaatacattttagttcccccttctttcttgtatgtattaatatttaatgtgctgatgtttcagtattttgtatttatctataaagtgagcattcatgtattcttgaccatattttattgacttcatatttattttggtatatttataactgagttaccaaggaattcagttcagatttgcatatgcattttgaaaaacaaattgaggaatctagttttatattagtgttaattttatattagtattaatagtttgtgttgttgtaggagggatctataatgtacaaaaatgatcctttaatttctgttaatttaatcactcatcaaacatttattgattacctgccaagtttgaggcatttttccaggctttgaggctacaaaaattccatacagagtactgtccctgaaggaactaaaactctagtagggaagtcagatgtattaatagatcattttaattcactatttttttttttttttgagacagagtctcactctgttgcccaggctggagtacagtggggcagtcttggctcactgcatcctccgcctcccgggttcaagcagttctccttcctcagcctcccgagtagctgggattacaggcacctgacaccttgcccgcctaatttttttgtatttttagtagagacagggtttcaacatgttggccaggctggtctcgaactcctgacctcgtgatctgcccctcttggcctcccaaagtgctgggattacaggcgtgagccaccgtgcccggctctaattcagtatgttaactgtggcaatagaaagatgcacagggtctggcaggtgcacataaaaaagacaagtaattctaccccttggaaattttcctgaaggggctggtccctgaactgagtttttgaggatgatgggtatttagccatgtggcaagtaggagcagccttgggaatagaacagataatgtgagcaaaggcagggaagcaaaaacagcacactgggtgggagtcatacatgttttggaggcaggcaatgcagagagctgaggctagagaggcagccaggggccgatcgtgaagatgctgtgtgtgggtgtgtggttggaaggagtttggacttgatcctatcagtcagtgcttttcaagctgatttttaagctgtgaagcccatgattgatatgaagttagcatgtaaaacagatgaaaatgatagaatggaggtgggagtgtgtgtcccagagccctctttttgagaccattcaccattttccaaggagctgtaggtgttggaaaccaatgaatcttgtagccgggagttagaagaccatatctgcctcttgattgaattgttctactagcagcatgaagggtgagtttgtaggtgataagtctagaggtagagagaagctatagcagtaaccaaggtattggaatagatagaattggttagattgagagagtcttagtgattgatttggtgtgtgggggtgaaagagaagtcttggatgacttctggattcctactttaaggaactgggttattgtggggccactgactgaaggacaggaggaggggagacttgctgatgttttctctgttcatcagtgtttgtgtaattgtttaaattccctgtgaaattaggattctgagctctgtttcctaatttctttagtccagagtgcatttagactagaggacagggagttttatgtttataaagcctggatctgtttatagcctacatagaataatattgttgatcataaagcactggtggactggccagagctccgcctaacgttggcatttggaatgtttgtagttacatggagcttttaaaattgctttatttctgttcttcgttacccatggtctatgacatgttgtgttttcccgttttcctatatatctgtcttttgttctgatgtccatctcacaaatttcttttgtaaaacccctccactccgtaggcctgtgggcaaatgttcaccaaatgttaactgtgggcctgttgagcctgttgatgtgtgggtgctggtgggtgtgaaatgtgtctcatataaaagagcttacagattgttgggggctggaaccaacacatgaagaatcagtgaatcttctatcacattctgtactgagataataagacctgtggaagcgtcccccagtgtcgagagcccaatatgcttttgttcttcacaaattaatatgttatgaaaatacagtatttgaaacatgtatttatatttgattaagcttttttcttaataaatagacatacataaatgaatgggtatggctgtgttctagtcaaactggaatctggtaaaactaccttgaggatacaagaattataaaatgccatccttgctcatgagtttaaatctcatgaggaaacagacttttatcaaattaaatagcaaattgtgctaaatgttaagatagagaaatatataaatatataaagtgtatatatatttacaacaaaaggaaatacacaacaaaaagtgggagcaaataaatgctgggagtattgggggaattttcacagaacgcataaagacactcacaggtggccaggcgcggtggctcacgcctgtaatcccagccctttgcgaggccgaggtgggtggatcacctgaggtcaggagtttgagaccagcctggccaacatggtgaagcctcatctctactaaaaaattagccgtgtgtggtggcaggtgcctgtaatcccagctacttgggaggctgaggcaggagaatcgcttgaacctaggaggtggaggttgcagtgagccgaggttgcaccactgcactccagcctgggcaatagagcaagactctgactcaaagaaaaaaaaaaaagacagtaacaggagttgtccaggccgaggaacacctggagttatctaggaagggaggtccaggcagggagctgaggcctgggaggacatgcagtgcttgggagcttcaggtagttcagtgtggctctctccaggcttcttcatttaccagcttcggaggccaaaaaccttggggccatccttgctgcttcccttttgctcacagtccatgtccagcccatcaacacattcttccagctctacgtccaaaagatgcctcgaatctgagtgcgatcctgtgtctgcggttcctgcctcgtgcatgttgtgttccccttgcatgtgctctgttgttattgcctgttgcctgctgtctgtctctgctatccttgctgcctcagtaggagcaattcttcacagaactgcgagagtgatttcaaaaaaatacaagtctgatcatgccccctcgctcacagctctctagctcccgccttcttgatctttctcacatagcaaacctcagctccttggacctgtgtatctgtctctccagaagttccacccttagattctttggcctcttcattcacttcatttgtgtggctgtataggtgatctcacaagccccctacccggactggttttttttttttttccatagcatttacagccttagcattataacatgtgtgtgtgttttcaagattatttgtttttgtatttgcgtattttctgttttcctcactggagtgcaggctgaaaagaggggtccctatttattgatgtgtcaactgttcttacaggtgcctggcatgtagtaggctgccagttaatattagttgactaaattatgaatggagtattgtgcttatcaggaattggtggagatgagtatttggaaaaggaagtaacatgcttggtaactaacatcctatttaacattattttcatagaaatacagtgacataggtttttctatcctattcactctctcttttttttttttatgagatggagtttcactcttgtcgcccaggctggagtgcaatggtgcgttcttggctcactgcaacctccgcctcttgggttcaagtgattctcctgcctcagcctcccgagtagctgggattacaggcacctgccacctcgcctggctaatttttgtatttttagtggagacagagtttcaccatgttggccaggctggtctcgaactcttgacctcaggtgatccacccggctctgtctcccaaagtgctgggattacaggcatgagccaccatgcccagcttctatcctattctcttttaaagatgagtagataactgttctgatgggttaagtaacatgtgcatgattatataggttttagttagtcaattgattttaaatatttttactgaatgcctctgcgtaagtgctaggtagaactcacagtccaagggaataatatgaccccatatgtacttgagaaggccgcctggtagtaggtaagaagatggttttgaagaaggttgaattggatgcggggaaatccactggtggaaggttgtcctagtgctgagctactccagaggcagggaagtagagaggagagtagttttaaggggaagattgttaggtctggggcctgattagctgtgggtcattctagaagataccagagccccgaacctgctggattatggaaatgtcaaaggaagacccagagagaaaataacttaaacaaggaaagaaaaaggttagggagtggctagacaaataagaaacagttattttaatggaaaagaaagctgcaaaattataaggttaccaagtgtagccttcatggtataccttcttcatggtagaaaaaccaccaccttttgacatgattttcttcacagaggttatgacatccctttacatatcagcatagcaaaatttaggggtaaaattatttttatctaggaagttcaggtttatcagtgtgctcaacatttcatttattttggggccagatctagactggatgaccttgttattttagtctaccccagggtgcagagtgcattttttcctgaccggtacgtgaagtgcttagccagaatggaaagtgggcaaagtgtctgtttttgcttccaacttctagcctttgggattaacaatcttagttctgcgcctgtagggtgtggagtgccactgccatctgtgggaggatatgagtggggaccgggggaaataatgccagagttcagcgcagggggtgtagtgagaaatgaagagagcttttcatagtagctgaggcacaggaggcagtgaagatgagtgacttgagtgggatgagaagaatctggaagctaaggaagagagtgtcaagatgtagtcatagtgtcacctgcctaagagagatctagaaagacagaattctcctttgggttggtaattaagaaattgttgaaaaaaataaatgcatgagaatagtttaaaatgttaaaaaatgagcatgtgtgaaaacaaagttacagtgcttaaaacagtgtgaaactgatgtaagaagacagaatagtgaattacaaagtccagaagcaaatttgaactatacaaaacaatttggcatatagcagtagtatgtacaaaacccagaagggacactgatagatttttgaatatgtaataatcaaggtcttctttggaagagggtggggttaagggtagaagtagtaggacatatgcaagttcaggtcccttctcttggggaggggacagttctgagtgcctcaccttcccaggctctcctgtgggctcagggaaagctgtcctgggttctttgcttgaatcctgctgggcttttttgcttcagtgtcctgagcccttcatgctatccctggcttctcctgggagctcttctttcataaatcacttgtacatgaatcttcgtctcagggcccagctctgggagcctgacccgaggcagctctgaaagtgggccatccttctataactatgctttttttttgtttgagacagggtctcactctgtcacacaaactggagtgcagtgacacaatttcagcccactgcaacttctgcctcctgggttcaagtgatcctcgtgcctcagcctcccgagtagctgggactacaggagtgtgccaccacacccaacttattttgttgttttattttttgtagagatggggatctcacggtgttgcccaggcttgtcttaaactcctgtgcccaaggggtccccccatcttggcctctcaaagtgctgggattacaggcatgagccactgcacctagcctaactgtgcatagtgggaacctgctttacattcagtgtttctctgagtgggttttgagaacaccaattcctcaacatatttggggtcaggggaggagggacaattttttaaactactgagttaaaaactatattggggccaggcgcagtggctcatgcctgtaatcccagcactttgggaggctgaggcaggtggatcacgagatcaggagttcgagagcagcccggccaatatggtgaaaccccgtttctactaaaaataaaaaaattagctgggcgtggtggcatgggcctgtagtcccagctactcgggaggctgaggcaggagaatggcttgaacccaggaggcagaggttgcattgagctgagatcgtgccactgcactccagcctggcaacagagtgagactctgtctcaaaaacaaacaaacaaaaaaccaaaaaaactatattggtgttgtttgaacaggaaaatagattacaaaaatttttaattttacacttgcttttacccatgttctaatatacagcgagtgctttttcttatattttttcatttaatctgcataaccacctagtgggctagggcaggtagtatcatagttgctgttttactggtgtgaatagtggtcagatgaatagtgacttgctaagctttcacacctggaactggaactcttccccatattgactcaaattctctgcttttcctaccatactggtggcttaaaggagctgacttgaatgaatcctgaagtgcccagagtcttacagggggctagcaggtctgttctgctgacacatcttttagacaaggaagggtctgtatttagagattaggatgggggtttgctatattgtatgattgagtccctgaggagtggagaagttgggaaggttgagctgtgtttcttctacctccagagatagtcttatcattttcaaattcagcagcatcaccaccggggaaagtgacagtgggatatcatcttcactggggatgacagggaagatgacaggaacatgatgctgaatttgaaaatggtaagactatctctggaggtagaagacagtggaaatgattgggagggagggaagatgggactctcgattgaatctctcacaggaaggagtttggaaatcaaaagcaagatttcagtgattgagtgctggggaggagccttgaagggcgaagagccagtgatgaagcgacccctggaagagatggaggaaaataggagagtgtggggtcaggatggagagttattttccagagaggaggaaaatcagttttgttttttttttttctgtctggagggaaagaatgtactagagaaaaatggtcgtagaaattcatataaagtggctttggacttgataaattagatagccatgtgaattgtttggcttgagagggggaataagggtgagacactgggtaatgctgagaggtgacattttactgagtgcctaccatttgccacatgctactaaccaccttatgtgaatttaattttatcctcagtacagccccttagaggcaatgcgattattgttcgcattttgcagataaattaactcaggttccagggagttcacactgtcttatttgtggagaaactaagcattgaatccaggtctgtctgatgccagggcccttgcgtcagcccttgtggtttgctgccaaggagagaagagaaggactgaaaattcctctatcgcttgcttacatattcaactcttactgaacaaaacatcttattcttactttctaggggacagatgatttctgctgaagattgtgagtttattcagaggtttgaaatgaaacgaagccctgaagagaagcaagagatgcttcaaactgaaggcagccaggtgatgaataaacattatataatgaacacttccccgtgtcatccaaaagtttagaaaaatcttagtgattataagtgacttccagttttcttgctaatttggaaagaacgttatattgagcatgtttaccttcatccttttctgtatttctgaatattttcttagaatatacacctggaagacaaatttctggaaaagaagttactgtttcagagtatgttaagttttaaaagttgcttaacttttctttttttaagagaattttttccacttggtattcttactagtaatgtttgaaatacctaatataattgaaaatgtttgaatttgctaagttaaaagggatatcactttgatgacatgggattacattattttcctgttgatttattaagtatttatatgtcctttgaaatttttttggcggtggcattctttttattttaatatataaggttttgttactttttgataaacagtctttttacatacaaaatttattactgtttgccatatttatagcaaacatagtttccttttttactatttatctttgaagggttgtggagttttttcatatacagtggtttaaaatgtttagttacatatattgatgttttacattctttcatggtaagtttattgtagaaaaataaaatactattaagcaaaagaaaaaagttattctacctaatatttctctgttcaaggtgacttgtttacacttagcgtatacctctctagatatttttctgtgcataaaataacttatacacttatttctacaaatgtgaactttttacaaaaaggggtgatatgtacatatctttgttcttttcatttaactgtatattcttcccttccctactatgcctgtaaagatatttctgtggtatttaaaataattaatttattattatttcccatttatggaaagttccgttgtgtaattttccatttaatggatgaaccataatgatctaaactaattctatactgttgcatattttggctacttccttttttttctgttttgaggcgaacagttagtaatctcataattaattcgagaagtgcaattatctggctgggtgcagtggctcacacttgtaatcccagtactttgggagactgaggcgggcagatcacttgaggtcaggagttcgagaccagcctggccaacatggtaaaacttcgtctctactaaaaatacaaaaaaaaaaaaaaaaaaaaaaagagtgtaattattgattaaactatttgagcgtgtgagagttttgatatgatgaaaatgctgtcttgatagattgtaccagtttgcagatcctgccagcagtatatgagagggcccatgcccctgctccagcaccccctctgggtctagccattcatcttttggtcattttgataggtgaaagatagtatcttaacgtaatagtgttacacattttcagatggtttttggcaccttttgtatccatatcgattgcttctatactgtcatgcactgactacataaagatgttttggtaagtgttggactgtgtatgtaatagcggtcttgtaagattatactaccatgtttttactgcacgttttctatgtttatgtttagacacacacatacttactattgtgttacagttgcctatagtattcagtatagttacagactgtacaggtgtggagccataggttctaccatatagcctaggtatgtagtagacactaccatctgggtttgtgtaagtacactctaggatgttcacacaacaaggaaattgcctaatgatgaatttctcagaactttccccattgttaagtgacacatggctgtatgttttttatttacttttctatggaagtgtttataatcttattgatttgtcagtttcctttatgttttaagtataccagctttgtgcatgccatatttcctcagcttgtttgttgaatttttaacttggtttatggggtctttgccatattgaagtttaagttgtgcgatgaaatctagttcttcctttcctttgtgatgtctgctgttggtgtcatcctttgaaaaagcttccccaccccaaccgcatgtgcaatggaacatgtagctgattcactgttttttcagcacatacacactgagtccctgccatgtgcctggtgagactggggatgtgtgttaataagacaagacttttcccttaaggagttaggagttaaaacagccctttcttttctttttttctcatttttttttaaacctgtttcttagtaagtgtgcaaaaacagttctttcttaatagcagtgtctggtgtgatgggccttttatggggcagttgccaggaagctttttatccaaacaaaatggcagtatatctgaaaaagagttctgacagaaataccgtgggcaacttatatctttttttttttaattttgcttaaataggttaaagtgtttccactttagtgttttgattaaaaaacccaactatttgttactgttaactgtttacattcagtatggtgagtgggctgtctatccatggaagacatgattcataggtaggcgtaagttctaggataagtatgattttgataaggtctccatttttttatagcatggtttttatcacatgctgtttgttacattggggatttattgaatgagtgaataccaagtgaaatacactttaatttatacatccttaaggtggggaagtttttcaatgtatgactccaaacctattactgaatgctgttgcatacttaaaactatgttttttggggggtgatttaagggattttatagagtgttttgatttgtaccctatttgatttatatgctgagtttagaacttggccccataataaggttcaattctgctgcctatcggggggcctcattggctgaaggagcccatatacaaattggtctgattcttacaacagtcatggggaagttggtaggtaatatattgttggctgcagtttttattgaattatggagaggttgtcatgtagttgatacactgtagaatggagactagtcagggccttctgattccaatctctggtactcttgttgctcttgtcttctgttccctttaagtacaacaaataaaatactcaaaaccaattgtaatttttgattgcctatataactttatgccgtcgtcggtaatcaagagttattagtggctaagtatatctatttaaaaatagtaaacattctgaaacttatcactagaaatgttcacaagctgatacaagccatagtaaggtcctctcatacttcatcacaatatttataaaaggtatatgttttctgtaagtaaaatttgttagtaatatttgtatcctaatttatgaaagagagacaatgttttactgaagttccattgaaatgtgtctgcaaataaaaacaataactttaatttcatttttttttttagtgtgctaaaacatttataaatctgatgactcatatctgcaaagaacagaccgttcagtatatactaactatggtggatgatatgctgcaggtaggtatattctttacttaacacatttggtgacttcatttttttgcatacctcacagtagcagcatttttggtgagatttcacttagaacatttgttctcttctagagcataataatatatttttctcatttatgtgggttgtaatttgctaatagagctaaagacagagatacccacacacaggctgtttttgtttttcagaacaccaagtaatcaatatgtatatttttctgagatacctcagagttttttgttgaacgccagcaaagcttgctgtatcacctgaggctttctggatgctctgtgtacttatggatgatatggctccttctcattcaatcagtcaacacatttcagtgctcatatgttctaggccagtgccgggccctggaggttcggtgcttttgttccttttgggaacagttttgcttatcatcgaaaacgtttccagttgcatacagtttctgtttactgcgttaccatccctgaacccaattatgaataaaggagaggcctcctttattcatatttatgtattttacactagagtataatctaggcttagatggttggtatgtagagcagttcttatgagatcggccttccagctgctgagtgtctcaggagacttgaaggaaagagtcagtctgggtgtttagggagggttgttctattaacttataaggaaaaaaacatttattgatggcctaattttcaccaagcactgtactattattgataatacaaaggttgggcagaatggtgctgtcttcctaggggtcatcatgtcctttataggaatctagtgattttataatgtgaggaaggatcaatatcaggactgtcttgagaatgacctcagtctctctgagcactttttcatgtaaaacagtaaagtttagaaaaatgtgaatgttatgatctgccatggttatcttgttactgtatgggactgtacctagaatgagggagctgtgagtcggcatgcggaccgtggttgctcatatccttaattactgtccatatgctcatatctataaattaacaccatgacatgctggtagctcccattacatttcagcgcagcaccacagggttctttgtctctcctttccgtatgtgtacctcttctgtaacagtgagattgtgagttcctcttatcctcagtgtgtttacttgtttgttctaccctaaaatacacagaaaatagtttcagagttgtggacccatacaactcaattatcgaggaaagcagtgtggtgattcttcaaagagctaaaaacagaactaccatttgacccagcaatcccattgttgggtagatactcaaaggaatagaaatcgtcctactgtaaagaccacacacacgtgtttgttcgttgcagcgccattcacattagcaaagacatggaatcaatctaaatgcccatcaatggcagattggataaagaaaacgtacatatactccatggaatactatacggccataaaacagaatgagagcatgtcctttgcaggaacatggatggagctggaggtctttatccttagtaaactaacacaggaactgaacaccaaataccacatgttttcaattataagtgggagctaaatgatgagaacacatggacacaaagaggggaactgcagaagctggggtctactcaagggtggagggtggggggagagagaggatcagaaaaaaataactattgggtactaggcttagtacctggattatgaaataatctgtacaacatacccccttgacatgagtttaccaatataacacaccggcacatgtacccctgaacctaaaatacgagttgaaaaaaacacatacacacaaaaaacaagtcttttacctggagttcagtatttgtttgcagttttttgttttaaactcagggtatatagtcagaatactgtgttcaagtttcagagtgattatttttcatgaaatactgtaagagtcatttgtttctgttgtattctattttagttttttcctcatccttgtgcatttcattattattatttttattttatttatttttttgagacaggatcttgctctgttacccatgctggagtgtagtggcgtgatctcggctcgctgcaacctctgccccctgggttcaagtgattctcctgcctcagcctcccgagaaactgggattacaggtgcctgtcaccatgcctggctaatttttgtgtttttagtagagacgaggtttcaccatgttggccaggctggtctcaaaactcctgaccttaggtgatctgcccacctcggcctcccaaagtgctgggattacaggagtgagccaccatgcccagcctgcattttatttttgagtatgtaaaacattaacatgtttccaaaagtcaaaactatgcagaaaggtatactcagagaaatgtcactaatcctagcccattcccacctccctctcgtaggtgaccaatatcatagttttttttttttttgagacagaattccgttctgtcctccaggctggagtgcagtggtgcaacccccgctcaccgcaacctctgcctcctgggttcaagcaattctcctgcctctgcctccagagtaactgggatacaggcacccggcatcattcctggctaatttttatatttttttttttagtagagacggggttttaccatgttggcgaaggtggtcttgaactcctgaccttaagtgatctgcctgcctcggcctcccaaagtgctgggattacaagtgtgagccactgcgctcagcccaatatcattggtttttaattttttttttctgtgaacatagacaggcagacacatgtatatttttttatttccccctcttatttctataaaacacttattagatataatctcttattttttgcttgtttcacttaacagaatatgccagaaatcattacgtgtcagttcatagagatctcatctccctgttctgtttttgacagctacatggtaccccattagtggatgtaccatagttcactcagcctctgatgtaatgatggacattgtggttggttccaaattttagaattagaaatcatgaagcaaagaataaccttgtgcaaatatatttttgtgttgttgggtgtatatttcatggtaaattcttagaaatgggattgctggataagaggtaactccatatgtagttttttttgttaagatattgccagacattccattttgcattttcatcagcagggtgtgagtgcctggttccctgtaaccttctcaacagagggcattgtcaagctgttacatttttgcctatcagaatggtgtccgaggttgaacatctttagatgaccttaaaggttgcttttacatttttttccctgaattatttgctcatgtctttgcccattttaaggagttctttatatattaggcatatatctctgaacaaagtgcaaatattttctcccagtttgttatttacctttttgtcttagcttataacatttttcacagggtaaaacaatttatttttattttttatatagtctaatttataaaaaaaaatttttttaatctagattttgagtaatagaaagcttttccttatacccaagtttacagtggaattcaccaaggtttttttctagtgcttgtatagtttcatctttagttagacatttggcctgcttagagttggttcttgtctatagtgtaaggtatgtgtctaattttatgttttccaaatggccattcagttgttctagcaccatttattaaaatgtcagtctttgccatagtggttggagatgctgcctttaacatcaaacctccctatataactagatttatttctgtaccttttatactttgcttctggaatgcctgtgtattcatgctccagcaccacccagtttaatgatagaggatcttatggctagttcccttcgcagttttttttttcccccagtatttacctaggttttcttgaatgttgttttttttgtatgaaatggaatgtcagcttatttgatctatgaaaaagtttgttggtgtttttactaagttgtgttaaatctgtaagttactatttaaaaaaaaaaatcaaaacaaggcctggcagtagctcatgcctgtaatcctagcaccttgggaggctgaggtgggaggatcgcttgaagccaggagtttgaaaccagcctgggcaacatagtgagaccctgtctctatttaaaaaactaataataaatttataagttaacttagggagaaatgacatcattatattactgaatttttctgtccaaggacaaggtatacctttccgtttgttaggtgtgtctgcgtcttcaggagtgttgtaattttcacataatggttttgcaacatttcttgttaagtttataccttcatattttatcttaattatactgttaaaaacagcatttctcttccattttatctctgaacttttgtttgttaatgtatatgaaagtcattgatctctgtatattttctgttttggtaccttagtgaattcttttatttgaattaattttgtgattgaatttttctctaatttataaaagttgtaaattataaattttaattaaaattttataattttctatttttgcaaaaacagataattttacttctttttcaattcttatgggttataaaacagataatttcacttttttaattcttatggcttataagaacttgtcaattcttagtttttgagtgctattattaagaataggtgttgagttttgtcaaaggctgttattttctgggcatctacatagataattgaatgactttttttcccctctccttagatatatcaatatagtgaattatagtaatggattttataatactgaaccaaccttgcattcgaggttaaatcccacttggtcatgttgtcatattttcttgatatgatattgaattctcttttctgttatgtaggatttttgcctcagtgttcatatgtgtaattggtttacaattttattttattttttgttttcttcatttggtttaggtatcagcattatacttgcttgataaaaaggatttggaggtttttctttatttgctatgctttgcaacaatttatttagcattaggactacaagggctaagttttggtaaaattcccttgtgaatacatctgaacctgttgtttttggtggggtaattatttgatagctttctctatgtcttctacagaaattgttcatttgaagctttctatctcaaatggtggtaattttggtaatctgtattttctctggaaattattgtattgaagcttttacatttactttcatagaagactaatcttattaaatcttatgcttcaaatttttttctctatttgcatattatgtcccccatgtcatttcttagtttatttgtgctttctgctttttttttttcttgattaaccagtgtttctcccccattttgttaatttttttcagagtcaggattttcatattaattgatctatagtttttctcttctctaccttaatttctgcttttgcctttattatattcttcctttactcttttttgttgtttactttgttcttttactagcattttgaactgggaattttaatttatttccattcttctattaacaagaaataaatattggccaggcatggtggctcatgcctgtaatcccagcactttgggagtccgaggtgggtggttcatgaggtcaagagtttgagaccagcctggccaacatggtgaaaccccatctcaactgaaaataaaaaattagccaggtgtggtggcgcatgcctataatcccagctactgggaggctgaggcaggagaatcacttgaacctgagaggtggaggttgcagtgagctgagattgtgccattgcactgcagcctgggcagaaagagtgaaactatctcccccgcccccccaaaaattaagtatttaaatatatgcattttcctttgattactgcttaaagtatatccttcagctctgatatgtagtgatttaggtttttcttaatccagtttctgcgttccctttcacagagggttgtttaatatttatgttttaattttcaggcagaaatgcttaaaacattttgttatagatttcaaaatatcatgttttaaaaacatttctactttatagaatttactgatactttttttatagtatatgatcaattttataaatataccaggtgtccttgagaagatgtattctttcttaaggggtataagtttgatttatatttatcagatctactttattgattatgttattatttaggatacaggttttctatacctttactttttgtctacttttttctcggtctggttttttttgtactaagagtggtatgttaaacgtctcccccttataaatgcattttttacttttctaatatcttttgtacttttcactttataaaggtggatgctgtatttggtgcatatatacacattagtgttatatctacagtgaattgtggcatttatcattaaaagtgtcccttttatcatacttaatacattttggcttaaattatactttaatactggtatagcaactcatggcttcttgttgtttctgattgtctgcatatctttgcctgtcccttttttaggtgaatcattttgttttaggtaagtcttttgtatacagtatagattcgggtcttgtttgtgagttgaaacccctttttttaataggtgaattaaaccatccacatttatgaatattactaagaaatttgatctcaactgtcatactgtgttatgattactgtgtgcattactattttattcttcattatgtgttttgtttgcatttttattaaacttttttggcatttaggaagttttctgtctgttctgttggttatctttgtatttatatccctttaatgctgttaatcccctgttttattcatttataatttcacttgtcatttttaatagtatttttttatttgcaacagtcaatgaacttattctacttttcctctcttctcattttttagtggctattttttactttgtcagaacatataacatttatatattattattctacacttgttcccacctttgttttgttatattaaattttcaccactggttcttttgccaaagttttcccagggatctcttaattagatgaagcttatctgctagtaggttcctcaggaatgtcttatgtgtacagtagtctctaaatttttgcattaaaattttttcctgtaatcttcatacttgaagagcagcttggctgatagaggatctctgattcacagttctttgacttttgagtctgttctctgttgaacaccttataatttagttttactttttgagaccattttgctcttttctttcatttctttcttgaactcaatcagctatttttaaattttcctttattaggggcagatttctcagttttggttttgaatttctgattcaaggtggtattttatttttccagatgtttgaggatatttaattcagtttgcattgttacgttacagttttgttttgcagttgttttcttgggagaggaatttcatcacctgagatattttgatttgcatcttttggtttctttttatggtagttttgtatctgtgtggggttctttcatctattcatatcatggatttgggtggtttataatactcctcactcaagagtaccatttttttttcttctttttttctttgatgcatggtctcactttgttgcctcggctagagttcagtggtacgatctcagctcattgcaacctccacctcccaagttcaagtgattctcatgcctcagcctccagagtagtagtagctggtattacaggcgtgtgccgccgtgcccagctaattttcgtatttttagtagagatgggatttcgccatgttgcccaggctggtctcgaaatactggcctcaagaaatctgcctgccttggctcccagaattctgagattcaggtgtgagccatcgcacctggactctctctctctcttttttttttttttttgagatggagtcttgctccattggccaggctggagtgtagtggcatgatctctgcccactgcaacctccacctcccgggttcaaatgagtctcctgcctcagcctcctgagtagctgggactacaggcatgcaccaccatacccagctaattttgttgtatttttagtagagatggagttttaccatgttggtcagggtggtctcaaactcatgacctcaaatgatccacctgcctcggcctcccaaagtgctggaattacaggcgtgagctactgcacctggcctctctctcttttttttttttctggtgagatgcagtttgtttgttttattctctttctctcctgttccttcctttcttttcttttttctttttcttttttttttttttgagacagagttttgctcttgtcatccaggctggagtgcagtggcacagtcttggctcactgcaacctctgcctcctgggctcaagcaatcctcctgcctcagcctcctgagtagtgggattacaagcgtgtgctaccacgcctggctaatttttgtttttttagtagagacagggtttcatcacattggccaagctggtctagaactcctgacctcaggtgatctgccagccttggcctcccaaagttgtgggattacaggtgtgagccactgcacctggcctcttttgttttcttttcttttttttttttttttgagataaaatctcactctgtcacctaggctggaatgcaatggcgccattatagctcactgtaacctcaaactcttgggttcaaacgatcctcgcacctcagcatcttgagtagctggaactacaggcgcttaccaccacatcttgctaattaaaaaaattttttaattgtagagattagggtctcattatatgccaaggctggcagtttctttaatagatgactttcttttggtggggggcagattgtatgcccttggatttttttttttggtctcattttgtcttgcagaaccctaaagtttcctcttttgttcctttttctttttgccacccaatctcctaaagatgcttcttcttcttcttcttctttttttttaaaccttattatctctcaaaaatgatgcctttccaagactgctccctgctccctgtagctcgtgctctggtctaccagtactctttttcagtttcttcatagttagagtttattttattttatggtggcgattgtagatccaccttagaacttcttccttcctgtgcccatatccttccttctacacacatttttcagatgcactttatcatccacaaaagcttgtgatggagtatgagagatagcttttgttgggatttggtgtttcttttattatggttaattacaaatgtgtattctctgtcttgttatcctgagggcatgggttttgtgtagtttttagttgatctttttgtcgacctttatttatgaaggatcagtggagagattcagatttaggtagctggtattattctcatccaccagttcaatgtatgtatgtatgtatgtgtgtgtgtgtgtatatatatacacacacacacatatactttgtatacaaagcatatatatatactatgtatatacaaatgtgtgtatatatacacacactatatactatatatatacaaagtatatgtatatacgtatatacatatatacatttgtatatacatatgtatatatgtatatacgtatatacatatatacatttgtatatacatatgtatatatgtatatacaatgtgtgtatgtgtgtgtattttatatatatatatatatatatatatatatatatatatatgcttttttttttttttgagatagattcttgctctctcactgaggctggagtgcagtggcacaatctcagctcactataacctccacccaccaggttcaagcgattctcctgcctcagcttccgaagtagctgagactacaggcacatgccgccacacccggctaatttttgcattttcagtagagatggggtttcaccacgttggccaggctggtctcgaactcctgacctcaagtgatctgcttgtctcagcctcccaaagtgctgggactacaggcgtgagccactgtgcctggcccaatgtatatatttttatttttttaattttatttttgttttcttgagacagggtcttgctctgtcacccaggctaaagtgcagtagtgtgatcacagctcactgcagcctcgaactcctgggctcaagtgatcctcccacctccgtctcttgagtagctgggaccataggcgtgtgccaccacacctggctaattttttatttttttgtagagatggggtatcactatgttgcccaggctggtcttgaactcctgggctcaagcagccctcccacttggcctctcaaagtgctgggattacaagtgtgaggcactgcacctggccctcattatagtttagcagttgattttatttgtaaaattttagttgcatggaaaagtttatatatacctttatcataattccttgtgctatttataataattttttttctatttttaatcctatcatttcatccttatcacttctgaacaaaatgcttttggacagaattgcttatgtttcctcacatgcttagtttttagcacctgattttgaggattaaattgttttctttgcatggatatcaacagcagttgctaagtgtacctgaccggaaagatttctttatccttattctcttaaaggtctgtaacctggatacctctaccaatgaagcaatgatggctcatctgaattttggattccttgataaaatcattatcacaactatttcaattgttattctaaacaataatgactcattacctaaggagacagtaggctattccttgatgggtaattattagtgtagaccaatattaaccaaaaaaccccactatatttaaaaataattaaatgttaatctgaaaataggaattttttgtttatgtggttatttgtgcttttaaaaagtattatgacccacaaatcaccactaaagaacttacataacaaataccacctgttctcgagtaacctatggaaataaaataaataaataaattaataaaagtttaatcagaaaaagtattgctactgctgatatggtggtgtagtaaaaaaatttttaaaaaagtattgctgtttaacaactatattcacataatgaatcagaaagtggatctcagccagtgatagagaaaatttagatgagaggtgaagttttaatgattggaactaagaattttctcttactcagatcctatgtccactggtagtatatgctgttttctgctgtctttatcccaagttttctaccatgatatgctaagaagtaacttgaacatttgcgattcatttaattccctgtttcccttgcctatttgttagtagttcgaggtgcatctagacctaatttgtgctcttcctgctccctttccgattttgatttccctcgtatggcagccaggtgttcacacttggttatcggtggtgggtgtagacctgttacattgggagtagcaggtcagaggtgcaggccgagaagtgtaacttgtagtcttacactttgtgatttaaaataatcataatcattaaaggtgatttttttagtaaaatatctgtgcctactaccatccctaccccctgccccgtagtaataatgacagacaaatcacacatacacacacactgaaaaaagaacacagactgatgggaggttgagaagtggtgcacagtcgttacattctttagcaaaatgtgttctgactggtgatatcatttcttttcttttttaggaaaatcatcagcgtgttagcattttctttgactatgcaagatgtagcaagaacactgcgtggccctactttctgccaatgttgaatcgccaggatcccttcactgttcatatggtaaattttgaattgattggattctttttttaaaatttttttaaagagagagggtctcactatgttgtccaggctggtcttgaactttagggctcaagcagtccgcctgccttggcctcccaaagtgctgggattacaggtgtgagccactgcacccagctggatttttttttttttttaaatacaaagaagaaaggtttttattttaaaatttttgttttattattattttaaaattgacagatagaattgtgattacattctcattcaggtaagaaagaaacctgggccttttatgacatagtaacctgtccgttcccataggagtaactactatgacatagctttccatattggtgttcagtagagaaaggacattgggagttggaaggagatagggttgctctgatgcagttgaggttttgtagactacaaggagtgcatcaaagcctgtggagaattctcacatgtaaacagctctacagtgtttgtagtggggttaactacattttactatatagaaattaaattttactttgaagcagctactgtgtttcgtttttattttaagtagttacctgattgcttttcaatatcttaaatacactctggttttttttttgagacggggtctcactctgttgccagactgaagtgcagttgtgcgatctcggcttgctgcaacctccgcctcccgggttcaagcgattctcctgcctcagcctcctgagtagctgggattacaggcatgcgccaccacgcccatctaatttttgtatttttagtaaagacgggatttcaccatgttggccaggctggtcttgaactcctgaccttgtgatctgcctgcctcggcctcccagagtgctgggattacaggtgtgaggcactgcacccggcctacactcctgttttaaacttaggctatgtttggaagccctagtactgaagaatttttcatggaatctgaaagcagggttgagagaataaacctttgtacaaacaagacttctctatttccactggggagtgggctacgggttggggatggcaggagctgttgggggcatgtggtagctccagaggctgcttgtttcagtagatgtttttaaagttttcaaatcaagggccactggccgtgaaacatttttgaacatgtatgttatcttgctccctccctccctccttccacatgtatatgtattcatacagtatagttatatattgtattcatatagtatatttatatgttgtggacattatgaaatatctataaaaagaaattaaggaggactgatgaaataaactgtattttaaagaatacttttcaaaaagccagtaatatatttccttctttaaaattgtagaggcttgttttcttcactgtttggtttaaatgtcctcctaatggtatagcaacaaaactgacaaatatattaaacaaatatacacttaggaaatggttcattattactgtgcagccaaatccatgttaacttcttggtaatttcatttacttttggccaatctttcacattctgaggggcagactcccattggtttaaccatgtgctgataaagagcttatgctagcttatgctcttgttcctttgtcttgtgcatgcactgctgataatattttcaatccttggcctcctaacagtaatctttttaagtcagttgtctattttgtgacagtaagatgagtttaaactagataatgtatttataaattcatttagctgggcatgtgaaaacctcagcatgtcacaactcaatgagcaagtaaaggcgccccattagtccctatgttgtagaattccaaatacaccagaacacttaagtgtctgacattctgaccttggaagtgtacctgtcagactggtttgctgtattcaaatgtaagaacaaacatgagtctaccagcacaggaaattattttgaggttagctagtgtagcctttcattctctactgggatgaattattgctgaatgatttggagttttaagacagtgatttgctctcagtactgatagaatatttattaaattggtttgtgtatggagaactagtactttatattgcctatttaattttaaaaatggttagttttatagcttgaagaaaatggagaaatctttcaggagaaaggatatttgtttatgttgggagagacgactaatacctaggatgtatattatcctaagaaatggatttttaagtattaaaactcccaagtggcttggaatgagtgtgggagaggctggcagtttgttgaagagattgcttagaattctggcaagtggtttggtgacagtctgcttctaagaaagatttttgtgttctgttttttgctggtcatataatgaattccaatcttacttttgaaactcaaaataatacagggagtgtcaagaaattcctaagacccagctaatttgggttcactttgatggaaatatttaaaaatatatttttaatgtttgtttcaaaatatattttaaaaaatgaaatataaactattatttttagaggggttgagtgttaagaaattgtgtagcaaaattgttacaaatcctttttttaaggtatatgatgtgatttttagaattaatgttgcgttaaatgtatctcttatttgttttcaggcagcaagaattattgccaagttagcagcttggggaaaagaactgatggaaggcagtgacttaaattactatttcaattggataaaaactcagctgagttcacaggtaaaagaaaattttttaaagtacctttgaaaggaatataacatccgtgttcttttaagctatttatagtaaatatgttaaattacaaaaatgttttattaaaataatgccgttttgaacttgtcaagtaaaccaaactactctcagatatggtagtgtgctttgctttttctttctttgactggcttcatttcaatcctttctgtcttttctgccacttggggtttcttagtcatgcttttcaggggtcagggagtacctttcttctaggtggctgccaagatgatacaggctggagaactgaaaggacccacacagctccaaagagcacgtgcgtgtgaggcttcgataaaggaaaacaaacggtacagcaggagagagcatgcctcgggccgagagatttccaggcgcagctcccttggctgccccaggattgtgaaccaccaagatttgtgcgagaaatcttggtttttggagagctctctgaaagattcgagtgagatcttttatgcccttttggttacataaccaggctaagctgtctaaccgattacactaataaacaaactggtcctgggtgccaccaggggcatttcaaactgcaaacagcatgttctagatcattattagctaacctgcttgtccttgtctggccaagtccctcccgtgcttccagctgcctctgggtgagcctggagctacctggtccagctgcgaaaggggtgagcctggagctacctggtccagctgtgaaaggacactgtcccacacggtggctcgttctcacaatttcacagtttcagggtgggattagttaggcctaacgaacctactggtcatgttggttgcttgcaggcctttctagctctatgtcttcgtggaggaagatagcctgcaggtgtaatgccttggaaaatgacaagttttctgttttgtcttcatgtttcctcagaacagggcaaaagataggacatgaatgatggctctgtggagtgttagtttcaggcttacagggttgaagtgtaggtatgaagaggtttggtgggattgatactcagaagaggagagaactgaaggtggacaggggaggaggattctggagatgaaaaggtagaagggaatgagattttgatgtgagggtgacctagaggaggaatgggaccaggagaaacaatattattaggttgttagattacaaatgaatgtctatttgaaattttttgaaagttgccatttagatttcaggtgactttattattttaatagattttagtttgaggcataagaaagacactgtattttgcttagatttactttttgtcttgttgcctgccttttttaggggagcctaattgccatttgtatttggatggagatattttagagtttcttgatcaaaatcttttttatgttaatagcatcaattttaactggtttggggctcggttttaaaaagcgtttttacaagagccaccattttattgagtttgtgagatatttcaaaaacaagctatttaaaacatgtaagaaacatgcttgtgaaagtgagatttaaaatttctaaatgtagcatattggttgggatcagaatgttagttaaataggatacacttctcccttttttcctgctttgaaatgatctctccctttaaataaacttcattccaggcctggtgtggtggcttatgcctgtaatcctagcactttgggaggctgaggcaggccaattacttgagcccaggagtttgagaccagcctgggcaacatagcaaaaccccgtctttacgaaaaatagaacaattagccgggcgtggtggtgcacacctgtagttccagctactcagcaggctgaggcagaaggatcacctgagcctgaggaggttgaggctgtagtgagctgtgatcgtgccactgcactccaccctgagtgacagtatgagactcttgtctcaaaaaacaaaaaaaaccccacaaaaacaaaacttcattctgggtaatgttagctttcaggtatagtggtaataaggctctgtagctgaattcataaaatgaaaattggtagggaagaatggatgccgtggcgtgctactagctttttgggcacttctaccttaaacttttcctcctaggaataacagatacattgtgcctctcaggtgactgtcacttctggaatgattgactatgcttgtaatgatgtgcaacaactgggaggaatatttctctcatcactagtggaagtaaatatttcaatgtctagaatagttttcattagaattgaactttttatagataaatgctcttcaagtattttctgcatctttttagtgcactcttttttatcacagagtgtttggctttaagttgtggactttaaattgtgcagtgcctctgctttgcgggtccttctgctgcaggggaactcttcagggtacccaggcttagcctggccttgcttcttagtctggctactgcttctgcttggctctcattgcactgtccctcttgctgtgggcaggcacttcttcatagccttctatcatgattaaaattcagactcttcgttttaaaaagtaacaattatttgtgatattacttgctactttgctcaattgtcatgcgatagtgctacatctagagtgtctcttttttctctgtcacaagtgtttttctctctcacaaaaagtaccacaatttcatgattctaatagaaataaactttcaaaagtccaagttagctgcaagtttagatgttttgttctttgaccttatagtggcctttgaagcctttttgggtagtttggagcgttgcacttgggttgtggggactcatgcctgtacttcatagatagtagttattgaatgatacaaagttaacatttcctttcagaaattcattattgcttttctcttgcactttcagcctctgactttctttaaattttctttggtcatttctatatgacatttgagattttgattgtcattataattcattagctttgctgtggataaccaagtcacatattgtaccttcctgacatcaggcacctatttttgaaagctttgctacagaatatagtgtggatagttcaatttaaggcagtcattttactggaaaaacaattcagtaagtaaatcttaagacttggaaatttgcactagctttacccatgaaatttacctggagcttagtagtcagtttattattgttccatttttagctacttactgattaatatattatctggaagaatgtaacgatatttagaacattttatgtcatccccttgctttttatttagtaggattaggaataaaattataggggaaaaattattacatagaattaggggaaaagtttgcttagctcccttttgtaagctgatacattaggataaaatcaaaacaaaactaaataatgagttatttatttcgtaatagaaactgcgtggtagcggtgttgctgttgaaacaggaacagtctcttcaagtgatgtaagtatattccttcactggcctaaacatccccaaaataaattattttgagtcatatacacttaaaattttgaaggtgtttactagttccccaactataaatccatggtcacctccagttaggttaattgtattataaactatatataaatattgatggtctgtggagatcatcttttctgtggtagacataagacttgttctttcccgttgctcttttttccaggtgacttttgtttcagacctgagaaacaaagcaaaaatcagaattcagaagcacaactggagcaaataatcataaagttttctctttaaacttcagttatctgattaaactgtctaatatctgtctaatcaaaaggtgaacaaaagcgtcaaacatttgaaagaaattcagttacttttatttatttatttattttttgagacacagtctagctctatcccccaggctggagtgcagtggcacaatctcagctcactgcaacctctgcctcccaggttcaattaattctcctgcctcagcctcccgagtagctgggactacaagcgcccgccaccacacccagctaatttttgtatttttagtagagatgaggtttcaccaagttggccagaatggtgtcgatctcttgacctcgtgatccgcctgccttggcctcccaaagtgctgggattacaggcatgagccaccacgccaggccttctttccacatttttgtagagccaaaaggctctacataaatacataaataatctacataattaagattaattatggctccccaagttcctttcttggctaaagttacgttttccatttgggaatggctgaactttgctgtgctctaggaatagctcaggaactggaagtaagtttggacaagttaacgatgttcatgatgagagccagttgatagaaagttagggaaaacggagacagaaacagaagtgtgtctagcttcctttgttgaaagtatcactaggaaactaggaagtatctttagagggtagtttctgtaacctgcctgcaatagacccaagtgaagctctgtaggagccatttaatatccatattggttgctggtactcccataatctgaatgaatgtcacgggtatgtatgttccaagaccatagatggcagcaaaatccattttgaagctgggcttctcttggagcatgggttgaagtgtttgatgactcatatgttaggccagaaaatggctattagccttctgaagtggaatcagaacaaggtatagaactagatacgcgatcctggggccatggtgggctgaggaaatggtaggtaagaagcctcgtttctcaatcagaagcagatgtttacattgagaatctttattttgcttaaattgagagtcttcatttcatgtgtcttgaatttctaccagtttgaaaaattatttagcttattttagacttacaaacttatttaagtggttgtcaaagtattttaagttattaaagcttaaataaggaaatgcaaactctgctgacatgacatccttattttgctattttctgtgcagtgtattagaaaaacaaaattaactgaattggtggtgtgttggtctaagtgatttacctggtagattcatatacatcccaaatggaattcacatcaggagtgattgtgagttaggaaaagatggcctttggtttcctaccttcttccctttagtgactctcaaccctgaacatatttttggactcttcctgaagttcttacttttttagatggctgtctacttgaaaagcagacctccatgtgttgagagtagggtgtcagcccttcctttgattcttatatttccataggggaatcttaatatagcagctaatattcattgagcacttaactatgtgcctgacgcttactcattttacatttacatctccttgaatatttacactccctgttcaatgtaggtcatatcattagccgcattttatggatgagtagtgagaccaaacagaaaaacataccaacatgcccgaggtcacacagagactctgaagaaatggattgcttagagaattacttgtgaggcagctgagttggaattgcatctttaggcattcctcaagttgcattgcttactcagactttttaaggtatcagtatcacatctttaaatcatatcttttcagagtggagaaaagcagtttggtaaactgcattacaaattattgccacttgatgtcagtataaaacaagttttacactgcaaaatgtgaaataaacatgattcaacagtcttaccttttttaaaatggcctcagaagcatcattttaagttataagtggatcattacaaacattttgttttttttttttttgagatggagtctcactctgtcacccaggttggagtgcagtggtgcgatctcagctcactgcaacttctgcctcccaggctgaagcgatcctccagcctcagcccaaccaccaccaccaacctctgacccccatcccaccagtagctgggactacaagcacgagccaccatgccccgctaattttttttgtattttggtggagacaaggtctcgctatgttgtccaggctggtcttgaactcctgagctcaggcaatctacccgccttggccttccaaagtgttgggattataggcgtgagccactgtacccagtgaaacatttttatttaaatgacattagataagtggaatttccttaaagtgcattatttgtcttctcctaattgtgaaaatagacatcagattatatgtacttactttagactgtctgagttgtttactgattcttaaacatggattgtaagtcttttcttctgaggaaggcaggacagcgtggaagtggattgctgtgctgatgccctgatgaaagaatactgtgattcctccacaaactttggaagatttagaaagaacctggggatttgtttctttctctgttttcatttttcccctccctagcttcatttttacagtacgcataggcaagagaacgattcatgagagagcccacatgtttccgtgtcctgttctctgtgatttgtgttgcagaagcagtctggaatgagtagttgctagatgaatgctgtgtcactagtagtgacttaagttgccaggtccttcttgcttgtttcatcttgcctcttgatttagtggagcaatccatgtccagtagaaatttctgtgatggtagaaatgctcacgatagctgtactgtccattgtggcagcccctaaccatatgtggttctggagcccttggaagtgttgccggtgtgagtgaggaagtaaattttcaattttatttagttttaaaaagagccttattgaaatatatttcacatgctataaaatgcatcattttgccattcagtgatttttaataaatttacagaattgtgcaaccattaccacagtctaacttcataacatttcaacatctcagaaaaacaaaccaaccaaccctgtacacattaacagtcttccccattcctgttcttgcctccaagccctggcaaccactaacctactttctgtcttgggatttgcctcttttggacattacatataactgaaatcatacatggtcttctgtgactggcttccttcacttagcataatgttttcaagattcatccgtgttttagtgtgcagtaacagtattttagattgagaggaaaaaggacttagttttttttttttctaagtagagatgggggtttcgccatgttggccaggctggtctcgaacgcctgacctcaggtaatctgcccacctcggcctcccaaagtgctgggattacagacgtgagccaccacacttggcctaggacttagtttttttttggcttttgaccagattccttaaattgttttctctggcagttctaatattcttgttaatgagagactagtttgtttttaatttaatgctgtgctgatgtaatacttgtcaccccttcagaagaggtggaagacttctttgctttagttctttactgctttgattataagtccatcaaaagtgctgattaagtagcagaaatcagtgggccacatcagttattcacatactgcaggcctgttattaaattgtagtctgctgtagctggtgagttgtgaagtttgtggggacctggagtaactcacaggcaattacagacagtccctgccctacgatggtccaacttatgatttttcaactttacagttgtgtgaaaagcatatacatttggtagaaatagtacatgaagtatccatatgaccattatgattttcactttcagcacagtattcagtaaattacacgagctgttcaacacttgattataaaatgggctttgtattgatttttggaaggattgcctggagatatattctgaaatgcaaaagaaaattaactggtaaagtatttaaatttaagactttcttttacatgtcattttcaaagtatagcactgataacaataataagctaacctaatactatgtatttatcagttatgttctcggaagttgcatacaaagcaataatttataaagaaaatcacttttttttagttatgctgacaattttttttctgtaataaagattcccactagtcatgtaattgaattactggattaagcacattagattgaaagcagtactttgaagatttataaatttgtaaaccaatagtaaaactattttttttttggtgaaactatcttcatttagatattttatgactgttgactagaggatctcttttaatcagccaacttcaagagaattcttggggtatatatgtattttaattcctgaatattgataataatagtatattttacaattgtttagtgttttgtagaaattgatttcagtgtcatgacagtttttttttatttttcccagtggtagagatattatttttcttttcctttgctaacgagaaaacaattttcgagattaagtgatttgcccaacattatgtgacaaaacttctgattcttgttctagtttttactctgtccttctccctctctattcctcttttactttcttttctctatttcttttttaaaattatgtcataacttacataaaggaaaatgcacagatgttaaatgttcagcgagataaatgtatacctcataattcctcctactgccttcacctcaactcgcacaaaggttatcattattatgacatctattaccatagagtagtgttgtctgatcttgaactccatttaatggaatcatacagtataaattcttatgtgtctgagctctcttgcttaatattgtgtctatgaaattcattcattgcatttagcagtaattctttttcattgcaatgtagtatttcattatatgaatattactcattctcttattgatggatatttgggttgcttctagttttttgactcttgtgaataattttgctgtgaacattcttgtacatatcttttggcagatgtatacctttatgtctgcagcacctaattttagaatagaattgctgattaatgggatgtatgtaaatttagttttagtggatcttgcctgttttttcagtttgtgtgcccttcaacaaagcatgaaaattccatttgtttcagttctttactgacacttgatattgtcctgtgttttctaagtgtctatattgaagcaaaaatcacacatacacacatatacaatcaccttttagttttaaaagaaaaagaaaagtttaatagtcatgaaacatattaattacttttagaactttgatcagcatcttttcatttcacttaaaactgctttctgggacttattttagtcaattgtatgtttgaaaagttcatctttgtggttcactgataccaatgtgctgtgcattttcaccatgaatctgtggaacagatgccttttactccaagcagacttgttttctcaagtgcggataattccagaatgtagatgaatacggtctttattctttttcacttagtttgcacttaaatcctagcattatgaagatgaatattgaaaatttgtaaacatttttataacattagttttactttgtacatacagtatcattgatgtttttatgtttcgtttattgcatacttattttgcagttcctcaattactgaatttgtaattctgtagtatatggatctctgagaccacattcaccaggaaggtgaatactgtagttgctattatctttgtgttgtgactttcactgtaatatagtaagagcttgcattttcagcaacattgaagaatttatctaaatgacattctcttaaatgtgttgagaagtgaaaatagtgtttttctctgccattgaggtttgctgtatagaaagtgcatgttgtagcaagttcttagctcagaatgcttggcacagtacaaagaatactagctcaagcatgaagagagttgacttctactgccaatctaagattaactcgctattttcttttttttgagacagggtgtcactttgttgcccaggctggagttcagtgatgccgtctctgctcactgcaacttccacctcctgggttcaagcgattttcctgcctgaccctcctgagtaactgagactacaggtgcatgccacctgcccagctattttttgtatgtttagtagagacaggactttgccatgttggccaggctggtctcaaacttctgacctcaagtgatctaccctcctcggcctccgaaagtgctggggttacaggtgtgagccactgtgcctggccaactcagtattttcatttcagcaaattatatcacctttttatgtcttggattcctcttctgaaaaaatgagtatcataataatacgctgttggtatcataaaaggggaaatttttatttcatctttaacttcaatttaagtgaaagaccaggaagtaatgcactctactttgcgtaattgaaggcaataatttaatcatttaccagtgctgtttctctctatactatgaaagtaatctctggaatggtatggctactgcctgatagtgtgcaataggagagagtatgtcagatttaggaccagcactttttatatgctcatttgtaatgggaatactgaagctataaataacaaccaagaatccatccttgtagtgtgttatgtatttcaacatagcatggtgagtagccacagaaaagaaacacttaccctgaaacaaagaatttttgtgatgagaggaaactgatggtaaatggaagagaagagggtgctctctgttgcctttttattcatttgtctagaaatcttgcttggttatctctctaagcaggaaagatgggattcctcttctttagaaaaagtttctacctgatgacttaattggaaaaaaaaatattttttcattatggaatgttgttttagaactgaaaatgcactatttatctgtctttaatttttgctaatgtttcgagttttcaggctaattatattactagatatattgtgtttttgtggaactaaattaactgctttttaggtacaacccaagatcaccttttcttgatacattagactattccaccaaatgtacttatattgttttgtttttgtattaaagtgcctggaatttctctgaagtgttaggtttttatgaacggtatttaaattggaacaaagtttagtagcatcatgtatgttaggttctgtgaatttatataacacctgtgattctttccttaagaaattctttttgaaattagcatgttcattttgaaggctgttgtctgaaatttcttttcctttctcttcttcttcttctgtttttattttttttttgagatagagtctcactctgtcacccaggctagagtgcagtggcgtgatcttggctcactgcaacctctgcctcctgggttcaagtgactcttctgcctcagcctcctgagtagctgggattgcaggtgcacgccaccacacctggctaatttttgtatttttagtagagatggagtttcgccatgttggccaggctggttttgaactcctgagctcaagtgatccacccgccttggcctcccaaagtgctgggatcacaggcgtgagccaccgcacccagcctcctttctctacttcttaaagtcttaaggcttattgtacatatttaaggaaaagcccaggtcagatgttcccactagctttggtaaaatgaaggggcttgcaactttctgggagtattactcctgtttattttaagtttcaggtttaagcacaatttctaagggacaatgttattgaactgatggttttaaaaatcatagtctttttcaagtgtttaatcagactttttatatgccatatgggtttttaaataaagtttttatttattgagttcctatgtttgtctagctgtgttgtaaaatgaattattatttatttatttatttactttttttgagacagagtctcactctgtcgtccaggctggagtgcagtggtgtgatcttggctcactgcaacctctgcctcctggattccagcaattctcatgcctcagcctcccaagtagctgggattacaggtgtgcgccaccaggcccagctaattttttgtatttttagtagatatggggtttcaccaggttgcccgggctagcctcgagctcctgagctcaggaaatccccccgcctcagcctcccaaagtggtaggattacaggcatgaaccactgtgcatagcctaaattatttttcttaaatctaacaatattcagggtgcttggcagtgtttttctcatgaggatgaagaaatttcatattgaaaaagttcaggaacttgtccacggtcatttacatataggcctatcttgaagtatttactcttctttttgttaattttattgttctttgatagttctgtaattatgtggaacagtattctctatacatagtatctttattcagggatatgtgaaacattgcaaggcagtgtgcttatttatcaaactgtatcaaatataaattattttgttccggatttccctgtgtgttaagtagtcttgacttgtgtagatttaattcaggagacaaaatcttgttcatttctaagaggtagagattaaagcaaacatgaggattaacttttgaaaagagattagggaattttggatgctcagatggtaattccagtaggtaatctgacttttcatttagaaatgtgtgtctgatcgcatgactttaaatgcttcccatttaaaaactcaacacttcttcttgtgcagagttcgcagtatgtgcagtgcgtggccgggtgtttgcagctgatgctccgggtcaatgagtaccgctttgcttgggtggaagcagatggggtaaattggtgagtgccctttccttttaatgtaaaataacatttacaagcatctctccttgacattttcaaagaaatatgtaatcatctaaaagaaatattttatttttttcatatctgtttaacaattgactatgctaagctttttagaagttagtaactatcaaactgagcccctttccttgcttgatctgttcttttataagaggttaaggcctcttaagaacctaatgcttaacaagacagattccaggtactcagaatataaaaaattttagaaaataattgatgatgaatgtaggcaaaaatcaacaagaaaagttcttacccaggaaagagtgaatataagcctttctttctaatgccatataatttagcccaatctttgtgggatcctaatttgcaggtatagaaactttgaggagctgcctgttcaggcttatacagacaagcacctgaaaacctccaaaacaatggaaatcttgttttaccatcagaaaatcaatttatttgttcatgagagatctaactgcttttaaaccaaatattcttttcatttagcaaggcattgtttctctgttagaaaatctacagaggagtttaggttatcaacagtaagttgcttggtgggtgaggatttaaagcaagcattggactcttaccctgtatctccagtgtaggatatacctgtgaagggacccaaatattctaggtcttttcagtcagtatttgtatgcaatttcttagaatgggttacttctgcgaatagctgttcttgtgagttgttatttgaattgtcacaactattcaatatccatcaattcagtaagttactaattatttttctattaatctataaaatttcagtccattcttgtttatttaatcctcagtttgccaggaaaaatagccatcacagtttgtcatctgggtccaacagaccctttaaaaatatatttttagtcattttgtgaaaaattgacggaactaagaataaagagagtgaaaaacaactattagaaatttcaataaaaattaaaatatagcaaacctttttgtaaaaagtacattttgatacacaaatatcataaaagattacagaaaatcatcacatgtccttgagcgaaatgatctaggttcttgctgcagaatactgtctggaagtctttcatgttcagtggctaactagttgagaatactatatttcctttttgtccttagaaatatattcctcatttatcagttcctgagtttgagtaaatgcatttatgatatagctatctagagactcacagtttaagatttcacttatttgacccatttcaccattattgttagagaatagagtgcaatctatctctttgttttcatcttctgaataatctaataattgtgaaacactttcctctgttggtcattattatgggcagaaaataaaaaattctgaattctcagctgtgttcacacttgtcaggagattcattagaaagactcacagacatagcatatagttctattcacagataagatttattacagagatacagtgaggacgcacagctgtatcataagggacaaagacacaggctgagtatggaggaatccacgtgcaggctcccttatgctctcttcctcccagaggggtcgcacagggtatcttctcccagcattgaaaatgcagcaacatttgtgtgaggtttctgtcccggaaacccatcagagactcagctctgaagattttattagaagttagttatgtagacacactgtgcctaaaacacaccaaaatttcagactcctgaaataaagtaggtgtcttaatctatttgggctgctttaacaaaatactgggtggcttataaacaatggaaacttacttctcacatttctggaggccaggaagtccaagatgaaggcactagcagatttggtgtctggtgagggcctgtttcctcattcataaatggccatcttttcactgtaaactcagatggcagaggggacaggggtctttctcaggacccttttagaagggtactaatcccattcatgagtgctctgccctcatgacctaatcacctcccaaaggccccacctcctaataccatcaccttgggtgttagtctttgaacatgtgaattttggagggacacagacatttagacaatagcagtaggaattcagcataagccacatgtttgtacaaatggtttagtttgatcaatttaggaaactttaccagccaaattcccagaagccagccaaaggccaaccttgtaagcacgtctttctgaggctagcagccttaggactttgctgttaactcttttctgcacagaaacgtaaaggtgaactacaaaaatggtgttaccagtctttttacctccataaaagataatgcagtattttgggcagtgcaataaagggtaattatttatttcactattatatcatcttcctaggtgattccatcaatctctaactttcttattattttagtctttgatttcttagtataattggttataatcaatgaataatgataaaataatatataggatgataaaacagcataagacaactaaaattcaataatatgtggtttataaaagagtccagtagaattgtttggcagaattaaaattcattttatcttacaattagggttattgtaagataaaatgaattttaattctactaaccaaaaattagatttttttctccctatggaggacctgtaagaaagaatcaaagtcatgaaatagcaatctctacaaatagttataattgcttataaaataaactcaaataccaaaatttggtccctttgaactctcatggtatactgagtacaacaaatgctgctgttctgatggctagtaccttagtattttagagaccattcagcaatgttaaccatttagcagcaaaaagatcaggataaatataatctagactatttcatgttcaaccaatatattttgatatgctaatgaccactaataagattagcagtaatcagataaacctttaggtggagaaatgggcattaataaaagtataataacttgctgaaagtatagcaatttcaaaaagtcatttaatcttttcattttttcagaaatatgtactttctactttttgagtttttgcttagcattgaatttgtgtgtgtgtgtgtgtgtgtgtgtgtgtgtttctcacattgcaaataggaataatgtgaggagaaaaattttcaagtatagcccatttgaagagaggaagataactgaggtctttttttttcctttctgagacagagtctcacccaggctggagtgcagtggtgcaatctcagctcactgcaacctccgcctcctgggttcaaataattctgcctcagcctcctgagtagctaggattacaagtgtgcgtcactacccccagctaatttttgtatttttagtagagatggggtttcaccatgttggccaggctggtcttgaactcctgacctcgtaatccacctgcctcggcctcccaaagtgctgggattataggcatgagccaccttgcctggccgataactgaggtcttaaaaaaacccagcacattttaatctatatagtttgctgacttttttattgttgttaaaaagcctattatatacataatacaacactgtttatttgtatacctatgtaagatagaaaaatttacattatattgtgctatatattgttagcctcacaagaaagtctgaaggttaacattaacttcctaaatattggagctataagtgggcctttgctgggggtaattgcctctactgcccaaagtaatttatagatgcagtgctattcccattaaactaccattggcattcttttttattttaatataatttgatatgaagaattattaactaagtacacatttgccctttttgtatttttttgggaaattttttggtattgttatgtttttttgatagagatggggttttgccatgttgctcaggctagcctcaaattcctggctcaagagatccgcccaccctggcctcccaaaatgctaggattagcagcttgagccaccatgcccaaccactaattttgtttaaagtggaaaaaaaaaaatgactcttgagtgtcagaaaggtagtgagtgcagataccacccataaggtggggtgggtgatgtaaaataggtgggcaatggtaagagactggaatcattaaaatttgcatgcttggaggaggggctgagtacagctgaaatttagacatttgaggaggaggttttgcccagctgatattggtgtctctgaactccgaggaaaagcctcatggatttggaacccaggactctggggaggggagccagttggctagtgctgacatctttgaggaaatgtgatgaggcttgttctgctagagctggaaaaactgcaaactgaatttggctgctgctgtgggaaagaactgctgctgccgggttgaaggagtgttactggggtaatgctctcaggatcaggaagccaacaggaggaagtctgttcttccttccttgaagtcagcctctagctcctgttcttggcatagcctaacatggagccaactggtagaacagaaatgtggttttcagggtctcagccacagcatcacaaagccaagtgcagaaggcttggcttaataactggaacagacagcaaaggaaaccagggactagggtgtttacagtataaagtgacatgattttatagcagtttatgtactgatatcaatattaattaaaaagcaagttttacataacatccaaaaatagagaagacaaggcaaaagccatgcatgagaacattaaaaacaattagtgaactgaactatatacaaatcatacaaatgaagaaatgacacagataaaagcctttcagtaagttacagtaagtttagattgtaaaatcaggcttagcattttaaacatttatattattagagcagctttagttttacagaaaaaccaaaagtgcagagagtttccattacatcctctcctctcccgcctcaaatttccattatcattaacatcttgcattagtatggtatatttgttccaaatgatgatccaatgttaatagatttttattagtaagtttccatagcttatattagggctcactctttgtgttgtacattctatggtcttcgagctcttaacccctttggtctttttttctttttaaatggtaggctctgctccaatatgaaggtcacttttaatggtcttatttgatgatttctgtttttttttttatttgatgatttctgaactctattctttgaatgtaggtattccccagggcaatttccttagcttttcttctattgtatatattctgtctcttggtgtaacctccttcatgtccatgtcattttcctagtttccttatcagtaaagtaagagatcaaactagaaatttgatcaaactgaggtttttgatctcttgatcaaactgaggtttttcctgacccccgaattcagtaattggctatgtcaaatttgaacccatcacaggttttcaccaagcgcttcccttcttttctctgtttcctttattttaaagctatcggtggtcttattggttgcccagactcaaaatctccatgtaacatttggctctattgtctgtccgattgctctttccattcccgttgccatattacaagtctttgttccctttcttcttgccgcacagcaggagctcctgcttcctgagatcctgtgacttttggagagagggttaagtggagctgtactggaaatggttctctgtgagtagcaatctagctgcttgttattgctggcagaaaagaaacaggacataattcagagagacctgttccattagtgcaaaaagagaataattgcttatttcttctttctaaatgttttgtaaatgtgttttttttgtttgtttgtttttcagcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtgtaagtgttttatgttggtttgtgtgtatgtgaggcatttttcactgtgcagtatatttgagtttttagcaggcgggaaaaaattacttgttcttcttgtggttatgaaaccatagagtcttggtgaatatagagtaaaatatcactaatttgtatttatggtgtgggcagtgggataggtgagaggaaactatctatgaatgaaatctgtgagttacagtatgcttgtagggaaatgcaattggattatgttcagatggaggaagtccttttctgttgcagtgtattccaagagactgtttttgaaggagtttctctcttatggagcatgtatgttagtatggagttgtgtttcaggttctggatctactgactggagtacatttttgaggcaactataaagatctatcattatttaaacagtaaagttatcctattaggatattagatttgtcagttacctaagtcatcttcctcctttgaacagatgaggaagttgaggacaagagaaagcctagctagaatcgaaatcctaggttgccaggtggttttaatacttcacgttgctaattggctaccgagagccagtgtatttgctgtgccaattgtctactgataattttgttggtcactttagatgggcttctatgggatggcttggttgaagtaatctctctaagaatgctattcaaggttagtaatagtggacatgtcccatatagtgcctaccctctgctatacattgttctaagatttttctgtttaattcatttaatgctcaccagagctctataacatgttattgttgttactgttagtatataggtatctttgctatacgttgggaatactgaggcgtagaggtcacattgctgataggtagcagacatgcaaatccagaatgttggctgtagaatctgtgcttttaaccatttttgttcttatactttctttaaaaaacaagtaaaaaataaaaagtggggctgggtgtggtggttcacacctgtaatcccagcactttgggaggccgaggtgggcggatcacctgaggtcaggagatcgagaccatcctggccaacacagtgaaaccccgtccctactaaaaacacaaaaattagctgggcgtggtgtcatgtgcctgtaatcccagctgctcaggaggctgagacaggagaatcgcttgaaccagggagtcggaggttgcagtgagccgagatcgcgccactgcactccagcctgggcgacagagtgagactccatatcaaaaaaaataaagtaaaatgaaaataaaaagtggtacagatgtattgcaaaatttaatgtagataacacatttgccaaatatagttactagcatctttcagatgtttgcaagcacagagataaataaatagatgtataattttgttttgtatttaaaaataaaaatgacatattatactggtctataactttattcttaatatatagtgaatatgttttcatttctgtatatgtggatattcagtattttttttaatggctattttccgctgtgttggtgtagagctatttatttaaccagtgctctattgatggccatgtggtggtgtttctagtttcttttacatatgtttgcccactttgatgaatatttcttttggatttagttctggagatggaactgccgagtcaaatgaatgtgtttgtacacttttttttgtttttttaaagacagtctcactgtgttgcccaagctggagtgcagtggtgcaatctcagctcactgtaacctccacctcctggattcaagcgtttctcgtgcctcagccacctgagtagctgggatcacaggcatgcaccaccacattcaactaatttttgtgtttttagtagagatggggttttaccatgtttcccaggctggtctcgaactcctgacctcaagtgatccacctgcctcggcctcccaaagtgctgagattacaggcatgagccactgtaccccaccattttttttttgagacagggtttttactctgtcatccaggctggagtggagtggcgtgatcatagcttactgcaacctcggactcctcagcttgagggatactcctgcctcagcctcccaagtagctgggactataggtgcatgccaccgagcctggctaatttaaaaaataaaatcttttgtagagacaggatcttgttttgttgcccaagatgatgttgaactcctgggctcaagcagtcctcctccctcagcctcccaaaaattgtgggattacaggtgttagccacagcagctggcctgcacttttggtagataatgtcatgcagttttcaaaaatgtgcagatttacatttccatcacctatatattgggagtgcatatttttctgctcactataatattacccttcttttaatttttacaaaatcttggtttaaaaactaaatcattgttttaaatttgcattccgttaataatgaatgaggctgagcatcttttaatattattggctatttatattctttctataaattgcttattcatagcagttgtcaccttccaaattttaaaatttgatgtgtaggaactcttttctaggtgtcggtagttaataacagctaatgtctattgagagcttattctgtgtcaggcactgtcctaattactttaaatgtattccacatataattgtcccaggaactccatttagtggtcactaggacacgagaggttaagtaatttgccaaaatagctaggaagtggcagaccagggatttaaactcaggcaatatgatgcgtgcttttaaccatcatgctaatctgtctttgatgctgagaataataattgttaaaatttattaagtaatttttatgcattgccttatttaagcttcatgattacccagtaagttctattactatttttattgataaggaaaccaagactcggagataattccccagtaagtgaaaagattggaatttcactgagatctgccagctccaaagctgtcctcttaaccaccctgctatctcctttttttcttgtctcgatgcattttctcaggaaccttaagactggcattaaaaagggggaaacgtgaaaaggaaaaccaaagctaatatcaggggaagatttctttgcttaaaataccagctggatgtgttaagccctgtgtatttcctggctgcctggcaagggctgagtgagtgagggacggcatggaggagtggtgttcagtgtggattctgggagagtgtacagtgagatccaggtgtggcctgctgggtgtgataaacaccgaccagctattgaccaggtgttgggctgggcattagattttctttcgattatgtttatttatgaaagtaacagtctttttcatgtaaaaatcattctgtggtccttgaagttcactcttgagaaacaggcaaatgcggagcctccttacttctctccctcaccatggtggctctgctcttcatgtttcctgcacactctgtccacatgagttgtcacagtaaatttcagtccagctaaaataataatcagttcttaagtcaaagtaggttgtattaatgaggctttactttggagtattttagtaggtaaactgaatgtatttttttcttctacttaagtgcttcattatccatattcgtatttatttagtaaaagcaaaaattttcagaaatggagtcttttgccaatctctcctaaatcacaaaacagttgtgggttccatgtatgtgccaggggctgtgctaattattcggggacacagatgaccaacatagagctggacatcgaaggtcttatggtttggtgaagacagtcgacgtgaataagcaatgccagtgcaatgcagtgatgagtgacgaagggaggaaaggcagtagaagagaggcggacagccagaggaggggtgtgaggaggagacagggcccgaggggccttttgaacggggatgtgaggagaagagagggctcaaggggccttttgaaccaggaatagttatcttggaagtgcaacggtggggagaggttgaatgttaacaagtgaagaaagaatcttctggaatcatcagtagtttgtgcttgtaggacttgttattcctttccctgacccaggtgacttctgagagagtaaatggagcacataaatctggctcttgaagatgcaatcctgggatttgtggctgtttactttctgaaggcacagacttgttctgtgaatggatcttttgcccctaccactctgggcatagaactagtggggccaacatgaatatttcagtcatcctggttatcacctgacactaacttgtgctcacactcttgggcatcactcactgaagcatggcaccttctaataagaccctttgtcagatctagttttagcactttattctgtgctctcctgctctgagggaacatggaataagagctgattcttcttttaaatttgttcactgtggcaaaatagatattgcatcttttcaactcaataaatttattctctgagggcttaatgctccttctgttccatttgtcttagttttgagtttctcccttgtctttccttttttttaattctaccattgtcacaggagcctttattttgccaaaatcttttagtgtaaattaagcatctaccatttgcaaaaatagagctagtttgatcttttactgttataaaaataatgtggttttatggttaaaaagatacaatagaaaaatattaagtaaaattgtaaattacccacaatatcactcccacatacggagcccccttgacgttttaaaacctgcagtttataatctctgttcctttactacaactaggcttcaactctggatgaattacgataggcactaaatagctgaaggagtctttgaaatctcatctcttcatgatttgggtggatcatgcttggccctcctcactacaaagtctgtatgcactcaggcctgtagtgagtgtgctggcatgtgcagtggcagtcaggttcgctgggctcttgggctggcctccaggctttggccaagttgcttagcctctccgtgctttagtttttttcgtgtgtcctgtgagagtaatatcatctctcctacatctattactttgttgatactcacatgataatacccttcgaaaaatatgtgctaaatgaacctttggtgcctaatggaccctcagtaaatatttgtgactgtataaagggctggtcgtggggtggttgttggcaccagggctacagcagtcatggtaaacttacttcaggttatgtgaacactgggttcatatagttgtctctgtggggtttgtctttggatgttacctagacagaaagaatagtgaaaagtcttttggaacgcaagtgtgttatttacaagggaattgccatccaatgaaaaagttaacctggaggtaaagactggcccagttactgaatgttcacattttaaaaattaagagagaagtaaaaacatgtttacttaattagatgaacatataacagaaagcaagactagagagagagggtccctgttttctgttagcacatggacttttgtctaaattggaagttgttaataaacttggtactgaaagcttttttcagaaaaggagatatattttgtaactgctaaactgttaggaaagatggttacatttgactcaatgtctttgctattagattatcctagaaagatgaattattattgtttttattatcttttgtgtgactttcccttaggggcaatagaaaggtcagcagtttcctaattagttaatgtggaagtgaatagtactatttttccatttacctctacctgttcttttctgtatgttatatattttttgaaatgaaaatatctatttttcaaattgtaaaagattgtaaaaatttataattatttcttgttataggcttttaataatttgttaataacttgtctatttaaggtgaaatagacgtatgggaaagagctgtaatagaagtcagggtcttattttagctgtcctgttgtttcaaagaatgtatctttcccttatatcttttcctctcagtttcaagagactacatggcttttaaaggtattatttagaatattttaagtgctgcaagtttctatgaaaaaccaggtattaataattttttttctttttgagacagagtcttgctctattgcccaggctagagtgcctgcttcggcctcccaaagtgctgggattacaggtgtgagccaccgtgcctggcccaggtactaatttttaataatgggctgagatttaatctaaagcccagcaaaagctgctttaatcattatatgatattctatccaagcttcccacataccctacttttttgtccccacttagttcctcctctcttcctttgtttttcactgaatcattaggtaaaataaaaaggttattggaagcatgtatctaatactgtaatatcacagaagagagatattagttgatattaattgaatcctgcctttaagttcttccttctccttttctctcccattcttcctcttgtatttattcatctatcagtgcatcagatgtttattgaagaccaaatatatgtaaggcaatttgttggttactgagtatatggaaagatgcataagatagaataccttttctcagaacctttgcattttgtttaaacctttgttttgatagcgtaacttgatgaagtcactgtgtttacggtatacaaagctcaaaaagtcaccataagtgtagagccagactgagattcctaagttttttcttttgacctcatttgggagctttctgaattaattatgtacctttatggaaatctgagaaatagagtagtgtaactgtttcataatggcgcagtagaaggatagacaagagtctctctggagtggatagacctaggtgtgaattccagcacttgattgtttagtgttgggagagtggcttgaactcccagagctagtttctttatggtgaaaggtggtagatggtacttaactcatttaaacattaggtaaggaatccatgaaataacagttaaagtgtctgcaatagtaaatatacagtatgtatttatttccctgcccttttctccataaaatcatggaataataacagttttcctctttatctctgtaagttggattcttgctaagttaatattaagcccaggtaaagatctagtgctgttttgtttgatttaaaagagacagcatgaatatgttactaatatttagcaagatttaaaaatctcatttaaactatatttataatttcaaatttttacttataatgcatagaatttaataatttatgggcttctattgtctaattttgggtttcagaatatttaaaatagacccagtccaatggcagaaatattagttttttttagattctcatatgctaaatttggggtaatgcacttattatgtgaatatgctgagagcagaaagaagaacatctttagacatccacaattttgatatgtacagtggaactaaaattgagccattgataaagacatagtaaagccatttgatttataccatcaaactgattttaacaatgatgatttttaaagtaattttcaaattcctgtaacctttaaaaaagattttactgatgaggttatttgaagatagtatagacacatcctaaaactcagggaaattttttttttgtgggaggctttagaaaacttgctgagctactgtgagctgaacaaatctagcagctgctaatgattgttattatttttccatttggctggatgaattttatttttgaaaatgtcaatctcacttattcatagtgcatgctgtactccaggtctctgcatatattactgctgttggttaaactgatttgtcaatctttaggtcctaaaataaattaggatgttttggggctgtgactgataaagacattgaagatcatctttgttgcctagagttttacatctgtttgttgtgcatttgatttctcttctgggctctgcttagtcaaaagcctacattatatgtcagataaagtgaattgtatttttacagtgatatacttttcatcagaaagccttaagaattacagccaaattgagttgttcttttcattagatagattaatcatgatgtttaattcacatctacacatgtatactcactagacataaacatgcacacgcatgtacatgcatttttccatgcaggcagttcatactcataaccctttcaaagaggctagctctagtctgtgtgtgtggggctgttctgaccactgctatggcatggaaatattgccatgaagaaattttattctggagtctatcccttatcccctgtttcaggaattctgcctcaacgtctttgcctaacttctatcttgcttagtagatactaggtttggatgaggtctggtaagactgagactttttaaattttggggtgagtcctttaatacagcatttttaaaagtgtggtccacattatcagtgcagtgcagtgaactgtttgttagtaacctgcaatggataagtacagaaagtgaaagtcagcatttagaaacttgtaggaatttgacagaataatgatttattgaattttataatatgaaaattgaacttgtattttacatgtcttgaaattcattcttactgtgtttcataaaagtatttgctcatgactgattgaaaatcaaaaaacaagcaaaactggtcttcaccaccgatggttttcgaaacactgctttcacatatattttacaaggccagcagttcagttttgctgacagaaagatctgaattgtcacctgattccaccttgttcttagaaatgtcaacatccctctgcaccattaatttgccaaaggcaaaaatgatgtttatactggatttgtcacttttgcttttgttgaggtgaagataccatctacttttagagaaggaataacatatttcagggagtggagccaagatggctcaatagtaacagctccagtctacagctcccattgtgagtgacacagaagacgggtgatttctgcatttccaactgaggtaccaggttcatctcactggggagtgccagacagtgtgtgcagcgcacagtgcgtgagccaaagcagggtgaggcatcgcctcacccgggaactgcaaggggtcagggaattccctttcctagtcaaagaaaggggtgacagacggcacctggaaaattgggtcactcccaccctaatactgcgcttttccaacaggcttaacaaatggcacaccaggagattatatcccgcaactggctcggaggatcctgtgcccacggaggctcgatcattgctagcacagcagtctgagatcaaactgcaaggcggcagcgaggctgggggaggggtgcccgccattgccgaggcttgagtaggtaaacgaagcggcctggaagcttgaactgggtggagcccaccacagctcaaggaggcctgcctgcctctgtaggctccacctctgggggcatggcacagacaaacaaaaggcagcagtaacctctgcagacttaaatgtccctgtctgacagctttgaagagagtagtggttctcccagcacgcagcttgagatctgagaatgggcagactacctcctcaagtgggtccctgacccccgagtagcctaactgggaggcatcccgcagtaagggtggactgacacctcacacagccgggtactcctctgagacaaaacttccagaggaacgatcaagcagcagcatttgtggttcacgaatatccgctgttctgcagccaccgctgctgatacccaggcaaacagggtcaggagtggacctccagcgaactccaacagacctgcagccaagggtcatgagtgttagaaggaaaactaacaaacagaaaggacatccactccaaaaacccatctgtatgtcaccatcatcaaagaccaaaggtggataaaaccacaaagatggggaaaaaacagagcagaaaaaccagaaactctaaaactcagagcacctctcctcctccaaaggaacgcagctcctcaccagcaacggaacaaagctggatggagaattactttgacgagttgagagaagaaggcttcagaagatcgaactactccgagctaaaggaggaagttcaaaccaatggtaaagaagttaaaaaccttgaaaaaaaattagacgaatggctaactagaataaccaatgcagagaagtccttaaaggacctgatggagctgaaaaccacggcacgagaactatgtgatgaatgcacaagcctcagtagtcaatgtgatcaactggaagaaagggtatcagcgatggaagatgaaatgaatgaaatgaagtgataagagaagtttagagaaaaaagagtgaaaagaaatgaacaaagcctccaagaaatatgggactatgtgaaaagaccaaatctgcgtctgattggtgtacctgaaagtgacggggagaatggaaccaagttggaaaacactctgcaggatattatccaggagaacttccccaatctagcaaggcaggccaacattcaaattcaggaaatacagagaacgccacaaggatactcctcgagaagagcaactccaagacacataattgtcagattcaccaaagttgaaatgaaggaaaaaatgttaagggcagccagagagaaaggtcgggttacccacaaagggaagcccatcagactaacagtggatctctcggcagaaactctacaagcaagaagagagtgggggccaatattcaacattcttaaagaaaggaattttcaacccagaatttcatatccagccaaactaagcttcataagcgaaggagaaataaaatcatttacagacaagcaaatgctgagagattttgtcactaccaggcctgccctacaagagctcctgaaggaagcactaaacatcgaaaggaacaaccggtaccagccactgcaaaaacatgccaaattgtaaagaccatcactgctaggaagaaactgcatcaactaacgagcagaataaccagctaacatcataatgacaggatcaaattcacacataacaatattaaccttcaatgtaaatgggctaaatgctccaattaaaagacacagactggcaaattggataaagagtcaagacccatcagtgtgctgtattcaggaaacccatctcacgtgcagagacacacataggctcaaaataaagggatggaggaagatctaccaagccaatggaaaacaaaaaaaggcaggggttgcaatcctagtctctgataaaacagactttaaaccaacaaagatcaaaagagacaaggccattacataatggtaaagggacgaattcaacaagaagagctaactatcctaaatatatatgcacccaatacaggagcatccagattcataaagcaagtccttagtgacctacaaagagacttagactcccacacaataataatgggagactttaacaccccactgtcaacattagacagatctactagacagaaagttaacaagatatccaggaattgaactcagctctgcaccaagtggacctaatagacatctacagaactctgtaccccaaatcaacggaatatactttcttttcagcaccacaccacacctattccaaaattgaccacatagttggaagtaaaacaccccttagcaaatgtaagagaacagaaattataacaaactgtttctcagaccacagtgcaatcaaactagaactcaggattaagaaactcactcagaaccgctcaactacatggaaactgaacaacctgctcctgaatgactactggggacataacaaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatctaaaattgacaccctaacaacacaattaaaagaactagagaagcaagagcaaacacgttgaaaagctagcagaaggcaagaaataactaagatcagagcagaactgaaggagatagagacacaaaaagcccttcaaaaaatcaatgaatccaggagctggctttttgaaaagatcaacaaattgatagagcactagcaagactaataaagaagaaaagagagaagaatcaaatagacacaataaaaaatgataaaggtgatatcaccaccgaccccacagaaatacaaactaccatcagagaatactataaacacctctatgcaaataaactagaaaatctagaagaaatggttaaattcctagacacatacaccctcccaagactaaaccaggaagaagttgaatctctgaatagaccaataacaggctctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaattttagactaatatccttgatgaacattgatgcaaaaatcctcaataaaatactggcaaaccgaatccagcagcacatcaaaaagcttatccaccatgatcaagtgggcttcatccctgggatgcaaggctggttcaacatacgaaaatcaataaacgtaatctagcatataaacagaaccaaagacaaaaaccacatgattatctcaatagatgcagaaaaggcctttgacaaaattcaacaacccttcatgctaaaaactctcaataaattaggtattgatgggacgtatctcaaaatactaagagctatctatgagaaacccacagccaatatcatactgaatgggcaaaaactggaagcattccctttgaaaactggcacaagacagggatgccctctctcaccactcctattcaacatagtgttggaagttatggccagggcaatcaggcaggagaaggaaataaagggcattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcctatacaccagtaacagacaaacagagagccaaatcatgagtgaactcccattcacaattgcttcaaagagaataaaatacctaggaatctaacttacaagggatgtgaaggacctcttcaaggagaactacaaaccactgctcagtgaaataaaagaggatacaaacaaatggaagaacattccatgctcatgggtaggaagaatcaatatcgtgaaaatggccatactgcccaaggtaatttatagattcagtgccatccccatcaagctaccaatgactttcttcagagaattggaaaaaactactttaacgttcatatggaaccaaaaaagatcctgcattgccaagttaatcctaagccaaaagaacaaagctggaggcatcatgctacctgacttcaaactatactacaaggctatagtaaccaaaacagcatggtactggtaccaaaacagagatataaaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagacaaaattgacaaatggtgtctaattaaactaaagaacttctgcacagcaaaagaaaccaccaccagagtgaacaggcaacccacagaatgggagaacatttttgcaacctactcatctgacaaaggctaatatccagaatctacaatgaactcaaacaaatttgcaagaaaaaaacaaacaaccccatcaaaaagtgggcaaaggatatgaacagacacttctgaaaagaagacatttatgcagccataaaacacatgaaaaaatgctcatcatcactggccatcagagaaatgcaaatcaaaaccacagtgagataccatctcacaccagttagaatggcgattattaaaaagtcaggaaacaacaggtgctggagaggatgtggagaaataggaacacttttacactgttggtgggactgtaaactagttcaaccattgtggaagtcagtgtggcgattcctgagggatctagaactagaaataccatttgacccagccatcccattactgggtatatacccaaaggattataaatcatgctgctataaagacacatgcacacgtatgtttattgcagctctattcacaatagcaaagacttggaaccaacccagatgtccaacaatgatagactggattaagaaaatgtggcacatatacaccatggaatactctgcagccataaaaaatgatgagttcatgtcctttgtagggacatggatgaagctggaaaccatcattctcagcaaactatcacaaggacaaaataccaaacactgcatattctcactcataggtgggaattgaacaatgagaacacatggacacaggaaggggaacatcacacaccgggggctgttgtggagtgggggatgggggagggataccattaggagatatacctaatgctaaatgactagttaatgggtgcagcacaccaacatggcacatggctacatatgtaacacacctgcacgttgtgcacatgtaccctaaaacttaaagtgtaataataataaaattaaaaaaaagaaaaaaaaatataacatatttcaaaaaatgtgttgctgccacattaagtagattatttctggcagattcagtttcttaactactttttataacccattcattccttcttttcattttttatagcaagatgacacaatgaaatgagaacatgtatttaaagaagaatagagaaggcttaatgattgatttgacaaagttgacgaaaaagggaaaatcaaaaatgactaatctttgaaatgccattatcttggacaatttagagggaagttggttttagaagaataccatagggttgttctacattagttattgaatgtgttgaagttatagttgaagccattagttatgataatgtcttttttttttttttttttgagatggagtctcaccctgtcaccgaggctggaatgcagtggcatgatctcggctcgctgcaacctctacctcctgtgttcaagtgattctcctgcctcagccttctgagtagctgtgattacaggcatgcagcaccacgcctggctaatttttgtatttttagtacaggtggggtttcactgtgttggccaggctggtctagaacccctgccttcaggtgatccgcctgccttggcctcccaaagtgctggaattataggtgtgagccatcaagtccagccgacaatatcttaaagatggagtttaattctctggtcaacaaatacatgtaatgaaattaacaaaaccatataaacaaaagagctttgatatgtttctaaagttagaggagaggataggtaataggaaaagtaactgggaaagaccatcgaaagtttagtagagaaataagtgaaatctcacaaaaggaaaggaagaggggaagagttttataagtaagaggttaacagatttacacctcccctctcagaaaataatttgtttagaaagaaataacaggtgttctgaaacagaatagtttgtagaagtagttatacaaggaactgggggttaagagaagaattataaataatctgtgatatctagtatgtcctatttactaggatctcacactttagtaaaggagacaagcatgtaataatattagtgtcatatatcatgatttcttctttgactatggattacataggagtgcattgttaaatttccaaatagaaattagaaagttactggtctttttaagcttaattccattacggttaagaacatattctgtaagatttcaatcctttgaaatttgggactcattttatggcttgtcttatagtctgtcatagtggatgtaccaagtgcacttaaaagaatgcatattttgccagtggagttgtgttctgtgtcatttaggtcagggtggttgacagtgttatttagatcttctatgtactgatttttttgtttagtggttctatcaattgctgagagagctgttaaaatctctagctattattgtggatttgtctatttcttcctgcagttttgtcaatttttgtttcatgaattttgaagctctgtaattaaaacacaatgaatgctacattttcctgatgaactggactttgtatcattgtgaaatatccttctttatcactggtaatgctctttgtttactttatttgaagttaatatcactccagcattcttacgcttatggttgcatgctatatctttttccttcttagtttcaacttacctgtgtcatatttagtttgtctcttttaggcaacacatccttgggtcttaaacttttatctattcaaataatttctgcctcttaactggagtatctagttcactggcatttacaataactattgatatgattggatttaggcctaccattttactctttgttttctgtttgcttatctgttttttgttcttctatcttccatttttgctttctcttgggttaagtgcatcctttaaaaaatttcattttacttaacataatgacctccagttctgtccatgttgctgcagatgacaggatttcattcttttctatggctgaatagtcttcggttgtcagaggctgagaagggtaccagggtaggaggggatgaagtgagattggttaatgggtacaaaaatacagttatatagaagaaataagacctaatgttgtacaattcagtaggttgatagtaaacagtaatctactgtatatttcagaatagctagaagataataattcaaatgttcccaacataaagaaaagataaatgtttaaagtggtgggcatcccaattaccttgatttgataattatagattatatatgattgtatcaaaatgtcacatgtactccccaaataggtccatctgttatatattaataaatttttaaaaactatcataacatttctttggggtctttaactatttgtttttgcactattttatttcttagaggtgattttggagtcacaatacacatcctttctattgtactaccttatgtaaaatgtaagcacttgtagtcttttatgctacagttgtcatgttactgtatttacatgttataagccctacaatacagggttttgtgctttaagcagtctcatgtatattatggaagtaaagagggaaaaacagtgttttatatttatccaggtatatattaatatgatatctacagttcttttttcttttctggacactcagctttccacttgtggtatcactttcctttagctgcagaattttctttagcccagggatcagcaaactttggaagcctatgggccaaatgtggtccacctgtttttaatcaataaagctttattggaacactgctttgctcatttgtttatggtttttaatgactgcttttgcaccgtagtagtagaattgtgcagttgtgacagagactgcaaagcctaaaatatttactcttcgcccttttacagaaaatgttagccaatccctgctttcggatatcttccagtgtatgtctgctggtgactgattatctcaggttattataaaaaatgattttagtttacctttattctggaaggatatttttgctggatatagttctgttttttttttctttcggtactttcaagatatcgttccacttctgacctctctcctttatttttctctctctttttttaatgctctctctcagcaaaatcatctccatcgtttctgatgagaagtcagctttcctttgtatttttgttcccctgtatataatgtgttatctttttctggttgctttgaaaattttactatatttggttttctgaagattgactttgatgtgtctggatttagttttatttgtatctacatttcctagtatttactgaagttacagatttgtagagttgcatcttttgctaaagatggaaaattttggccattatattttcaggtatacatttgcacctttttacttatccttgccttctggcattctaattccacttatgttagaccttttgatattgcactgcaagtcactgagcctttgttcactttgtttgtgggagggaagaaacagtatttttttgtatctgtctctgaaattgaataatttctgttgctctgtcttcatgttcactgactcctttgtcatctccagtccacttttgagctcatttgtaaattttaaaatttcaaatgatctgtgtttttatttctaggatttccatttgggaatttagtttctgtgtctccactgaactttctttttttgcttttttattggtaccgtttttttctttggtcatagtcgtaatgtttactttaaatctttttctgcaaactccaacatctaattcatctcagggttggtatttcttgactgacttttctcttgagtgttggtcacattttcctgtttcttcataggcttattaatttgggagtgtattctgaatgttgtaaatgatacatcctagaactggcttctgttatgtttctccataggacattgaggttgtttagcaggcagttaacttggctgggctccagctccaagctctctcttcctgtggggagaagcagcttaaatcttttttcagttcttttagatgtagctgggctgctgggagtctgtccttgtgagaggtgacagcgtgctggcagtcctcacagccctcgcttgctttcagcgcctcctctgcctgggctcctactttggcggcacttgaggagcccttcagcccaccgctgcactgtgggagcccctttctcggctggccaaggccagagcccactccctcagcttgcagggaggtgtggagggagaggcacgagcgggaactagggctgcgtgcggcgcttgcgggccagctggagttctgggtgggcgtgggcttggcgggccccaaactcggagcagccggccggccctgctggccctgggcaatgacggacttagcacccgggccagctgctgcggaggctgtactgggtcccccaccggtgccagcccaccggcgctgcgctcgatttcttgccgggccttagctgccttcccgcggggcaggcctcgggactgcagcctgccatgcctgagccttccccgcctccgtgggttcctgtgcagcctgagcctccctgatgagcaccgccccctgctccacggcgcccagtcccatcgaccgcccaagggctgaggagtgcgagcgcatggcgcaggactggcaggcagctccacctgcagccccagtgcgggacccactgggtgaagccagctgggctcctgagtctggtggggacgtggagagtctttatgtctagcttagggattgtaaacacaccaatcagcaccctgtgtctagctcaaggtttgtgagtgcaccaatcgacactctgtatctagctgctctggtggggccttggagaacatttatgtctagctcaaggtttgtaaacacaccaatcagcaccctgtgtctagctcaaggtttgtgagtgcaccaatcgacactctgtatctagctgctctggtggggccttggagaacctgtgtgtccaaactctgtatctaactaatctgatggggacgtggagaacctttgtatgtagctcagggattgtaaaccaccaatcagcgccctgtcaaaacaggccactcggctctaccaatcagcaggatgtgggtggggccagataagagaataaaagcaggctgcccgagccagcattggcaacccgctccggtccccttccacactgtgggagctgtgttctttcgctctttgcaataaatcttgctactgctcactctttgggtccacactggttttatgagctgtaataccgtggaggtctgcagcttcactcctgagccagcgagaccatgaacctaccgggaggaacgaacaactccacatgcgccgccttaagagccgtaacactcaccgcgaaggtctgcagcttcactcctgagctagcgagaccatgaacccaccagaaggaagaaactccgaacacatctgaacatcagagggaacaaactccggacacgccgccttcaagaactgtaacaccgcgagggtccgcggcttcattcttgaagtcagtgagaccaagaacccaccaattgcggacacacttgcgttgcataggtcattggtcagctagagatttgggcagagttcatatgcagaatttgggtcttctttatgtttctctctgatttctcctctcactttctagccgctgtagtcactctgaattgtcctctgtctccttaggtcattgaggctgtggtttccggctgagttttacctgaatttttctgagtggggcgtatcttcaggaggagagccatatgtaaaagtagaaatttttctagtgccattccttttttttttcatatctagactccattctagtttctgctaccttttgttcgttcaggtaatcttttatatttcatccagattttatagttggtttctgtggaagggttgatctgatagaagccactttatcattcctggaagtggagtctctggaatatattttaaaattgaaccagtaaatatacactttgttcacaatgttttacatgaaaggataaaatagtaacatgatagaaattcagaagtaacctgatgaaaatatcacagaatcgtagttttgtttttctgacttaagataacagttcaaactgaactgtcctctctctctgaaatgaatactttctactttaagtagatggaagctttgctaactttaatagtctcgaagtttaccagggtcactttggttcttatgttttagttttgtgtgtttgtctgtgaattataaactcagaattctataggcaacaaaaatattctttaaactttttgtcagcttgacaatgctatgcctttgcatgggcttggtgttcactggacatcttgtgtctgaaaatttctctgagattgaatttgggaaacttgcagccattatttcttcaaataaaatatcagccccattctcttcctcctctccttttggtattccaattgcacatatgttgggccatttgataatacataacagattactgagcctctattcatttgttaaaaaaatcttttatctttttattcttctccttggataactttaacctattttcaagttcacttactctttttctgttttatctccacttggttcttaagtccatcagctgatatttttttatttcagaaattgtagttttacttctaggatttctgtttctttttaaataatttataagttttttgtttgaaatttttcatgtattgaaagcattttatttcattgaggatttttataataattgctttgaagtctgtgtgttctagtatctggttcattctggagctgtattcagataggatttgggtctcctttcttgctctttgttttctggggctccccccagccttagccctcagtgttcatggttttccagcttcacttttctggttccccaggccagaaagactatttttggcttttctgtggcttctttgccactgtgccttagcttcaggataaaaattgcagtgacaggaacgtatttgtattgttccttgacttccctactgtatgtgagtatgaacttcataccagattctgtctgcttctatttactgtttttttaagtagttgccttttcagtctgttcaggttttatagttgttttctgccagagagaggttggttcagtaggttcttaaatccatcgtacctgagtggacattcatgttttagttttgaagtaattttaaaagcaaattaatttatactgttgctgctactctattcattatctattcataataaggaggattgcaagtaatttctgatatctatagatgtaagcactgagtaggaatattaggttcacaaatattttattattgaatatcaactctgagccaagcacttgtgatagaaagaaaaataaggcaaactactctcagggtacttaaaatctggtagaaacataaagggaagattggtgggcattgatttcactgacttccacatactaagctaaatcactttttgcatttgttcagccttattattagggatagaacttacttgtaaaaagaaaaaaaaattcaagtttttttacaattggagttaattgttactgttttgtttttttttttttttttttgcatttgataggctttttaaactagcttggtgaaagtagcttttttttaaaacagaggtctgtcttgttgcttcttgttccaagagtttagcctggtccttactcagaaacattgcttaattccatgacagcttattgttataaatttgtggattattttgccattttcttaagtactcttaaaaatagaaaatcctagaagagaactcgggaatttgcccgaatgtcgcaaaacttttctgataattgttcaaacaagggagttttaaaaattgttgtcccttgtgcttacaggttgattagagatgggggaaaatggtgacagactgggaactggagaacttggcttgattgcaaacttgaagaaacactctctcttagtattgtatgtgctctaggtgggcaacaaatgagagctcacagccagagcaagtccatgaaaaaggactgtggtggatttcattgtaaacgtgttcagtgttgtagggctcatctgggtcaaaaattaaagatgtttagtaatccaggaaatacaaaaatgatcagaagtaggcttctgatatgggacagacactcaggagcgaagtaaggatttgagatagagtcatccacttaaaggtgatagttaaacttgagaataggaggaggagagagactataaaagaatgtgcagaggtctctgaatccatcacatgacaaattgtatagtttctcactatcactttgtctaacccagaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttaggtgtgttattctttttaattctcatgtgctggatctgttgggctttgtttgacttgcatagcattttaagaaaacctgaatttgttgtcacctatacaaatcaagagagtccactaaaatacgttaatgtctcctgagaagacatcattctgacatggcaacaattggtcagaactgtgtgttatctcttcttatttacggagattcccactgttttctgccgtctaaactctgaccggctttactccctcaggatgactccaccctggagctcctcgagtcttctcttagagtctttttaagcaacaaaggtagtttgttaattagtggaggaggtttgcctgtatatggagaaagtatttgttttcctgctttttgaaggccttttggctcatgttttaatattaaaaataatgtaaataatgtatgtacagtaaagaattagccactatggaagggactccatgccactcccaccatcttcactgcctcgcctcactctccctcgggtctcttgtgtttgcttccaaaaagccttctaacccctctctgcctgccccctacaacccacaaattgggctctgcatattcttttggatcttgttctttttctgtttcgtacataatatcttgatgatcttttccattaacactcatattctttgtttttaaattaccactggcatgtttttaaaagagttactctctggaaatagaaacttctcttgggtggattggggtttggagccaggctgattcttggaattgtttggctactttttccctgtgtggccttgcacaagtgtcttgactttttcaagtctgttttccttttggtaaaacagtaataaaaatgctaaccttgcaggatttgttgtgaggttccgtctgccctgcaaatgccttcagcatagtatgtgctccagaaatgtatttaccagatgattcagtacagccgtaatcccaaggcccaaagatttcccagagatgggaggtgttatctgtatcagtggtttgtaatggattttgtggaggaagaaaaatgatttttattattctagattttcaaatatttcaaatatggatacattgattataataggcaggccaggaataggcttcacagctatacattctgttcctatgtttattaaaaactgatgactggttctccgtaataatcatttaaggcctgtttttgcaaaaaataagattagtgatagctttctaaatgatttaatcaattttagctaattattattgattatcttgaatttggtaatttgaaaaatactatttacataaagctaatagggtgatgggtgcagctaaaagaggcttttctctgtttttgctgttacaggattaggatatgaatattaaaaatacttgtttacttcttatactaactggccctacattaaagtattgtactactttattcaaatggtaccctctgatcaacttatctagtacatcctggttataccgaattactagtagtatttgaatggttacatcttttataaatttttacttcagagaaagtccaagtatgttctgactgtgtttgtctactggctaaccacattaaacattttcctactgtaaagcttggaataatcaagttactatccagtgaatggtttttaaattaaggtgaattgcagtttgttatatgtacagaggcttttgtatttagtctgtaatggattaattcaattaattatgtctacactctttgtaatcacattgtaaaatattgtgccaataagtgtgattttgtttttgtgatgtattattacagtttatgatatttatagtataatatgagtttattatgttaaagtactatgcttttacataacatattattttgcctgttggtctgggaaatacagtatttcaagtgtcatggtagaaattctgattatcaatttttttgcttatacacattcatgtatatattggagtaaggattttgaaagcaagtgctgatttttatgtctcatacccagcattcaaatttgacaggagggttggaccttactacactgaataaaatttcacatgatttattaaagattatttaaactgtttaaagttcgtttggtggtagttttttaatgtacaaaggatggtcagtctttgtaattaaataataagtgaagacattttattttgcttaattttggagtactgtcagattcttataaaccttgaattcttttgaacatttttatagttcatttgatgaatacagttcagaacttaaatctggaaggttggaatggagtcctgtgcacaaatctgagaaattttggagagagaatgctgtgaggttaaatgagaagaattatgaactcttgaagtaagttttttgttctactttacactcttaatatctgttatcccaaatcctcaccaacactcgtttttgtcactctaaattttagatattctatggttttaatttgtattttcttgctgactaatgtggttgaatgccttttcatatccttttgaccatctggacatctcttcttggagaagtgcctgttcaagtctattttctttccttctacaggagttctatatgtattctgaacatgaagttgttgtctcatatatatattttcatcacagccattttgtccccactctgttgcatgccattttactttttaatggtgtcttgatgaagagatgctctaaatttcgatgtaggtcaattcatcagtctttccctgtatggctagtgcttttctgtgtcctggttaagaagtttttgcctactcaaggtcatgaagatgtctttatgtgatatctcctagaagctttattgtttaacttcttatatttagatacccagtccatctggaattgatttttgggtaagggataaagtaggaaacaggatttatttttttctttccatagatatctaattgaaccagccccatttattgaaaacacttccaccagtgccctccaggtttacctttgtcataataagatgactaatatgtgtaggtttctttctttttttagtgaggtataatttgtatagcatacaattcatctgtttaaaccgtagaattcagtggtttttagtatattcagatatttgtacccattgacaaaatcagtttagaacattttcattgcttcaaaaagaaaccccatatcctttggccgtcacctctctatccacccatctacctagccctaagtaaccaccaatatctcgatttgcctgttacagaaatttcatgtaaatggaatcatataatagatttttttttgtgactggcttctttcatgtactgtaatgtgttcagggctcatccatgttgtggaatttatcactacttcattcctttttatggttgaatgattttccgttgtggataagaccacattttatttattcactcatcagttcatggacttttgggttgtttctaccttttggttattataaatattgccaataatacttgtggtatgagttgttgtgtgggtgtatgttttcatttgtcttgctgttagatacttgggtgtgaaattgctgagtcatatgttaactctgtgattaaccatttgaggaactgccagactgttttccaaagtggctacacaattttctgttcccaccaacagtgaatgagggttctgatatctccacatctttgccaacgtttattatgacctttttgattctagccactcacactgagtgagtgtgcagtgatatctcattgtggtgtctatttgtatttcctgatggctgataatgtcaagcatcttttcatgtgcttattggccatttgtatatctactttggagaaatgtctgttcagatgcttggctcattttttagttggattgtcttcttattacttagttgtaggggttcttcatatattctggatacaggtccaagatcatatatgtgatttgcaaatattttgtctcattttgtgggttatcttatcactttgttgatagtgtcctttgaagcacaaaagttttaaaatttcgatcaagtctaatttgttgtttccttagtttctcatgcttttggtctgttgccaaaactgatttactcccatgttttcacaatatttttatagatttagttcttacatttgggttcttgatccattttgagttaatttttgtatatggtatgaagtaaggttccaacttctttcttttgcatgtggctatcctgttgtcctaagtactatttgttgaaaagattgttctttacctattgaattatcttggcatccttgtggaaaatcaattgactatagacatgggtttatttctgaactctctgttggtcagtaagattactgtgatagtagtaccacactgttttgattgctgttgctttatagtcagtttggaaaacaggaagtatgactcttataccttttttctttttataaaaaaaaagagtgtatctttatttaatgagtctctaattggtagatattttaaattgttactagagtttgctgtcacacacagtgtgagaattactaatatatactttactacaacttttaaaatagactttaatttttagaacaattttagattcacagaaaaattgagcaaaaagtagagtgctttcatatgctacctctacctccaccaacacacagtttcctgtttctaacatcctgtttttagcattagtgtggtacatttgttacaattgatgaactaatattgatatgttattattaactaaaattcatacatagtttgcattaggattcttttggggaacctgccccgaaaatcacgtaggttcttttctattttcctaagtgtcagctggcttgagaaataaagggacagagtacaaaagagagaaattttaaagctgggcatccggggaagacatcacacgttggtaggatccgtgatgccccacaagccacaaaaaccagcaagtttttattagggagtttcaaaaggggagggagtgtgcgaataggtgtgggtgacagacatcaagttcttaacagggtaatagaatatcacaaggccagtggaggcagggcaagatcacaggaccacaggactaaggcgaaattaaaattgctaatgaagtttcaggcaccattgtcattgataacatcttatcaggagacagggttttgagatcaaccggtctgaccaaatttattaggcaggaatttcctcttcctaataagcctgggaacgctatgggagactggagtttatttcacctctgcagtctcaaccataagagacaggtacaccctgggggggccagttcagagacctacccctaggtgcgcattctctttctcagggatatcccatgctgagaaaaagaattcagcgatatttctcccatttgcttttaaaagaggagaaatacggctctgttctgccctgctcaccagtggtcagagtttaaggttatctctcttattccctgaacaattgctattatcctgttcttttttcagggtgcccacatttcataatgctcaaacacacatgctgtacaatttgtgtagttaacgtaattattacagggtcctgagacgatatacatcctcctcaactgacaggattaagagattaaattaaagacaggcataggaaatcacaagggtattgattggggaagtgataagtgtccatgaaatctttacaatttatgtttagaaattgcagtaaagacaggcatgagaaattacaaaagtattaatttggggaactaataaatgtccataaaatcttcacaatccacgttcttctgccatggcttcagccggtccctccgtttggggtccctgacttcccgcaacaggattcactctttgtattgtgtagtttcctcattatgaacttttcaactttgtgtatagctctgtgggttttgacaagactatctttgctccaatgaattgcccttgctctgttaaaagatcagttgactatatttgtgtgggtctatttctgggctctctgttctgtttcagcgatctatttgtctattcttttaccaataccacattcttttgagtactgtggctttatagtaaatcttgaagttggtagtgtcagtcctctgactttgttgttctttaatattgtgctggccattctgagtcttttgcttttccataactttagaatatatggaaacaaacattagtttgtcagtatctacaaaataacttgccaggattttgattgggattgcattgaatctgtaaatcaagttgggaacagttgatatcttgacagtatagagtctttctacttgtgaacgtggaatatctgtttatttgtttcaattttctttgatttctttcatttggcttttgttttcctcttatagatcttgcacatattttgttacatttatacctaagtatttctctttctttctttctttctttttttttggtgctaatgctgatggtcttgtgtgtgtgtgtgtgtgtgtgtgtgtgtgtgtgtgtgtgtgtgtgttgttgttgttgttgtccaccaccctccccgccctgccctttttttttttttttttgagacagagtctcactctgttgtccaggctggagtgcaatagcgcaatttcagcttactgcagcctccgcctcccgggtgcaagattctccagcctcagcctcctaagtagctgggattacaggcgcgcaccaccacgcccagctcatttttgtatttttagtagagacggggtttcaccatgttggccaggccagtctctaactcctgacctcgtgatctgcccacctcagcctcccaaagtcctgggattacagatgggagccaccatgcctggccttcccccgcctttttaagaggcaggatctagctctgtcacccagattggagtgaagtggtgcgatcatagctaactgtaacatcaaacttctgggctcaagagatcctcccatctcagcctcttgagcagctaggactacaggcacataccaccatgcccggctattttgtttttgttaaatttttgtggagatgggatgtcactctgttgcacaggttggtctcgaactcctggcctcacagcagtcctcccatctctgccttccaaaatgctaggattataggcatgagccaccatgcttggcctagtgctgtgtttttaatttgaaattccagttgttcagagatagtgtatgggaaaacaactgactcatagatgtaccttgtatcctgcgactttgctgtaattatttcttttatttccttttttgtcttattacacttaatgatacttccaatatgatggtgaatagagtgatgagagggtacatccttgcgttgcttctgatcttagggaggaaagcatctagtttctcattattcagtatgatactaactatagatttttttttttgcacatcatctttatctgataaagttgagaatgtttccctctattcctaatttgctgagagtttttatcatgaatggatgttaaatttgtcaaataattttcctgactctattgatatgatttttcttttttagcctgttgatgtgatgggctacattaattgattctcaaatattacgctagccttgcatacccggactcaatcctgtttggtcatagtttataattcgttttatatgttattagatttgatttgccaatatttttgttgaggatttttgcatctatgttcatgagagatagtgctctgtaaatttcctttcttgtgatgtttttttctgattttgggattatggtaatgttggtctcatagaatgagttaagaggtgttcccgctgcttctttttctggaagagactgtagagaattggtattgtttacttcttaaatgtttgacataatttaccagtgagaacatgtgggcctgttgctttctgttttgtaaggttattaattactcatttctttaatagatacaggcctattcagattatccacttctccttaggtgagcactgtgaaggccacctaacttccataagactggactccttggggtttttatttctctagctagttcttgttaaatctttagcaatgagtcagttaccctttaagtgtttctaccagttgatagatccaacagcagtttctgctgccaataagctttgattctctgtcacccatctctctagcttccagggagatggtttgtcctgggacctcagttctctgatggttcctgatggatctaagaagacttgttttgttcagcatttttttttttcctgctgtgaggattggagtgatgatttccaagctctttacatgctgtaccagaaactggaagtctgctcttttgtttccaagatgattttggctatctgggtcccttaacattttatatgaattttagaatcaccttgttaaaatctacaaggaacccagtttggactaatagggattctgttgaagctgtaagtcagtttgaggagtatttggtattcagatccatgaacctgggatgttttctgatttgtttacatcgtatttaatttctttcaacagtgttttgtagatttcagaaaataagttttgcatgtcttttgttaaatttatttctaaatattttgtccttttgatgctattgtaaatgaagttgttttcttctttttcaattatttattgcaagtttatagaaaaacaattgagttttgtagattgaacttatgaaacctttgtctttattggattcctttgcatcttctgtctgctgttggcccttgaaaatgcaggaattagggatgccgaccctcctcccccacagtcaaaaagccgtgtataacttttagcttccccaaaacttaactactaataacttcctgttgactagaagcctcactgataagaaacagttgattaacacatattttgaatgttacatgtattatatactgtattcttacaataaagtaaactagagaaaaaatgttattaagaaaatcataagaaagagaagatatatttactgtccattaagtggaagtggatcattgtaaaggtcttcatcctccttgtcgtcatgttgagtaagctgagaaagagaacatgttgatgttgctgtttcaggggtggcaaatgggtgtaagaaaatccatgtgtaagtggacctgtgcagttcagatttgtgctgttcaatggtcaactgtacaagattatgtcatctgtgaatagagagttttacttctcactttttcaatctgagtgccttttatttctttttttttgcccagttgccctggttagaacctctcctatgcaaatgtgtttatgaattctttgttctattccatcatctatttgtttattcttactccaatactatgttatattaattgctgttcattattttctgtcttggtgtctgatagtatgagcatgagcatgcctgttcttccaaggtgtcttggtgctttctggactcctgcatttctgtatgcattttagaatcagcttgtcaaacaaatggtttgacgggtatttcgattgggattgaagccatagtttattctagggggaattgatattattttaatttggaaggagggtcctccaatccatgaacatggtagtatatcccttcattcatgtaggatttcctttggataatgttacactgttgtctttcattaaatttattcctttgtgtgtgattttttttttttagtgttcctatagatcttgtattacagtttttcaccttctacctcaacttcattggaactttttgtgatgatagaagtagtttatatctgtgctgctcaatacaatagtttgtcactaaagagcactggaaatgttcttggtagctgagaaactaaatttttatcaatttaactttaaaacaaaccacatgtggctaatggttgtcatatgaggcagcaaagtttgagtctggtatctaaaaataccggtataaatagttctgtgttgtaaatcaggttgctccttggcttacctccctgccagcttggtatttggttttctcatgtttaacatttgttcttctgactttccgcttcaatattttattgtttttgtttcacttcccattttgtccttccttatagatttatacttttaagaaatcctcttattgtcatttaaatgaggcatccagatggagcatttttaggcccacctatctctgttgtttagactccattttctgtgtattactgaaaatgatacattattctcatttaaacaaaatggcaaatcaaagtgagtggttgatgtcagcaagactgacagaataggaagtgggaaggagtggattagtttttcactgttaccttatgactttgagttttaacaacagaaagagcttggaggttttttttaaatctagtgtttagaaaacttgaatatagtggaggggaacgttttacaagttattacaaaagcattatgcatatctttattatgatacacttaaagagacttttgaaaagggtactttctattttctggtgttaggttttaatttttgtggcttcttcagattactccctttacctttgtatgacactgtgatttttctgaataaccaggaacaatggtatatggtatttttcttttttttttttttgagacggagtctcgctctgttgcccaggctggagtgcagtggcgcgatctcggctcactgcaagctccacctcctgggttcacgccattctcctgcctcagcctcccgagtacctgggactacaggtgcctgccaccacacccagctaattttttctattttttagtagagacagggtttcaccgtgttagccaggatggtctcgatctcctgacctcgtgatctgcccacctcggcctcccaaagtgctgggattacaggcgtgagccaccgcgcctggctagtatatggtatttttcttttatgtttatatgatgatgagaaatttgaaattattgtttgtttgtctttagtttttattcttgttaatggagaaaccaaactccgtgaaatattttaaagaggcttcttctgagccaatatgagtgaccaccatcttgggaaaaacagtcttaaggagccctgagaaagtgtagctgatttctgttttacattaatggtggccagttgtgcctaaactccgaaagggaaggggtattatgagttttttctgatccctcttcccatcatagcctgaaactcagtttttgaggtttctctggggtccccttggcccagaagggagtctgttctgtcagtggggttgttaccagttgtgaatctgtatgggtctgcagcaacgtgatccttgcctccttggaggaaataattctgctgaggggcagaaataggtttaaggcagagtaagagaccagggcaaattttagagcagaagtgaaggcttattaaaaaagttttagaacaggaatataaggaaataaagtacacttggaagagggccaagtggatgacttgggagatccaactgccctgttctgcccttgacttggggttttatacattggcatagttccggggtttccatttctcttccctcgatgtttcccttgggctgggctgtcatgttcagtgtcctgccagcacttgggaggggccacatgcacagtatgtttactgaagttgtgtgcatgctcacttgaggcatttttcccttatcagttgagcattcctagaggaaggtcatatactggttaaactctgccactttgcaccttactgtgcatgcttgagcctgcccaccccactcttgagatattattgggaagctgctgatcaccagcttcaggtgttttctatctgttggaagactgtcgttccctggcaccagctgcaaccaattattatcttagagtggcagcttaacaaccccctgacttgatggtcacctgacattctttacattcttataaattatatgcatgagatgaatgacaggtactagtgctgcccaataagatagatctggatgaaatctttatttgattctgctgtttaaaaagcatcatgcatactggtcttccttttatctgtggataaccacacttacgtcaggtaattccacacttagcaagtataaaagttaatttttccctctcacttttgaagtatacagaaaataccttgtagcttgtatgttagtagttttgaaataaatatatattttgagtaagaaaatattctgaaatataagaagccgtggagatagaagaaaagcaaaaactgagagagaaaacaagtttctaaaactgaggaaaacattgtgaaagagaatgaacatatttgttgaatgatcaattagaataataatgtaaattctaatttgatttgaacagatgcttttcaagattacatttctagctaatgtcgaggcagaattcacatttggtctaactacagagctgtggtgtgttgctgcctggatccattggactatttgatagaatcatgggttgtggttaacgtggcaatagaggtttggattgtggttgatgaatctattgttgacttaactgtattcagagacatcttggagggagttctctcattgcataccataaaatgtctttttttgaacctgttcttttgaagaacattttaattgacgatttgacacagaaatagcatgctcagcaggtttacagctaataatacaaaaatgttttcattgttgctgaagatattcagtggacttaatggtcctgaagggtaacaattaaaatcatgtccacattttgcagatttgactagaaagcctgtgattccttccagttctaacattatctgactctaaggctgtgcttctcaaatgttaatggagatcttgttaaaatgcagattctaattcagtagtcctagattagggtctgtgatcagcatttctaagtaaccaggtgatgcccatgctgctggtgtgtacaccatattttgggtatcagggtctcagccatatggagaatggcttaagtcactgagaatagtttaaggcagggattggcaacgtgatttgggaaagaccaaggtagtaaatattttagactttttgaaccattttgtttctgtcccaaattactcaactctgccattgcagtgccagctatggacaccaagtaaactaatgagcctggctgtgttccagtaaaacatttacaaaaacagatggcatctgggtttggacttgagctgttatttcctgacttctggtttgatgtattcagaatgtcagtcttaaataacgaaattctgaaaataagattaaatacagagattgttcaagctcaaagcttgaagatggctacctgggagcatagattcaacttgccttgaatatgcactccaattagtagcagttacaagtgggcttttaagggaaaaagaagaggcacttcctaagtcgtttgccaagaatttacattaaaatgacataaactgttgattagctgtacattgatctttgtatcacaaattccaggaacacgagggtaatgagtgggatagttagggacaaaatgcctttaaataattgcccttggacccacactcttgtttctgggtgtgaaaaatgttatatatttcacatagctctgacgactctgagctatttttcttttcttgagaacaaatgttatattttaaataattttcgttaatgcaatttgcttataatttcataaaatttcttaatatttaaattattgaaataaaaacaaagaagtaattttttgaaattatcaaaatgtttcagttgaattaaatttaatgtaattttagaataatttgcaagttagccttttaaaaacacacatagtttgaaatgttaaaaatattaatagatatatgaaaaactgaatatgtcttgtttcatcttgaaggcagagagaactaaagtggaaaggtttcttcactgctcttcaatctcagactcttcctgaggaggaactagggtcagcaggccatagtctcttccggtgcctaggcataccttacctacatctttatatacctttacttatacatgttatcagactaaatgtattaatttgtgacctgtcatttttacttcctatggcttgaagtcatttaacatgactgtcttaatacatattacaatggcaggtggtgattagtactatgaagaacagtggagtaggagaggagaatggtggggagagtactgccttagggtaatcgtgggctcttatacaagagatgacatttgagctgaaaactgaatattgtgtctcagtgtactagtgggttcagttggctaatttaagtttgtgtgtatctatttctgagttgctggggtattagaaagagttgtttttatatattggtcttctaccaagccatttaaaaaacattcattctgactggttatcacagttacgctctgcttttagaatgaattgagaagttttccatctatttctaggcccttgagcattaaaataacagaggagcaacctattccttgaatgatctctgcttgcacacatgaggaaggtagtcctttccaagctccttggattctgagcagcaccatctccctcccctttcactcccaagggcacatgcacatcttgggtagctgcacccaccctcagtggtccttgaggagggtagcagaagccggggcagggggagccttctttgctgctggttcctggctcctgttctcagaagtacccgtcaggctccagtgacaatttatgtggttgtattggagaaagtaccagaagggcaaggtgacaggatggtggatttgggctgccatcttttctcttgctgttatggacttcactgtttggaaagtatatgttccactcttctgttagagttggggcaagagagaggggaagacgtgtgtgcttagtgctcagtccaccctcttatcatcgagcactgaaagtcacttgtcccagtagtaccagtaggtcctagggtttataaatggcttatgaaaatatatataattggaaaagatctattggtagttttgtgttaaaataacttttattcatgttctagttttcttgaggggggagtccctgatattttggaaattgtgcatggtgtacattgtgaatctgaaagaaacttgttatatatgtttgaaggtttgaaaactgcaaacttatgtctaatagtgaaatccttagaagaatatgaatatattaataaatgtctattttcaggaagatatcttcattatacctgtgctctgttgtagtctatagaaaaattagaacttgatctctctttggataaaatttatttcagaatcttgacaaaacttttggaagtgtcagatgatccccaagtcttagctgttgctgctcacgatgttggagaatatgtgcggcattatccacgaggcaaacggtaagagaaagccattcatttcatttggtttcttgaaaccttcagtgtagagtcctaaataatgtacttatctaaaatggagtaggttagcaaaggaactaacaaagcaaatgaaatcaagattgccacaatagtgagaattatgataaacccagttaaaaatgagtagtataggccggttgcagtggctcacgcctgtaataccaccactttgggaggccgaggcaggcagatcacaaggtcaggagaccatcctggctaagatggtgaaaccccttctctactaaaaatacaaaaaaaaaaaaaaaagaaaaaaattaactgggcatggtggcacgcgcctgtagtcccagctactcaggaggctgaggcagaagaactgcttgaacccaggaggcgaaggttgcagtgagctgagatcgtgccactgcactccagcctgggcgacagagcaagattgtgtctcaaaaaaaaaaaaaaaaaaagaaaagaaaaagaatagtataaaaatatatcacgcctgtaatcccagcactttgggaggccgaggcgggcggatcacaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaatatatatatatatatatatatatatatatatatatatatatatatatatatatatatatgtacgctggtataatactactgtgtagatcacattagatatttcatgttaatgatttggtagccattttgcgagcactggctattttttgtcttactatttgtacttacagagatgaatgaagcataaaatatttacttatctggcccttaggaaaagaatcgccactcccacccccaccccccgtaacctaatcataagggaaagggctgcttggttagtgcttgccaagtctctgtgtagtgactcacgcacactaaagacggaaacttaatggatttctgtaagttttgcagaagtacgcttgtcccttttgtacttggccctttcagaccaaatacctggatacaattaagggatggttaaaaaatagtgaagttagctattggaatggggcacatagattttgtagcagtggaaggataacagcaacctcagcatctgaagaatacctcagaccctggagatacaggggaggtagggacatcaatgatctttgtttccagtgaactgcctctagagctttcctcaaaggaaaacagagagatctcccaagctgttgccagtgccttctgtttaattgagtgctgggcctgtcacccactgcgaggcagctctcactgctataccatggccactccctttaaccttactgaaaaatttattgggaacagaagagataatggtagcccctgcaccccctaagcaaaatgccagtcaacggctctgtacttccctaattccaaagctatccctcagccattccatggtacggacaaatgtcctctggctggtggcatagacaaataggccagtctcgccttaaaataaggactcaattatttgaactgaactcagactcctaaggtttatcatccagctaggaggccactcagcctgtttcactaactcatgaaggtcccacttgggtggccccagcaatgataaaccactttccaggggcacaatgagcaccctggtattatacttcatggaagccaggcattaactcatcttcttctcaaagagacaataagttgcgctttaggggtgtggtcataaggaaccttcaagtatttcaggaaacgctaccagtagattatgtagtcctcagacaagtgtagagagctctgtaaaaggaggctgtccttgtagactctgatgattcgttccatttgtttaggtggttgagtccagggccctgggggacatgggtggtgaggtcagtgctgcaggttggccttatcctggtgcttggagtcttgtaggtagtagccttcatgaaatggcatataaaactaattaagtggacttggttccagcctgtgccagccagattcatcagaaccacccacaagtgttgtgtttatagatacattttttggaaggcaagatggtgtagaaatgaggggttgatactgtaggaagacatttctcatgccttccttttttctttgtttcccaataagccttttgcactcctatctctcatctttctgaacttcttgcaagacgaggcactaaatgccctttacagagaggtttgtctgcctaagagcaatgggcagatgtgcttactgccatatgagagattggggtttctctaagttcagggttcctcttatgcgcagtgtgcagggctcatctggcttcctttatgttcacttgtggaaattgaggcttgggggactagcactaaaatgctagtatcttgctatttctgttgctgtgagcaataaactatcctttgtctcggacccaggagtctcatgtgttctaccgggatccatgaaactgtggcaggctaacttgttagctgcaagtagggtaaaaactaagaccctcatagttgttgacactgtaatatcaagagctgtccaaaattaatatcattaaaaaataattggttttactatggaaaattaaagatctttagataaggcaaatataaatttagctaataatagtcaaggtctataactcatttaaaatgtgttaaatatgaaaaacagatggatagatggtatatagagccctcttagatttatagctgctaaaaaatgaatgaagataaaaatatgatagttttaaaacgctgaaagtgaaaagcatgttgaagaattcatcttctcacagcactgcctcagctggtgtttcaaatgtttcttttggatatgttgtgcacacctgacctgctgccaaggcagaagcctgctatgccttcacgtaattctgctctactgccctgttcctttctttctccctgccttactgtctctccctaagaagaatgatctctcccatcatgctgtaccttcatttgacttcctatcaccaatatctgctgcagtcgatcctccgtgcttttcctaaaatagtcttttttggcccaaaactgtggccatgctaattcttttctatgtccttccagtggcttatatttacatcatggaccaatatagtcattctttattctgaagcctctcaccagcataacttactttctgtgcaagctctggatccttctgctttgagatatgttttcaaattattttctcctcattaagactctgctttttgaaacttctcagaaaaaaaaaaaaaaggcatggtttctctcatggttatagggttgttgttttttttttccccccaaactttatgggtgttcagtggatttgcagatcaacaatttgaactaagttttctaaaagattaatcataatactcaaacattttaaattacataattctttcatgtcaagtattggaattattttgtttttgatcttttaccaggttatctagaatagacttattgagtcataagaaaggatcgctgggtgcggtagctcacgcctgtaatcccagcactttgggaggctgaggggggcagatcacgaggtcaagagatcgagaccatccttggccaacatggtgaaaccccgtctctactaaaaatagaaaaattagctgggtgtggtggcacatgcctctagtcccagctacttgggaggctgaggcaggataatcgcttgaacccaggaggtggaggttgcagtgagctgagattgtgccactgcactccagcctggcaacagagcaagactccatctcaaaaaaaagaaaaaaaagaaagtatctatactcagtttcttttcttaccctttattgctactgaattagaaaatgctaacttactattatcatttggcaggaatggctacaagagttagaagcttggccagagagtttgggatattcaggttatatgcggatttctcacagaagcccagctcagcacttcatcagacactcagttgaccagcccattcaaacaaaagcaagaaaatagagtgttgcctctagtgaggtatcaggagaaggattcccagcctacttgttggtcgcattcagtaatataaaagcatttcttcatattcaaaagttgtagctttttgatatgattttttaccatagccctcattaattttttttccttatgaataaaaataaaactttaacacttagaaaaattcacatgctttgtgatagatccattttcaccacaagtcagttatcttaaaaaataattgtggtatctcaaatttgaggttgatatttggaacttaaatgataggtttaacctattcaagacagcaactgttgctaagatatgccacttaaagtcacttaaggtgatagaaatgatctttattggccgggcacagtggctcacacctgtaatcccagcactttgggaggccaaggtgggcagatcacgaggtcaggagttcaagaacagcctgaccaatatggtgaaaccccgtctctactaaaaatacaaaaattagccaagcatggtggcatgagcctgtagtcccagctactcaggaggctgaggcaggagaatcgcttgaacccaggaggcggaggttgcagtgagcctaggctgcgcgactgtactctaatctgggtgacacagcgagactctgtctcgaaaaaaaaaaaaagaaattatctttattggcattatcagtaaaagtctgtctcctgcattatattctggtaaagctaacagtgaccattttctattacctcagtaaaaataatgccagtgaagaagttgagtttcaagttcttatttaaaaaaagtcgtgcacttctgattggaaaagcagttttatactccctattccttccttcaaacagcttctcatatgcttctaatgtcatatttgcactttggactatttcaacagtagcatggtgaataggcacatcacggacttccaattcggttagtacagcctttttatccacatagccgtaactctgctgcacatagctagtcctttgtcagtgccaagttcaaaaaactgcttccagtccagatcatgcaagagttagaaacttgtccagagtttgagatattcagattatatgtggacttgtcatggaagtctacctcagcacttcatcagacatattgtttttttcatgtttacacagtacatatatggatagttacttagcaacacggacaccaatgcagagtcatgcagtgggtaagtgcccagactaaactcgcctgcttggttttcagatcccagctcagccacctagtaactgtgagattgggcaagtccctttacctctctgtgccttggtttcctcctctgtgaatgtgaagagtgagtgagttaatactcattgataataataatgtaaaacacttagagtcatgcttgctacatagtaagcactctttaggtgtttgctgaagcaagtaaatcagtagattgttcaattgtcaagtaaagtgtctgctacttcaagcaatagcagttgttcttctacactctttttgttatcatgggatttttcacattaaattttgcttctctaagaacatgtttgtcattaacttctcggtggacttttttgtttttacaagtttctcaggaatgaagtgtcagaatgttgtctcttgcagttttgtccttttctcccatctctatctccatcaaacagtaacctttgtcggttgacaacattttataacaaaaatattctggagatgcaagtaaatgttttgctggtccactgatacatttttagatacagtaagccctcacttaacatcatccatacgttcttggaaactgagactttaagtgacagcaggtcctcgaataatgtcctttgcttgttttatgtcgttttgcttgaagtcagtttccaagaacctattgatgttaagtgaggatttagtgtactgaatatcacatttcctatccatccttttctttgatcactatcaggtttttctcagtgtgcatgtttacatctagtttttaacgtggaacccttttcactcttgttttacatgtgtgttattttcatgactgcttttgtagttttaagaaacacttttgatccaattacttgttttcgtaagattgggtggagagcataacgtgacagttaattgccccccagttgcaaatttaatacttgtcctcaataaatgcaatgacacaaaaataaaacgaatttaccttatcaactgtactggccagttgagttcttttaatggacttgtaacctttaatatggtaacatgattctgagaatcaaacacaatttagcattaatcttacttttcaaaaatacatgatgttcaggaataaaactgttccattgctttttcttcaggaggcacaaaacacctgtggcccctgatagaagtccagaaatcacaccctgatgattaatgcctgacactcaccttagggaatgtgctccctctgcatgtatgacttaatagcacaagtctggcataatgaatgttgttctaataattaaaacattgtgacaatatcaaagctctatcagactctcttacatggcttgtacagctacacttttttttttttttttaaaggagtctggcatctaaaccacctttctatattccaggaattccccattttacaaggcttgtaatccctcccattatagaagattaaaaatgccacaaattcactttgctcttctcccttacatttagccacctgcccgtggcctaaaagctcagttataagccgatgtagctaccccagacctccagcaggaacgagagactggggaagcagggatagccagctccatgaggaggagaagaggtggcagctctgggtagctgggtgtgaacaaagtaagctgtggggtcaagggccgagctgaaacagcaccctcactgaactacttgattttgatggtgattcagcctggccagccctcgagtacaattgtccagtcttccaagccatatgcagttacctttcaataaattattttgctggagaattatcaggcagggtaaagtttttgttacttgtaactaaacatattcactgatataagagattcttctctgtttaatctgacaaactgtactgcctttgaatctaaatacaaatgtccaattttctgtgctcccacaggattctgaatatattaatgcttccattatgtaacacttttcactttgtacagtgataatgtgatgaagtctgtttatctcactagactgtgaacttctcaaaagagccacctgtatctgactagacatagtgttcaccacacagtagggcataatacttgctgaaggaaagagctaccaaaagaatcatgtttgttctgttaaaatacagacttttttatctggtaaatatctctgtgttcctttgttcaaagcctagcacagcatgtgtaaatacaaattaaattgtgttgatagtggcacaaaccttttattgaccaaactggtttaatttttctattttaacttatagtcatcatgaaaagtaacaaactctcattatagaaaacttgaaaaatacagaaaagaataaagaggaaaaagcaacacccttaatactacaaagtatgagataaaaatgattttttagttttttccccatgcatatatagtatgtattttttcttctgaaactgtgatatgtgacatctcctattttatctcctgcatttcctcatttatcatgggtattttccatctacagagttttaaaaatatggtttaatgctatgtataggtacacatgctctagttcactcaaatcttactactgggcatgcaattagtttccaaattttcattattaagaaaacagaattaacatctgtgtgaacatttctggttatttgctggccccttcaaatagatttaatgagatgatatgagtacttttgagattttaataaacattattgaatatagactaattcagagtccccctggcagtatataggaataccatttacaccaccttttcagcagcactgaatactatcattacctctttatggcatctggtgcttttagtttatattttaatcacttacatgatccgtaggaatatttgttgagtcttgccccatggagcttacattttactgaaacctttgctgtctctcccaccacttttttttttgtttttgagatggagtctcactctgttgcccaggctggagtgcaatggcgtgatctcggctcactgcaacctccacctcctcggttcaagcggttctcctgcctcagcctcctgagtagctgggattacaggcgcccaccaccacacccagctaatttttagtagagacggggttttactgtgttggtcaggctggtctcaaactcctgacctcaggtgatccacccaccttggcctcccaaagtgctaggattacaggcgtgagctctgtaatcccacagagcctggcctctcccaccacttctgtgcttagagctttcttggacggatgcagtggctcacacctgtaatcccagcactttgggaggctgaggcagggggaatcacgaggtcacgagtttgagacaagcctggccagtatggtggaaccctgtctctactaaaaaaatacaaaaaattagccgggcatggtggcatgcacctgtaatcccagctactcgggaggcttgggcaggagaattgcttgaacccaggaggcagaggttgcagtgtgctgagatcatgccactgcactccagcctgggcaatggagcgagtctccatctcaaaaaaggaaaaaaaaggaaaaaaaaaaaaagagctttctctttattcctcctttagtcaggtaagtaaaaaaaataaaaaagagtgagaagagtgagcttcctcacttagaaatctgataaatattctccaaaattatctttttatttttaaaaacggtaatgaccttcctaattaaggaaacgaaaataggcatggtttctgtgctcattgaatttataactctagagggtatattgctacacagattaaaaaatattgactttcatataagtagcattgtgcaacttaaccatttttagcaatatgagtggaatcataatatgttatagtgtgatatcattttattagcttctaaacagccatgtttagaatactaaacaaatagaattcttatgaggatattttatgtaaactcatctgaattatttatattaagatagaaaaagacctttagaacaaacaaaaatagttctgtatgttttagaatatttaaaagtttactctcaaattacattttttggtttcatcagctgctgcattctttaaatgtatgtaccagtgctgaacttgttaatcatatttcagaatattccaagttcttaaagcttaacatgctattgacttaacttgttttgaaatatggttagcaagattacccctattagacaatagctcataaatgaagtacttgactctagttctaaaaaatcatcaaatatcttgtctttttaatgatattttgtaatccaccagctggaaagattcttttctcacctttttttcaagcattcatgatattgggcatttgtataatctgaaaataattggtgcttcaattgcatcttgagaagatgagaaatgtctgtttatttcaatagcactgtgagtttcagtggggcgagatcatccacttggtatgagacccactgggctctggggtggagagtaataaaatgtagtttactaaatgcttaagaaataaacataataggatgggtgcggtggctcatgcctgtaatcccagcactttgggaggctgaggcgggtggattacctgaggtcaggagtttgagaccagcctggccaacatggtgaaaccccgtctctactaaaaatacaaaaatgagctgggcgtggtggtgagcacctgtaatcccagctactcgggagactgaggcaggagaattgcttgagcctggaaggtggaggttgcagtgagccgaaatcctgccactgcattccagcctggctgacaaagcaagattcttgtctcaaaaaaaaaaaaaagaaataaacataataatatcaatcattaaaagcttttcaaaattttattggctggtgataataagaacaagggtttagaatgtcaaaaacactgcttttgctaggcagtattatttgttgtgagaattacatgagatgaaaaatatgaacatttagcacagtgcccaacgtgggggaaagtgctcacatttgatattactgtaagtggtgtgtgagctgtatgtttttaatcagtcctattttgctcacaacatggcagttttctgagattgtatttggtcctcattattcacaggttccagaattgtgaatttgcccacctactaaaaagtttattttcaacagctgtgtcaatactagaggcgcttttgtagttatccatggacatgtgtagagtggtgaataattggagtcgctaatggacacatccccagctgtgggggaacaaggcagcgttctgccatcccatgttgtctcttacgctagaaacaagcgtcctttacgtggtctgtttagtaccatatttttttttttttgcatttttgtggggtttttgtgtgtgtgtgtgtggtgattttcctgtttaaaatggcccccaaaccttctggagtgctgtgtaatgttcctaagcacaagaaggggctgttacgtgcctatggagaaaactcgtgtgttagagaaggttccttcagccaggagctatggtgctgttggctgctagctcaggcctcagaggcagtctagagaacaagcagcctgtgaccgtgctctgtgaagctcagtggggctccaaagctgactgtgaaaggaccttgtcagctattttaaggatttgggtcctttgttttatttttatttgtttttttttaagaaacagggtcttaccctgttgctccagctggagtgcagtggtgcaatcatagctcactgtaaccttgaactgggctcaagcaatcttcccacctcagcctctcaagtagctggttctacaggtacacaccaccatgcctggctaattttttattttaatttttttgtggggacagtatctcattgtgttgtccaggctagtctcgaactcctgggctcaagcagttgtcccagcttggtctctcaaagtgctgggattacaggcatgagccactgtgcctggcctgggtccttttgttaagacaagtagaagccactgaattgttttaagtagtaaaaatcatatgcagagttttgccaagattcctttgactacagtgagaatgggaggcgggagagcagcctgtatcatcatcgctgcacagctgggcttagtgtcctgcagggacataggctttatgtcctttaatcatcacagcaacgctgtgaagatgtccttgtcttccctatttgtcagggaggaatttaccaggtaaaggacttgtctaattaacatgtttgataaatggctgagctgatatattagataatgttttaaagtacagtgcctggcctgcagtaagcactcagttaatgtttgatgatagttacattatgttcttttttttcccctcagttcagtgcattttttttaaaaccatgctttaaagaataaaatatgaaaaggtatgcagataaaagcttccctctcactccgacccccatctacttatttcttcctgaccccagaaacattactgatctgtgagattgtcttaaaccaccaaacactgtactgcattaaggtgccgcttgtcactgactatattgtaggtatcctccactagacaggactggtggctgaagaatggacagggcagtccacactgttgtgtggaagctgagactccacagctctgtctgtaaccacacctttgcaaagaaacagaggaccaatttctatgcatgaagaaatagccatttttactttcctttgtgtttgtaataagtggattttcaggatgtcggaagtgtggtgatagaaagcagtgtcggttgtcagtcatctcggtggtctcgaagatatgaatgttctccttcgtctcactgcccaagtcacatggcatatcccattgttattacaaaggggtggatatcttaaaatcagtagtcttttccaggaaattagcatgggtgctctttaaccccctgttccctgctatctacatctaagcccctatcttcacgcagcacggtcactggtgggcttgatattgattgtatgttgttatgaaaattagatggtgttcaatactgatattaaacaagcaagaaatactgataataaaaacgttaatactcagccacttagaaaacaatgatctaaaatactagtgcctgggtggtatctaggcagatcatatgtttctggattagagatgagaaatgagaacaactgttggatttatcattaggaattcaaaaacgaaagtatttgaatactgtaaatctatggttcagggaaaatgatgtaaaaaaagacacgtttggtttatttacgtacattgttactttcctttttagcgtgttggtatttgagctgcctgcttacaaactgtgaatttgagagtaattgcatcttcctcaccacgtctctcccgtttgcagggtcatcgagcagctcggtgggaagcagctggtcatgaaccacatgcatcatgaagaccagcaggtccgctataatgctctgctggccgtgcagaagctcatggtgcacaactggtatgccacggctttttgctcacacttgtacattagtctgcaaactctcacttgccattctaaaagttcttatgcaaatgctttgaatgatcatttttaaaattagttattttgattcaaaatttagaaatatattttagtaattcagagcaatgacacattagttttataaagacggactgcactaaaggtctcaaggagtgtatattcaaaataataatttcaaaaacgactccagaagtaactaaaaggaccctgtgacataagtcagtcagtcctttttggagctgaatgcagttggactactgattcctttagagacgccacaattttgcaaggcttacctattcagcatatggtaaactggatgaattttaccaattcacataaaaacactaaaagctgataaatcaacttagattcagctctcacatttcattcactatagtttttgcttttgaagtaactaaagttatgcttctttattgcctgtttttatttttaaaataaaaattagtgacttttttgtacccacttaaaacaagatcaattaaagagtaactacttagacatggtgagccctttgtgtacataatagaagaaatgaagattccccttgacatagctgcttttagctgtaggttgggtgttcagtgccttcagcagtatcctaaacagttcaaatgcctctccattccccagcctctggaaggatgctctgtttttttgttaaggcatcaggaacaaatatacattgcttgtaactgacagtaatgctaccagcacttccaaaggagagggttagtgatgcactagcatgagtgcgtttgaagatgcaggcacatacagtgtaggagaatatccaggagtactgctgtggtatcatgtgttacatattacgttcctgccacttaacacttttatcataaataatgacatttatgtaaattcttacaagtgctttttgagtgctagctttgtaccctgataagtgtacaaatctgtaccctgataagttaaatgatgttaggtatgatgaaagtgggtgcaactttacataggatgattagagaaagcctccctgagtaggccacatagctaagttgacaataatgataagtaaccagccatacagctctattactggagtgaataagcattttaggtggagggaatgagaggtgaaaaggctgtgaagtagtaacgaacttggcttgtttaaagcaatgtacagggaattatgtggttgtgacactcaggggtggaggtgctactggcacctagtggatagacagctggagtgctggtaatatcctgtaatgcaggcagtccctagaattaaagaagtatatgtgagtgccaatgttgggcaactctgatatgaaggatggtcaagggcaaactctgacatgaaggatggtacgaggggaaaaacatggttcaggagaggtaggcagagacctgatcgtgtagggccttgtaggctataatttgactcctgtaagatgagttgaaaaccattgcaaggatattaaataggggaatgacaagatgtggtttatgttttgaaagggtcactttggctactccctggagaacgggttgtgcaagggtaagtgagaaagcatgaagagcatttgagctggttttcatggtagtctggggctgaggtagttggtggcttggcctagatgataaacattgagataagaagtagatggacttggggtagattcagagctagtgtggacagcacttgatgggctgaaaatgttttttacttttttccataacttcagtgcaagaagaatgggatcaaaacagaaggtgaaaaccccagaatggtttttatcagtttagcaggaggaaaaacttcaggtctgtcagtaaaacataggatacatcacaggatttctctccttacttcactttaccccaagccagatttttcaacataaatcatttatttagtaatttcatatcttatggtttgtttatatctctttcaggaatttaatttaaaggatgttggcatttaatagaatttcaggccattgcaaccaatgagcttatagttgccagatgtttttctaaagtttctgtgaaagtcaaagttttattttcccattgtgttgaaattagggctattgaaatacagttattattttattagcgtatttctcttgaagtctttcttgttgggttagtggttttcttgttttaaaaaatgtatattcctaatatgaaaggcaagatgtgtgtgaaataggatgttgaccttttccctttgccagtggaggaaattttttagttgagaatttttgttgttcagatgatcatgtattgaagatgaaatttttaaatttgacttttttcttgaatttaggaacttgatgtagtctcatagtacatttttctgtgtgtgattataagaggaagtgtattctgtctttacagggaaatactggtttatttgctctttatgagagagtattcttttttcctctctctttctaattatatggcaaactttttaaattttaatgttttaactacgattatctcctttgcatttaatggagaagcttagtattttcccacacttccttcatagagaaatttttgtatgaaggaagattaaaattcacctgtgatctctgtatttgattgtgacttataaatttctgtggctccctgtgccagagaatgaaagttgctcaagtaataatttattacaataccagtttaatttgagactaaatagaataccatttggaaagtaatcttttgcaaagtatatccccaaatgtaaaagaagtttggatcaataccttttttcaggtaacctagttgtctatactaaactcataaagactacctttctacctgcctaaaataggggctttttaacctaaaatatgctgctggtgttctaaagaatcttgtaaatttctctaaattgttttcttttctaccaagtgaaaacttgaaaatacagtggagtttttcttttagcattggctcgatttaaatggaaacgagttattataaatggtgtattttagccctccatagtgaaataattattttaacataattaaaatgcaagcacagatgaaagcatgaaggtctgcgtgacaggcagcagcagcggcactttgcctgcatccctgggtttttctgccctaaaggatttttaggtttttgatattgcattattcctgaagtttttgtttatcagattaaattgtaactttggatacaataaaattaacatttattactttctgccatgaatttaaaaaattttaggtataatttcaaaattacattttaagtgtaatttatgttacttatgaaatcatggaactgggtcagatatggatttggattttgattttgattctgttataaggagttaaatattaagtttcttgataatgtagagatacatttgagtttatatcatatggagtatggagttatataatgggaaaatacttatttattttatgattgatttcaaaactgtatccttgaattgtaggtgttagaataccagcgtttctccccttccacatcacatctgtatttctgtggaacaatggattataaataaccctgactgagagtgggtgaggagcggtggaggaggaatagagttgctggggagggaggggacagtggcacccactgggcgccctcagctgggaggcctgagcaggccagtcctactcgcgggcctctgcagctcttatctttttgtgcccaccatggcattcctggtgtgccctttgttcttttgtgcagtgctggatttttatattcataaatttggcagaatatataaacagtgacaactaagagaacttgtgtatatacacctaattcatccgtttcacatcataagatgtcatcgtttttctcctacagaatgattttaaatgtaatcagcctctaatgcagaagcaacgatatgtgcatatggacagctcaggacttcaggaaagaaacactgacttttgtaggtagaggatctcacgtagaatttttcatttttgtctctagattcttgttcagccctttcttaagcagcataataagttataagagtgttaccatctagattttttatgcttaggtaaattaatataacagaaaaactcaccaggccaagggtatggatattactttgttctctggtgtttctatctgctttgcatattttagttattctgtaagtgcagagccataaatacagtgattaaaatagttacttatgaactaaagaaaaaaaaacctcttatgtgttttagctaatttttaggataataatcaagttaccaaaacattccacatgatttttaataaacataacatttctagatttaacgttttccagaactaatttctaatttctaaattagaattctaatttctaaattaatttctagattctctttctgggtctctggaattttctaggtacctgaaattttctgggtacctggtctgtttctgggtacctggaattttccacattattatgacatttttagtggaggaacatttgaaaatgtctttaatgtcatatgttttctgtatttgaaaaaaacaaatataactggatttttaaaaatatgaaaacccattccaggtaaagaggaattttttacagctgttatctcactatcaactggtaattcagcctcccaatcgaaggttgctgcttctttgcaagttagaaatgtttcctaagactgtattaacttttctggacagtatgcaccactgaattacagttgaattgcaaatgccggcataacataaacctcagattgttgcaaagtatcagcctaaataaatattcagaagagttggaaaataagcattttgacagtaaagaaaacccctgatggataatgtagtctgtggactttataattaaacataaaatcaattacaggtttcacacataggtgcacatgactaagtgtggggatctgtggatctagttcatgttttggttttgtttgcttacgattggctttgtagacaaacaggtacctaaagtgggatttaaaggatcaataaagtgtagacgaaagaaaagcctggtctagtaaggagaggtagagaaaaacgaattaacttgctttggttttcattgctttctcttccttctgtgggtggggcagttacatctgtgatcccttggcatatttcatttcatgggctttgtgtgtgtgtgtgcacgtgcacgcatttttttttttttttgaggcagagtctcgcactgtcacctgggctggaatgcagtggcgtgatcttggctcactgcaacctccacctcccgggttcaggcaattctcctgcctcagcctcccaagtagctgggattacaagtgcccgccaccacacccagctaattttttatatttttagtagagatgaaacatcttttaaatccaataaactcaatagaatggttggcagagtatactaaaaatttaattaagataaagcaaactttatattcactctctaagatatttaagtttttgaattattttctcagtttccctttatgtatgtcacccagatgttaagtcatgatgggggaaaaaatgttttatagctaatggaaatgaattgacaggtttttgtcagtagtaaaaacctgaggaattgaccaaaaagaggaggaagagtatcagcctattgtcttaagaaaggtaccttttgatgtaaatattctttaattgaatttttattccatttaaattttaaaagaattgtgcagcagtgcagcagttacatttttaaatctaaatcctcttagatgaattagatgaagtttatcatctgtttttacttacattttaaaaaaggaattcagcataaaggtgccaaagtgttagtacagggccagaggttttcctaaaagaccagatttctcccaccacacggtatcagatctgtactgcattctcctagaggcacctctcacactggtaggagctgtgctcttcttgccttattttccttaagggttaggcatttagaagcctgaaatgaaaacagtctcttggatgagtttttcctgccttgctaaatatcccagaaatgtattctgagaaaacatttcagtgtctggtttgaacactatgctgttccatttgtatccagctcttttctcagttaagagagttatgggagtgtttacttttatctctgtaattgtctctaattacagacaggaatacttgttagaaaattcaatttgtgctaaagtagagaaatacaaagtagaaaataaaggcgtagcacacaatttcagtgcactgtcatagcaggacgagccgcagacaaaaccccttagatactaggttaaagaaggaagtggctgtattcggctgggagctttggcagacttgtgtcccgaaaaccaagctccctgagagagaaatgcctgcccttttaagggcttacagctctaagggggtccatgtgaaaggattgtgatcaattgagcaagcaagggatatgtggctggggctgcatgcatcagtaatcaagacagaacagaacagaaagtttcacaatgcttccttatacaatgcctggaatctatagataatacaagcggttacgtcaggggttgatttttaactaccagaccaggcctggggtgtggcgctgggctgtctgactattgatttcatttttgcctttctttaacttttacttcctctttctttttctgaggtatgagacaataagagaggtggtctccttccttattcccccctgtgagaatctcacttattagtgggagttctcattctcattttcactacttaggtcttcctgcaagacagatggataatgattcatgtaatacatttgtgccgaggttttctgatgaactaagctagcaacaaaactttttattatttgaaggaataagggtaatacagcagcaagcaagttaagctctgccagttttattagtgattatttctaactgtatgattatttcaactgtatgatttgattgagcatgtagatgggggtttggtttttaataatggaagtttttaacagctagaagcttgaacttgtgggcgtctgttcggggaaagaattagtcagagtatagttattttgaggcattaacttttttgcttcctaaggccattggtctcctatgttagtctttccacaaacataacatggcctaggctgccggcaatgttttcggctaagggaggaggctctggtaacttttggtttatatgcttaaagaatgatttaaagacttggaaatgctgctgggccagacgggtctgggttctttgactaagtagtatgtgtacagtggggacacttatatataagtgctagcaaggacaaaagaggtccttacctgggaaaaagattgagtacagtgacagaacaatagtaaaacagtatacaagaatactactaggcctaaaatttctaactatattacttgtttgacgagtcctaaagcttcggccgtgggtagactagtcagcttctggtgtgtgactagagcagggcttgttgtttcctcagcagcgcagtctcatcttaggattagctgggttggatgatctgagtcctactggctggttcacttgtcctgagatgccggtgttagccgactgtggtggatccaagaaacaacacctgcaactttagcagcagtgggagtggacaagattacagtatagggcctatcttatatggatcctagagaaattagattttactttttaaccgaaacagagtcaccagatttaaaggagtgtcaggcttataggcatttttgtgtgcttaattatgaacactttgtatggctattcctgaagcctgcatttgctttttttaaggttaattcccctagttcctggaggttacttttaatttgggggacttatgatttgcggggtggccgactgaacaaaatcttatagggcaactacctagtttgtttggtgggggtgcacctgacttggaggaggagcataggcaaaaacttgattttattttaaatgaatttcctggcaatatttcttcagtagctgcttgagtgccagtttatgtgttttacctttttctgaactttgtggctggtaggcagcatgtagttttcatgtgatctttaataactttgctgttttctgtaccaagtcagctacagacgccagcccgttatctgaggcgattcgtaagggtggtccaaagctaggaataagatctcggagaagcacatgggttactttacgagctttttcagtttgtattggataagcctccacccacccagagtaggtacacacaagaactagtaaatacttgttacctccacattttggcatttctgtgaagtccacctggagatcttcaaagggggctgttccataagctagtatgccgggcagaacggctggaccttgcctcgcattgtgctgctggcaggtaatacattgctgtgccactgttttggcaagggctgataaatgtgagatgtagaataactggcctaacaactttttaagtgactcttggcctaggtgggtgatctcatgcacagccagtacaactgtggctcctcgcagttgtggcacagctatccttttatccagtaactggatctatccttcttctattatttgtcctccttctgtctggcaaaagtccttttttttttcattagaataagtaggtacaaggtcaggtgcttgagggagaaggagggctgtgactgacgcccggtagcgggtggatgcagctttccgagcctctgagtcagcccaggagttccctaaagcaactgtagtgggagctcgctggtgttccctgcagtgcatgactgccaccttttggggcctctacgctgcttctaatagttgcaggatttcttgctgatgttttatgttttttcctctggagtttaacaagcctttttccttgtataatgccccatgtacttggagggttaagaaggcatactgagagtcagtgtagatgttcacagtcttacctacacttagttctaaagcctgaattaaagcaatgagttcatccttctgggctgaagtaccctggggcaatgattgggcttcaatgacagtatccagggttaccactcaatatcctgcatatttttctccttgtgggttgatgaagctgctcccatccacatacagctcccagtccactgatgcctaaggctggtcccagaggtcaggtctgctagagtaaactgagtctagcacctctacacagttatgctcgacagggctttctgatactgagagcaaggtgttggggttcagggtgttacaaacttcaatggttatgtggggattttcacagagcaagcctttgtacttggttagtctagcattcgttagccaatgatgtcctttggtattcattaaagtcaccacagcattggggggcttttatgttcaggttttgcccaagagtcagtttatctgctttttgttctagcagggcagttgctgttaaggccctcaaacatggggggcaacctttagaaaccccgtctagttgtttagagaggtaggccaccagcctcggccagggtcccacagtctgggtcaaaacctcaactgccattttttctctctctgatgcatatagtgtaaatggctttgtcaggtcaggcagacccagggctggggctgacatgagtttttctttcaactcacagaaggcttgctgctgttgagacccctattcaaaaggttcgtggtcgcctccctttgtgacttggtacagaggtttggccagtactgccaagtttgggatccataacctgcagaaccccacagctcctaagaattttctcacctgctgtctggtcttaggctccggtaggttgcaaatgacctgctttctttctgatcctaggctgcgctccccctgtcggatagtaaatcctaggtagtgtacctgctgtctgcagatctgagctttctttttggacaccttatacccacagtcctccaggtgccggagcaggccatctgttcctttgacgcacccagttgctgtggggtgtcccagcaggaggtcgtcgacacactggagcaacacacagcctgggtctctggcgggaaacttttgcaggtcttgagccagggcctccctgaagatagtgggggagttcttgaacctttggggaagccaggtccaagtgtactgagtggtgacacctgaccccggatcttcccactggaaagcagacaatttctggctctcaggagctagtctgatgctaaagaaagcgtccttcaagtccaggcgggtgaaccagctgtcctcagtacatgagcagctggcggcagtcagcctaagtagggttatgagtctggataatagtttagagcaaattaattaaggcttgaggctttttagtataagctggggtattctttcagttgaggagatcagcagaggtgaagggttgatacacaaaggcacacctttctaccatatgcccgtccttgtctaccccagtatatcactgctccgtcaggggcatttgcatagctcgagcacggccagatttgagactgcctgcttgactatcttgacttccttccctggcctctcgcggctctgatcctcccctttgaggtgagacctggagcatgttagctcctgaacctggttcctggggggctgctggcctctgtaaagcgggggtaggctgggacatatggagggagaatttctgttacctctggcggctcctgcaaaactggtttctcttgttgtttctgggatttcttcttttaattctgtctgctggcgaagctgctcttactgttacttttttttttctttttttttttttgcaataagctgttaaacagggctggatctatgctggttttgtctatattatgtttaactatgagtcactctaaaggaatttggtctgggtacactggctctgacccctgtcaccacctgaaatacatggccaattgttccctgtctgtagttatttctgttggccatccaacaccaaaagagggcaattctaatttacattcacagagagttctcacctgtgaggggttagcttaactctgtaatcccctgcacaaccttttttaaggttctgtaacgtgcactttaatagagtaaattttggatgttttgatgacttttttcttatttttttgtatatgtatattttttaacatagttcctagcagggtgggcttactttctgtctaacttattttttatttttattttttgagacaaaacaacactcacactacaagaaggaaagggtaaaaggtcactcacttgtctaattcacactaaatcaaaattaaaaccaaagcaagtgtcgataaaggcacgcctgttcatcaagcaattcaagccaagtcaaaatcaaaaccaaaaccaaagtgccaataaaggcacactgtgggtgatcaggccacgcttccactcagatggagtgggcaagttcctaagaccagtcttaccatattccagatgtccaactccaagcgtcagttccttcgcagtgttcagccactgcattgatcctccgtgggggactgccatgcaccgctctgatgaggtgttccaccaggacaaatgcctaccccggagcgctctcaggatctgcgtcgctcaagctggctggagtcccccccagggatgctccagagggcaggcctaagccacctaaggggctacctctaccatctgttaattacctcgcttcccggtcagggaaccaagaaatgtagcaggacgagctgcagacaaaacccctctgacaccaggttaaagaaggaagtggctttatttggccaggagcttcagcagacttgcgtcccaaaaccgagctccccgagagagaaatgcctgcccttttaagggcttacagctctaagggggtccatgtgaaagggtcatgatcaattgagcaagcatggggtacgtggctggggctgcatgtatcagcaatcaagacagaacagaacagaacagaaagcttcacaatgcttccttatacaatgcctggaatctgtagataatacagtggttaggtcaggggttgatttttaactaccagaccaggcctggggtgtggcgctgggctgtctgactattgatctcatttttgcctttctttagcttttacttcctctttctttttctgaggtatgagacaataagagaggtggtctccttccttatcgtgagagctgtgacagaagtgtatgtaggtgtcacaggagcttgggaacaggcgggatcaggcagtgctagaggtgttaagggttaaggagtgagttggtggagatgtggctggggtaccaggaggacttcaggcaaaggcaccctgtgagcctgctgtgtgtcgggagtcacagcagtgttgtcagaagtggaactgggattctagcagtagcggaactaacaccagaaggcatcctttgaagtcgcgtggaggcttaataagattacagtcacctgaatgttaattttacttctttttggatttttattttaataagtaaggggtttatctttctcatgtcatgtggactgtggatgtcggtgagtccagagcctaacaaaatcatgaaagagccagagcccttcatcctactgctccccttcccacagtatggtgctttcgtcctcctggttgaggtggaaaagggaagagtggaaagaaaaaatgttctcatgagtctttgtttttgagttttttaattggaaagaattttaactactgaaaagctgctttcatctgtagtcaccagctttgacattatgctgcatttgtatgtgttctctttctctctctttctgagctgcttgagaataagtggcagacattatgaccctgcagccctgaatacgtgggcacagatctcctcagaggtaggatgttctcttacgtaactgaggtccattgatgcaatatatagtgcgtactcagactcatggttttggtaaaattgattcttaaatgataatctaaaaaaactttgcaatattttaataaattcaagaagctataccttaagaaataatgtaaatgatctattatagaaacaagttagccactagaagatccatcagaacaaaacaggaatgtaattgatactgctagtgagaatatcttagttgaacgaagtctagacatgtttttcttgttcttctccaagaatagtttgtttacaagaaacaaatacctaccgaagttagcttaaatataaggagacatgtgacaaggatatcaggtggctcacagaatctaagttaagtgaagtcacacagtccactgaaactggagaccagaaagctggtgggaagtgagccaggcagtagtgttttccacctcccattcttgcgtggtttctacattcatagccaggctgttcacttcttctctgtagactgcttttcctgcccaagaccctgtcatgattgctctagaggcataggctgagctgtgtcatcatgatgttctagctcagctttccgcatcagctgacatggtttgggtatgcccttccaaattcctgggtgcaggaagctcccttgcttcctgcctggcctgttcattggccagttgtctctcctttacctgctgagtgaagccagagtgggaggatgacctgggctagtacagtacctgaggcccattcctcagaggactttgaaggacttccacagagctgcggctggactttctgccctgtctgcggggcagttctcctggtagccttggacagacccaattctgtctcctttctcacttgtagtttacaagaataactgtggatatgccgggaatgtaatatccccagatagggaaggacagcctggaatagcctgggctccattccacactcccttcctccccacagcagggtgagcttcagcacattagcccagcacatcatgtggcccccagggtgtaaaactcagggtgggctacttcctggggtccttcagctgccttggaagtgaggcatgcacagatgagacttcatctgccctgggctgctttcttgcacgttgggggactggcttgccatggatcccaggcctctgttgtcccttgcttcctatctgtaagtaataaatctgcttcatatagcctcttgggtgtgggtgttctgtttctccaaattcagccaagttggtaaccagtgcacagtgaacctgtttcatattttcttcttcctctcttccaaaatatcaacttcacttttttctggtctggtcatcctaattttaaagacaaaaagtataacttaaaaaaaaacaacaaaaactgggctggccaaaaaaaacatgtggtgctagtctcttatgtttgttgtggggaggtttgaggagggcagctgctctggcccaaaggttttcagcctctgccctcgaatctccagctgtcggtcatcagccaagagcggaactggaacaacaagactaattgtattaattattaatttgttcattaaaggtttattgagcatttgttttgtgtccagtcctgttctaggctatggtgatgtacgtttctgccctcatggagctagaatctgttagtgggaggaccaacaagtacagaaaatgacagcacagtgtgttgcatgcttagataggaccgagctctgcatccgttggggaaagatgagtgaagtgtttatcttggttgtggtgaaatcaggactgtcttcctggaggcaggcggcctgtgctgaggccttaagcaggagctgacccatgtgatgaggaggaggaaggcagggctttgtgctttgctggccttctgttagctcacatttgttgcccacctcaaggtagcacctaacaaatgccgtcgagtggatggcgttgccagaagggacaaagcaggggatctgcatggaattctgttgcctagaggagcacagcccagtgaaattgtaatgcgagcaacacaggagaaatgtaaaaatttcaagtagccatattttgaaaagttaaaaaaagtggagttaattttaataatattttatttcacccaatatttctacattatttcaacgagtaatcagtgtaaaattttctaatgagatattttccatttttttcacactgagtctgaaaaatctggcaagtgtttcacactcagcacagctgagtctgcatgtgcccccttcctggggctcagtagccacccatgccgagtggctcttggcccctgtaaggctgaggatggaggctgaaggggtgagttgggagagatgtggctgctgaggtaggggaaccttccttgtcacattaaggagtgaggacattttcccggaataatggaagcaattagaggactgaacaggcggctaccgtgagaaggcttgtgtttgacgtcaccctgcctgctgcgtggcaagttcaaaggcaaggaaaccaggtgggaactcttagatcactctagagatgaggcagttgttccctaggtaataatggtgatagcaaggacagaggaaagaagaccagtttttttagttattaaaaatatggaagtgacaggacttaatgattgcatggagctggtggcgaatgagtcacatcaagattggcagtctggcttccgaactgcagctggatgtgttccattgactcacacaggaatgtagatggaggaacaggattggggtggcactgaggagttcattttttagacacattgaattttatgtttctgcgttctagccaaggagaaattcaaaagctggaaatataggtttggagttcaggagtaagatgtaagctagagcgacatatttaaagtaatcagtggagtgagagtggaagtcgtggaaggggatgagattacctgaaaaaatgtgtgtagaacaggagctcttcactggggaggttttggattaactccctgcaattgtatgcagtaggagaagagcgcatgctttccacaggagtctcaaagagctgtgtgatccaagaaaggctgagaaccacctgctgccatggactctgacaaaacatggaatgggctgacagaagaggagtagattttacccagggagggtggggtggtagcagttaagaccttaactgcttaactctagggagaactggctggaaaattaggtgaaaaccaggaacatgtgctgttagggaaggaaaggaaaacaagtatatttcaggaaggatggagtagtggtgagcagtgtaaaataagccgagaggatgaggaaggaaggactgaaaagtatgcagtgggtgcagcagcgagaaggccattggccacctgggccaggtaattgatggaggcaaggccctgaagagccaggatgggatggttacttagggaaagtaaccaggtgggactgtctaccattaaaagcgtggaaaactttcctgccgatactccttctactagtgagactaaaacatctgtccagactagctcagatcaactaacttagcaaatacatgtttattgaaaggaattgctaattcagaggtggggtgaggtgtccaattcatgccgaataagtgttttcctcataactaaagatttgacttgttatggtccaaacttgtgatttgggagtggaagtggggctagatagtggggacgaagcagagccattctttaaacatggtcagagtattccctggtctttctccatgatcttgtgtgccacagatagcaggagggagcggagggagacagtcctatttcagatgatggagggaagagaattagcattattgaggcactaacaagggatgttatcttttgaatctttacacatctctacagtagatgggtagatgttctcctgtttagagatacttctcttttttatgccttagggtttcaaatatacagaactaacttggcggtgatagaatgcatttgttgtttgaatctctgttcttcaaataatgttctgaagttcctctgggtagcagggtagaatagtatctattcagaacttgatagtcatgatttactttaatcttgttgaaaccttgttgaaatctctgtcaaaatcaaaaattttaagtaccttagatttaaaatattatatacttaaaaaaattgttactgtataagaatagtcttttcataatgtggcagctaaggaccagttagtttcctgaaataaatttttaatttgaagctttaagggaaaaaagcttccaatttggaaaaaattgttagaaattattttgccattatgtcatgttaaatgagagcaaatataaagtatgggtatataatcaaggttgattattaaatataaaagtagatgttaagggatgtctatacagcagtttactgttgttgaaagtgttcttatttgtggcatagcactagaaagagtaacaactttttcaaagaataggcaacttgtattatgtggcttgtattaatgtttttaatggaataatctttggatggttttgagtataagttgtggtctaaaatgtttaaaacagagttttgatttattttacattttgctaattaaaaattttgcctagttttttcccactaaatgatttcttgtcaacggtcagcgcccttcagaccaaattgttcatatattatgcttttaggaacatcattaacatgcagtttgaaacttagagctctttataaaggagaacatacaagcaagtcatcatactctggcatttttctcccagctgtttttgtctgtctccctctcctttcttccttctctttgtttaaattgtgctaatctcccagttggggtagatgatagtattatgtggtcctaatgtattttaaccttgctgactgtctttttgggcactcaagattttctctgtcatatgttgttaaactttattttgttggttctggcctgatatcacaatctgcctttccactcatctttgtgtaagggaattagatggggcatcctagatgacagattagctgtcaggtggaaattgagtcaagactgctgcgtgcttagacaaaccacagacaaaccactgagcaaagtgtctttgtttattttctgatgcttgtaatagaatacctgaaactgggtaatgtctaaagaaatggaatttatttcttacagttatggagtttgagaagtcaaggttgaggggctgcatctgttgagggccttcttgttggtgaggactctgtagagtcccacggtggcacaggcgtcacatggccagggggctgagtgcccgctcatgctagctcaggtctctcttcctcttctaataaagccacagtcccactctcatgataactcgttaatctattaattcatgaatggattaatccgatcatgagggcagagctctcatgacccagtcacctctttaaggcccctcctctcaatactcccacattggggattaaatttcaacatgaggtttgaaggggacagatactcaaaccatagcagaaagtttcagaattccaatatttgggaaaaaatattagttctattgtcatatgtctagatttatttaagtttgtaggtaagctgttacctaaatatattttaaatccaggttgactgatctagtcacatatacactggctttaatgcaagtatatctagtataggtgctgttatttttttttttttcttgcagacaaggttatgtctcaaggatagttatttttgttcaagagaacagtaatcggaaggataggttcatctaatgatgtaacagaaaccccaaataccatgacttaaatgagagagagatttgtttttatcttacatccaggggtgggctgggcagaccagaactagacatgcgcagagatccaggcttcttcagctcagcgcactgccgtccctggggcgtggcctcgtcctcttggctgtcggggtggggcggggaggagggggaggggggaggagggaggggtgttccaggccgtggggaggctcctggaagttgcctctcaacacttccatcttatatcgtatggcccttactcagtcttctggccatatgtagctgcaaaggaactgggaaatgaaatctttcctctgataggctatgtggcatactaagatgaaagggttctgttattgaggaagaaggagagaaaaaggatattagggaacattagcaatctcttccccaggagttataaatctatactcatctgtactacattataaataattgctttgattttaattcttaggttttggggggccatatgacctaccccactggcagataattcagaatgctgtggttgtgcttgggtttccggaccttttaatgcccttcttcctttcagagtttgagaaaagtcttgtaatcccttgtttgtaggtttttgaaagttaatatttgataattcggatggcataggcattgcccaggatttttgttttaatgtttgaaatgtttaagaaaatgaaacaactgaagtagttatactacttttgttagcttacttagaaaatagtaaattgtagattgcatttaaatgaaatttaatttaatttaaaaactggtttttgacagagggggttggtgatagtaggtccattcatcacctacttgtaaagtttatattggatttacaaatttaaacaagtctaacttttctgtttactgttttgagtaaagctagagctagatggttcatcccacggtgaggcagcaagcacatactgcgttgtgaccccatgggaaggactcaacggccacgtgaccacgtggagagcaggcttaggcctaggagggttctgggcagagaggagatggggactgtgaacagaaggaggaagtgtgggggagagctgtgcatgcaaacacatccaggtagggagatcctcacccagcaggggaattaccagacagctggagtctgttatgaagccaaaataaagttggagacatgcatagtggccacatcacgataaaccatctttgccttgatgttctgaattctttcctgaaggctgtggaaaaccaccgaggggtaaaataacagtgtcattttagcaaggccattttagagacagtggttgtggggagggtactggattttggattgtaaaagactagagggaaaagaccagtaaggaggctgcagatccaatccagccatggtgagaggtgggatcaggggtgaggagggtgggagagattcagtatatggaggagagaggatctgtgagacttgtataccagttggatgtggaggagaaatcagagggaggaggccaacaacttcccaggtttatccttgacattcttagttaccaaacaaaatcacacacacaaattaaaaacctctgtcaccttctatgtagtgtgccaaagttgtataatctgctttattcttttaagtagctctgagactcatttcaggtgattataattcatattgaagaaacatctggcccacgtgttgtggtttgttttagtttttgcatatcttgtgggaaaatggattctctaaagaataattttgtaggctaggagattcttcaagtataattataaagctgatttaattcactttctactacatatcattaaaacattgaactagtcttctaaaatattgtttcttcactgtggatttagttgagctttcttatgttatacgcagattctaatgaaaaataactttaaattttgtttgagcaattccgcagttagattatggagtagttggtaggtttaactgctgaagactttgtctctactgctgttgcagcacattttcctttaggagaaagatgcatccttttccaggtctaactctcctgtaggactcttcaactaccgtttattcaacaatcatcgatttcttagtttataccaggaactgatctgaaaagtggaaggtgatataaatgggacaccatctccactgtcatacgctctcagtctttctaaatataattcaagaaaaagaggtctgcaataagtcttaaatgtggactttgcttacgtgctatctttgtaataaatagaaaataaacgttcttattagaagtcctcataactgcacaggcatttctcccacactgcacgttgcataactggatctgtatgtagtgcagttggctagggtcatgccctgtgttgtgcaggctgcttttgattataaccacttgctgatcaggaaccagcatttaaaaggtaaaggagtgtttgctgccaactccaatgctttgagtggctcagtgcgttgcctgcccatcataaccacacgttggaaaagccatgaagcacagaagatgctgccgatctgtgacagggctggtagtagcaggggaagaggacaactcttgagcatagccagagataaagaaacgcacactttgtttagtggcatttagattttacagcttgttaaaaaggaaaagatttgattagtggaattcctgtaggaaaaaataactttgttattgcaaattttacataaattgcttttagaatacactctttaacgcaatttcttttaaaatgtacatttttgtttcttaggactacaactcctataaatagactcgaatagacttttagaatcactgatctctttttcctttttaatttcatggatcacctctttagggagactgctaatctattagtctttgaattcagatgctgttagaaggtgaagtgtctagtgattatgaaaatatgtttgagaaaataaattgaggatttgcactgtgatgttcttaatcttttttattctcccagctgtacaataatatgtctccacccagtgagaggtagaataatgtaccatgaggtagtactattagtcgttaaaactatgaattttgaaattagacttggtaccagtacactccccactaatctagttgtcctaaccttacaacatgtcagttatcattgctaaactcgagttacgtatctataaattgggctcatctgtacctttatgggtattcttgtgaagagtacataagaaaatgtatgtcaagcagctagtgcagtgcttagtaactagcaggcactaaaaaatggtacatattgtgatgttaaatactgtttttcctaggctgacataaaaatactgtagaaagagttggactatatagtacttactcttggaatttaaatgtttttgtaaattagatacagatgagagagggcactgtggtttttatatggttcagctgttatgtaggaaaaacaaaatttgttttttttcagttcataaaaacaaagtttgctttgagttcaaaatcatgataaaagccagaggaatcgctaaatttataactaaactatagtgagttagcattaaagaaagcagagctatgtaaaattattgatgatttatttttcccctttaccaaatataaatctgtattataaacaactataaagtttatattttctaagataaattgtgtttatatatttagaaaagaatagtttgttaatgatttacattataccagcttgttttccacaacaggataggtaaagattaagaaacgtaattatgactcagttgtagttttaatgatcgttatgacaaacccacagaagtaggctatagaattccaagaacattatgattttagttatgaaaaatttgcacactaaaggaagactagagaaaacagtacaaaaatgctgctaacagtgggttttctacttggctttgtggacaggcaaggccaaaaaaggaaaataaaagagacttagtagttttcattgattaatatatttgtcagtagaaaatcacttttttcctatcactaagttacacagctgaagttaccatgtgtcaagttatataggtaaagttagcatgttgaaacactattatagtcagtgtcttcaattatagttttaaagaaacatttgtaatgtttgagtctttaagcaactaaatacactgtgaaggtaaggcatttgattagaatgggtaatggtcttcctgttgtttgaagagttactatagctaagtaagtgcttcctggtgccctagctcctagcagaatagaagctagatagtcagtcaccttcagaatgcccctgtcaagcctcaggcaccttgtgccttgtgggaagtggaagtcagtttttcagtgtttcttcatcagatgtaaactcttttgcagcagtatgatctcttttgtgagccgtttatgtacttgggtttttaaaaaggggagtaggttttcagactgcccttttttcagtttcagagatgttgagatcccaggagatttcaggtgtggatgaagttaaagagaagaaaaatattgcacctcacaaattttgcatcttaggtggcagaagcaaagatttaatgtcacattcctatagattgcttgtataagtcaggcaccttttgactgaattataagttgaaattttattgtattgatcttcatgtattgaggatgactcaatacccagattaattcacaaaagatctccttgcatcctttgttctagatatattattatcccctgaggtaaaatctatactagtttttgcttttgcctgacagtagtgtaattttaacctgaagaaatttttcacacccacttgttgttttctaatttatgaaaaaggaagtgtctgccttctgcacctttctgagctcttactggaagccaggcagctctggaatagaataggaccagagccctgagtaggcgctttgctcacttagctcttgggcaagttaatgaagttttctgaggccctgtttcctcttttgtaaaagggagaagatattaataatacccagctcacagggtgctctaaaatgagaggggagaatgtgtgggcatacctgtgataaagcttccatggtggctcggaacgcggtccagatggcaacagccatcctgtgttcccagcttcaggccctcgatggcaggaccccctgtgcctggcacagaggattcagaggcaggcttgtgtcccccagtcttgggaatgttttcattgactacataatgtcattcgacattcaggggagcaagctatagtattttataagctggccaggtgcagtgatcctagcactttgggaggccaaggcaggcagatcacgaggtcaggagttcgagaccagcctggccaacatggcagaaccccatctctactgaaaatacaaaaattagccgagcgtggtggtgcgtgcctgtaatcccagctactcggggggccaaggcaggagaatcacttgaatctgggaggtggagattgcagtgagctgagatcacaccattgcactccagcctgggcaataaagtgagactcagtctctaaaaaaataaaaatagaataaaatacataaaagccaagttcgaaggagtggattttccccaaagttcgtataggttaggtgtttttaatacccttttcagtggagccacagttcagttcctcctggtatgttagaaagccatctaacaccccacatgccataacaaacaacaatttcaagaaagcttgaggaggaaattgtattcttctttccatgaatcctgtctgggctcttctcttgctgggcttttggcattttgacctacaatactcaaaccaggctcacaaagttccacctggggcccctgatgtgcaggttcttagttggaccctttttcatctatatgagtccttgttcttcccccaaatccaaattacatgaactgtcaactaggcagaagaaaggaggtgctgatttttctatgtgtcacgtacttaggtcaggaagaagtagatgcctccgggctaccttgtatgtacgaataaacgagagtgagcctggccgggtatggtggctcacgcctgtaaccccagcactttaggggctgaggcaggcatatcactaaagcccaggagttagcgtccagcctggacaacatgacgaaaccctgtctgtacaaaatatacaaaaattagccaggcatggtggtgagcacctgtagttccagcttctcaagaggctggggtgggaggatggcttgaacccagggaggtcaaggctgcagtgagctgtgactgcaccactgcactccagcctgggcaatggagcaaaaccctgtctcaaaaaaaaaaaaaaaaaaaaaattgtgtaggagaggatgttacctgtaatttatatctttgaccaggaagaaaaaaatgaatggaagatggtagggtggaagctgtggctgcatgtgtctttacgttctctgctggaacagcgcacctgtgctaggttttactgtcctactttggccccacttcaagagtgtttcttttgtgaagaaatcaattatcttcaccacttgttgtctgctaagtattagtgaagtctgatatggggaatgaactaccctcaggcctctggaagggatggagcaggtgggagcctgtctgtgaccagacgcacaggaccctttgtgataacttaccagttccctgcctgagctcctggaggctttcccatacattcttattagtcatttttggaaacttacatttagaagttggtccttgacattggtgctttagggagagaaccacgtcttactgtcattggagagtggcacagtgtctttgagtacacttttaaaatgttttctaaggctccacactaaagagtctaaaattgaaatatttgaagacctccttaaaatgaagcatatctaacttcaggcttgatttctcacatatatgtaggaaaaatatatttataagttctggaaatttgccataaatattattacctccaccaccaagaaaacaaatctgtgtgaccacaaatgctcccaagttgcaggcattcccagaggagcagcattgatagtgactgtaaactcttgtttttcctgtctaacaaagatgataggatggcttccctttcagcctttgcgtgaacttaacttctggttggaaataagatcccattgtctaaattatgtcagcgtagttcctggtagcacaagaatattaaacactttaatgtgacatccaaaattaatgagtcagttataagaactttccttgaaggatggaaaagatcataacccattttcatgtcctgggatgcttcattcagtctcatggtattaaaaaatgaacagcctttggattggggggagtggtgcgtgacacttcacatgctctgggccaccagttcctcctccctgctgctccgccactgcgtgacatttccttcttgtcctcattcccagtgcttctgtcttttctgtcttaaaatctttgctgctttggcctaggcggcagtagcagggggagagcagctcaggtgaaatgcttgccctcttctggaccactgtggagagaggcggagtcatatttacctgtgtacatcggtggcccccaaaggtggtttcttggcgatgctcacacagttgataggcgataggcaagagacgatggtattgacagtgtacctgatgcttgcagcccagccagggcctccatacccagtgcctcctagagcccccatgggaatacccaggaggtcatggagctggaacgtaaacccacgtctctattccaaaactcatgcttttttataagaggaaaacttttaaatagttttttcttaaaaagcctctttttcttcttcctaattggttctaaaacaaaagtttcggcaagtgcctcaaaggaaaatagggacaagattgttttctgtcctggaattcacagtggtgtctgtatgtactttagagctaaatatgcacatactgtgggcacatgcttattttctgaatgagagtgctctaaaaggattggggaccactgctctgagccccattgccccatctgtggagtgagtgctgctactcagctcctgggattgttctgtggttctgggctgaccgtctctgtgtgggctttagactgtgctggtgcagagtgagtgccccagaccagtagctcctgatggtgtggggactcccaatgctacttttggtgatttattttcacgtactcttgtgtcatcccagggtgaagatacacatattctctaatagcaggacatttgtttttcatttatgaggtcattcagaatcgtaattgaggtgatgttgaacttcttagattgcagaaatggcagtagcagtaaacaagacctttatctgaacaggaaagtagtctttccccaggaagtaattacatttccttgtaatcacctgtttgtgtaatcgtaataactttacaagttattcataaaaataggagaatgactagtttgtctttgtcataacttgtttgtgtatgatacatgaagtagaattcatacagcacaagtactttggaaatttggaaaagtttaattttctaggactttttagttatttttggatgttaaagtaagtatatatgacagtgcataatgtgtttcaattttggaagtgattctttgctattgaaattctcattctccttacttcattcttttttttcagggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaaacatggcctctctctttacttggactttgaacaaaagtcaactgttgtctcttttcaaaccaaattgggagaattgttgcaaagtagtgaatggcaaataaatgttttaaaatct

SEQ ID NO: 38668 - DNA, 14169 bp, Homo sapiens
ttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtgagtctcttccggcatccgcctggggacgaggagggcccagggagagccggagtcgggccgggctagcctccggccccaacgcgcagcaagccttttcctcgggtctggcccgcacgcctcgcccagtcaccagaaccccgccatccatgtagtgccagtttgtgcacacggctgggacacgctccctgctctcaatacacctggtgtagccagggagagagttgtaggccagcaggaaagggcaagtggctgggagactcgagctgtgagtgtgtagaagagggagccccttatcggatctgaggagacatttttattaattcactggtttattctctcattgagcaaatgcttactggtcgcttaccatattccagacatactgctgggtctgggagcaagagtgggagtttggttgggaccacacgagatcctgggatgtcaacattggaagggcccccagagatctgagagtccaaccctttgtctcacgtgccatctcagttgcaaactgggtttagatcccaggttgtctgcctcccagaccaaagttctttctgtaacatcagcctttgtcaggggagaagcaggtgctctggtactacttggcgccttttgggaggagctctcatatggggagaggtggtttgccctcctgcttcaaccttgacagctgataaacgtaacccctcctcaccgtgctggatagtttgccaagctcttaaacacccattttatcagaattaaacatccattttctaaggtaggttatcttctcagatggtgaagctgagctgcttgtagcattaagtgtcttgatcaggttcgcaccccaataagcaaaggcatgaagagctcagtcttctgatctaacttgctctttgcactacatcttatccactctcacctgatgggatagcttgttccgctatcaataacagccagtggtgatgtggagaagggatcatttggggccttaggtgttgctgattctaaaaagatcgtagtttttgaattatgttaaaatacttgaattattttgtgttttcaagtacttatgcatataagagcatccaaatctgttctttaaaaataaaatattgggacaggcgcggtggctcatgcctgtaatcccagcactctgggaggcagtggagggtggatcggtaggtagttcgagaccaacctggccatcgtggcgaaacccgtctctactaaaaatacaaaaattagctgggcatagtggcacgtgcctgtaatcccagctactctggaagctgaggcaggagaatcgcctcaacccgggaagtggagtttgcagtgagccgagattgcaccactgcacttcagcatgggcaacacagtgaaactccgtctcaaaataaatagtgaaataaaatcttaggaaaatgtgcacattaattcattcagtgttcttctaacacatgtgctaagtgacccctgtgttcccagatagttctaggtgatgcgaatatacagtgatgaataaaggagatatggtctttagacttttgagagtttaagtcatagtggaaggagatagacagtaaacaagtaagctaataaaagagcacctgatagtgatgagtgctgtgaagaaaataaaatattagtgtgaaaataacaggggccgggcgtggtggctcaggcctgtaatcccagcactttgggaggcccaggcgggcgaatcacctgaggtcaggagttcaagacaagcctgaccaacatggagaaaccccatctctactaaaaatacaaaattagccggggtggtggcacatgcctgtaatcccagctactcaggaggccgaggcaggagaatcacttgaacccgggaggtggaggttgcggtgagccaagatcgtgcttttgcactccagcctggacaacaagagcaaaactccgtttcaaaaaaaaagaaaataactgggagggatactcaggaaatgtattggttttcttaaaacctgtcttgtgatcctaaactctctttagcctttcttattctcaaaaacaccatctgtggcgtggtcctctgcggagaatggtagcagcgtgaggtggaggcaccacaatcccttgtcacctgggccaaaagcagctcatagcccatttctattcagatctgtgtacaggtgttcataagaccaagatgaataagacactgtgttcctgtcaaagggttcatgttcccttctgtgttagtccattcttgcactaatacttgagactggataatttctaaagaaaagaggtttaattgacccatgcttctgcaggctatacaggaagcatagtggcttctgcttctggggagacctcaggaagcttccagttatggtgtaaggcaaagggggagggaggcatctcacatggcgggattaggagcaagagggagtgaggggggagatgctacacacttttaaacaaccagatcttgggaaaactcactatcacgagaacagcaccaaagggatggtgctgaaccatttatgagaaaaccagcctcatgatcccaccaccagcccccacctccaatatggggactacagtttgacaggagatttggcggggacagatccaaaccatgtcaccttcaaaggactcacctccagcaggagggagagaaaggtcaattagccatcgtagtattactgtatagtgatgattgcagagctaggcatagatgtggcgcaagtaactgtcacctgtctttggaggagagatcagaggaggaaatggaacccaaagatctgtctaccccctcagagatgttggtaattctgcatgaaaaaccagtttagtgctcgcctcagcagcacatatactaaaattggaacgatacagagaagattagcatggcccctgcgcaaggatgacatgcagattcgtgaagcgttccatatttttgtctccctggacttcgagcaggagatggccactaccacatcctcctccctggagaagagctacaagctgccggatggccaggtcatcaccatcagcaacaagcggttccagtgtccggaggcgctgttccagccttccttcctgggtatggaatcttgcggcatccacgagaccacgttcaactccatcatgaagtgtgacgtagacatccgcaaagacctgtacaccaacatagggctatccagaggcaccaccatgtacccgggcatcaccgacaggatgcagaaggagattaacgccctggcatccagcaccatgaagatcaagctcattgtgcccccagagtgcaagtactctgtgtggatcagcggctccatcctggcctcactgtccaccttccagcagatgtggattagcaagcaggagtatgacgagtcaggcccctgtatcgtccaccgcaaatgcttctaaatggactgcgagccgatgcgtagcatttgctgcatgggttaattcagaagtataaattggccctggcaaatgcatatacctcatgctagcctcacgaaaatggaataagccttcgaaaagaaattgtcgttgaagcttgtatctaatatcagcactggattgtagaacttgttgctgattttgaccttgtattcaagttaactgttccccttggtatttgtttaataccctgtacatatctttgctttcaacccttagtacatgtggcttggtcactgcgtggcaaggtaagaatgtgcttgtggaagacaagtgcgacttggtgagtctgcatggccagcagtctccgatctttgcagggtattaatatgtcatggctgagtgttctgggatttctctagaggctgacaagggctcctgaaccagttgtttctgtcctgctggtctgtcagggttggaaaggccaagccataggacccagtttcctttcttagctgatgttttcctgccagaacactgtgggctgtgacttgctttgagttggaagcagtttgcatttacacctgtaaatgtattcatccttttaatttatgtaaggtttttttttgtatgcaattctcgattctttaaggagatgagaacagattttggttttctactgttatgtgagaacattaggccccagcggcatgtcattgtgtaaggaaaaataaaagtgctgctgtaaccaaaaaaaagggaaaaaaaagaaactagtttaatagctgctgctactaataaaaacagctaagattagatgcttactctgtcctaaacattgtatgttcactcactcaatcctaatgtcaacctatgaaagtagatactgttgtcaccattttatagatgaggaagtaaggcttagaagccagtgtggtgctcttttgctgagttagcctaccttcccagattgagctccaggatgagtgagtcatttattcatttattgtatctttataaagcacctattatgtactaggtcctgaatagaaggtagtccacaaagcggctctggagctgccttcctggagcttccaggctgacaaaccactttgagggtttcttctctggggcttccagcctttactctgatttccatccactgctgccagcacagctgtggcgtgtggaatcctggttggacccagacttcctcccaagcagatgaaaggattagggggcagagatgggggtggagggcagtcctgagatcaggatgagctactttcccataatcctgaatgtccatcctgtggcctgtggatcttctgcaacttattctatgttagtgcagtcagtcagatagtgcttatgtattgaacacctcgagatgacaacattgagcagctgccaagcggaaggcagagtcctaggcactgtgtaaatggataagtctatccatttaatcctcacaatagctcctcattaaggtaatttttactatccacagagagatgggaattagtaacttgcccagaacaaaggcaagcctcaacccagatgatatctgagcatgacttcactgttggcgtttgtttgttgtttttaatttttatttatttatttatttagagacagagtcttgctctgtcacccaggctggaatgcagtggcgtgatctcagctcactgcatcctccgcctccggggttcaagtgattctcgtgcctcagcctctcgagtagctgggattacaggcacatgccaccatgcccatctaatttttgtatttttagtatagacagggtttcgccatgtttcccaggctggtctcgaactcctgacctcaagtcatccaccggcctctgcctcccaaagtgctgggattacaggcgtgagccactgagcccagccttgactcactgcagcctcaacttcctgggcccagccttggctcactacagcctcaacttccttggatcaagtgatcctccagctaatttttagatttttttagatacagggtctcactgtgttgcccaggctggtctcaaattcctgggctcaagcaatccaactgccttggccttccaaagtgctatgattacaggcgtgagccacagcacccagccccagactctactcttaaatgcaggatgttcattcattatttagtcaacaaatatttagtgagttgcagctatatacaggcactgccgtagtaaacaagaaaaaatcctgtctctcttggagcttatgttctagtggagagacagcatataaataaccaagataattttggatggtagtagatactatgagggaagtaaagcattgtagtgggatctgggattgggtggctgtgctggaagacaccgttcaggcaagacctccgaaggtgacagtgaggctgaggcctaatcagtgaggagtcagctgtgccatgctctctgggaagagtgttccagacggaggagagggcagatacagagaaagcatggggtgggaggatttggcgtgtttgaggccacaagcaggcagtgtagctagagaggggactgagatgaagttcaagggataattagcaccacagtgttggaagaagttcgaagtgtattataagtgtagtaggaagccattaataggtgttgaacaggggaatgatggaatctgagttcaattctcaaaagaccactctggccctaccattgtctcaagcgctcaagctgtagacctggaagacccccatcctgtcagtcgtaaactctccagtcttcatttgaaagatcttttgaatccatgtgtttctcaccaccctgcccctgatcctctagtcaggacctccatcatctcttgccagtggtacagcagtagcccctgagctggcctctccccctttcgttcttccaggcacatgtaccactttcttgctctgcagtgttgttttctgcctgttgatgttgtgtcctttcacaggtcaaggttaaaagtcacctcctctgtgaagtctttactggctccaccccagccccctgtaactgcttttttaaactgcgtctctggaggcttggcctgcacccctagccaggtgctttatgctcgtgcccaggcagcattgaggccaggactcggccactggccctgtgagttctccttaaactggatcagtctctccagcacccaggtcctgtagggccatggttctcagaacacagacaggtctggggttcctatgtgtgacatattggggtgcatctgagatttattgttgttttttaatgcccatggtttataaaaaaggaacttttatttcctggcatacaccatgcttctgttccaatttctacccttgcacattctgtttctttgttatttcctcagggaagcctttcctgaactcccccacccatactggtgtcatgaccgcccacctttttttttttttttaactttcttattgaggtataacttatgtaccaaacggtgtgcgaatctcaagtatacagcaggaagaatttttgcatatcacacactcatgtaaccgccacccagacgggggctagaaagcaatgctaagacccagaggacccccttgtgccctcccagtcagttctaccacagattccaccccgctgtggacctctagccatagatcagtcttgccttttcttggacttcacgtaaacagagtgctatgttacgtactctgtgtaagatttccttcattcacccttatgtctgtgaaagcctgtgttgtgtgtagcagaagtgacactgtttttcattgttatggactatttcaatgtataactataccacacttattcatcgtactgttgttgaacatttggattctttctagttgtttttatcaattttattgaattatagtttacatataataaaatgtacacattttaagagtacagttcaatgagttttggcaaatgttatttcccaggggtgagggcaaagaaggttccaaaagtgaaactgctgaggcatttagtatagtgccaaactgttttccagaatggtagaaacaggccgggtacggtggctcacgcctgtaattccagcactttgggaggccgaggcaggcagatgacttgaggtcaggagttcgagaccagcctggccaacgtgatgaaacctcatgtctactaaaaatacaaaaattagccaggcatggtggtgcactcctgtagtcccagctactcgggaggctgaggcaggagaattgcttaaacccaggaggcggaggttgcagtgagctgagattgtgccaccgcacttcagccagggcaagagagcgagactccatctcaaaaacaaaatggtaggccgggtgcagtggcttatgcctgtaatcccagcactttgggaggccaaggcacgtggatcacgaggtcaagagatcgagaccatcctggccaacatggtgaaaccccatctctactaaaaatacaaaaattacccaggcgtggtggtgcacacctgtagtcccagctactcaggaggctgaggcaggagaattgcttgaactcgggaggcggaggttgcagtgagccaatattgtgccactgcactccagcctgggcgacagagcgagactccatttgaaaaaaaaaaaaaggtagaaacagtttatccctcccaccagcagtgaatgagagctctggttgtcccttgccctcacctgcattggtgttgctgtcgtttgagttacagccatcctggcgggatgctgaggtatcccattgtgctgtcggtttgcagttacccttgtctgtgcttccccagccttctggaccaccctaatggccacctgtcaatgaaacgtaatattcacatgcttctgtactgtatgaagggtccccagcgtccgtctaactggctgaaagatcccctaagctctgtcccttccccgtccttttcctcacaggtggtttttccccatcatcggccacatgggcatctgcacatccacaggagtcattcgggacttcgcgggcccctactttgtctcagtgagtccccattctgcccacccggggggttccaaggtttaagtggaaggctgtcctgtcttgcctgcaggcaggcttcgtctccccagacccaggagaacgtagataacccgcagtcctggccctggccctctgcccctcaccagtgtttgacccctttcccccttctcttgcctccaggacaggccgggagggcagtgtggccagaaggattcttaagtaactgacccagccctttgcccccacccctggggtaccgagacatgggtagggattagaggcaagagtggagagtcagaccatccaggaaccacatctctggaccttcagaaggtgggagtcaaggtggggggacacgggaggctgattcggttccctgggtgtggccatggagaagagggggtggggctttagaatgaagcagctgtgttctcaggtctgttccctggggctgtgaccaagactggtccagtgggctagcagcagaggagcatgcatcatcctgtctccaggtgtcagaggctggactgaaggggtgtggtggcaccaacctgtttatattaatagttgtcatgatcatcttaacacgacaaaggtctgtcactttgtacttaaaaatactttcacatccattactttatcatatatttttatggtgattaatcattgaccaggtctgtcagcagggtctccctgatctgaacccagagtctgtctctgtgtaagtcctgtaccccaggaataatgtgatgagtctaggacttcactgcagtgtctccctcacaggaagtccctctgggcccagcgcccccgccctgctatgaatgcagtcagactgctgggcgaggagatggtctccatgtgggccaccactgttgagtcaggaggccagaccatgatggaaacctcctgctggtcctcagagatcagagaagactgaccagagaacttggagaaaatgaggcccagagagggcaagagaattcctgggtgccacaccaagggacagtggcagctggagccccagatctttggtctctgatgcagtgctctgtgcacttgtgccacactgccttcttcctgcagaacagctgctagctctttagatgccatgccagccccagggcagggcccaggccccacttctggcccccccacccctgacataccctcttctaagtcactgcacttctgccacctacccaggtttgtcatctggcccaaatgtaagttcctcactgacctctgcttttgtccctcaacaggaggacaacatggcctttggaaagcctgccaagtaagtgatgaacacccatgtgactggctctagaggcaggtcgctcctgccggggcgggccaggccttctggggcacaggaggggccagcaccctgagaatagagtatttggggtcgggggagaggtcagccagggtccaccagagcatggcaaccccatacagagtgtgtaccgcaccagcccctggctagggcctttacctgtagaccatctgggccttgccacagctcttcaggtttgtattttcaactccatggcaagggtgaggaaagggaagggacttggtcaaggtcacacaggaagtggcagagctgggacccacacccagatctgtctccctctagactcactctcctgccctttgggaacaaatgaggcatggaaggtagaagagaggcattgtttggagctctgctggaaagttctggttggagagaataaaaaccgttcaaccttctgggagctattgctggtttggtttgggacatttggtcttcatctttgcagtctcgggtgcccacctcagctgtgggcctggtgagagtgcctcagtcatcagtgtcctcaggtgacctgttgcccaaggctgcactgggaggagagactgggccgaggaggagttggtgtcccacacagctgagatggcctggagcagggcttcctgctgccctctctggcttcctccggcaggcagcagtgtagtccaggagtctctgggccaccaggtgttcgctgccagactgctcttcaaggacagttttaagggcatcattttccaagcagtagcccctaagcggccccagtccaggccatggtctctagactcctccaccaagccattcccctacacaacagccagggggcgccctgacctcccagctctccttggcctgagacccaccgggcactctggtgcttggaacagcaattctcacccaccttgaggtttatgggctttagcaccatcagcttccctgccactcaccctggcaagctgcctgggagactaggggagagtgcttgctgctgggtaaactccccgcgtgatgtggcctcacctgcatctccagccttagctgccagcattccatcaccgtgtttctctttctgcatcctccaggagggctcagtcacttcagttatgggacatgctgcacagttttatgcctgtcacttagcttaagctgttccctcagcctggaatgcccacctcttctttctatgcctgcctaaccctcttccttcatactggacccaggtgtcacctccaggaagccttctcacaccccatcttagtccgttctggctgccataacaaaatctcatcaattgggtatcttagaaacaacagaaatgtatttctcacagttccgaagactggacagtcctgggtgcgggtgctggtagagtcagtgtctggtgagggcctgaggtgcctttccactgtgtccccacgtggtggaggggtgaggggtctccctcagggctcttttataaggacacggatcccattcatgagagctaatcaccccatggcctaatcacctcccaaaggccccacctcctcataccatcaccttgagggttaagatttcaacatatgaacttggggacacagactttcagagcatagcacccccaatttcattccatatccccccaggatcccccatggcaccagccacctcaccctgtgtcacagttgactgccacataacacttgccccagatctggcttactgtacatctcagcacccagctcaggcccgggcacagggcaggcctcagaggacgtgcgtagagctgagggcacaaaggagccaagcaagtgtccagagcccttctctccccccaggtactggaagttggaccctgctcaggtctatgctagcgggcccaacgcatgggacacggctgtgcacgacgcctctgaggagtacaagcaccgcatggtaggtgggccagggcggcaccggcactccccaggtggggaccaggggggaggctcccctgcagcccatcctgaccagcccttctggtgcctccagcacaatctctgctgtgacaactgccactcgcacgtggcattggccctgaatctgatgcgctacaacaacagcaccaactggaatatggtgacgctctgcttcttctgcctgctctacgggaagtacgtcaggtgagctgccctcctgcctgcccacccacacactgcccagaggctgctctcccaaggatcctagaaagaccattcctagcgtccttcagtcagccaggacagttggaacagatgccagttggagccgtggtggttctagagtgacgagctgagggcctgatggagagggaggtggctgtgctgaagtccagctccacctgggccccaaatgcagctctggctcttgcctgctgtgagaccatgggcaactgccttggtctctcttagccacagctgtctctggtgaaatgcaggcaatgattccggctcctcagggaggcttctacggatccctgtgctccggtaaagtgagcagatagatcctctcataatgactgccccacaggtcccttcctaggcagagagattgagtgagtcgcccatggtcgccacagcatggacacagcagagcccagactcgtgagccagcataggttagtgctgatctggccgcctctccaagctttcctcttagccacgttcatcattaagaggttctgaaaagaagacttttagggatatttttaagtactgcatggcttttagaagtcccctgagaataactggtcacacagaggttgaacccagacccctggctcccagctgcttggctccagccacaacactgctgacccttgccagccccagagctcccagtagtccccattatgaagtccataggcagagggcacacgtggcttccatacccaaactgcaattcctggtcctcttgctggagaccctagaggtaggtggctatagatggagccagtgaggcctagaaatggggagcatgtttcctgttcccaaccagcgaggtgtcagtaaatcaccaggagcgcggagcagcccctgcccgggaccatagctggtgatcccccatagtgggcaaccatgcccagcctgcttccttgattggccaagtttggggtgagggggtggttgggttttccttagggatggcagccctattggggtctgtgggtgctcagggctgcgggccgcatgcctgctcaccaggccctgcccacctatgctcgctcctttctctctgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcc

SEQ ID NO: 38669 - DNA, 15853 bp, Homo sapiens
cctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcgggtgagtgagagaaggaatgagggccgccggcggctgggcggcggggaggttgcagcgcctcctctcaggctgctgccggcgcctcgcatgcggcccggagtcaggataccagcatgcagccgggggtctcgccccatcccgccctggactttcccctgggagacccctcggctgccccgccccgccccaacctcggagacctccagtgccccgaagcaggcctgccctggcctctgggcctccgcaccccggcccggcccccacggttggtgaagtgcagactggctggggctcagccgcccagtcgcccagcgaccttgtagttacagccctcgccgtgacagtcgccttttacagcatcaaacacttctgttgattttctgcatcgggaggtccttagggccgagggatctcttaaacagttgaggaaaaatgggcagggatggtggcttgctcaagcttgcgcaggaagttagcaaggccggaggctaagggctcgcggactttgggcccaaagtccaatctttttttccagccaaatacttcccccacttggtgtcatttctttatttctgaaacggaggtgatcatttcttccacatagggacgttgtgaaattctctccgttacgcataattttgagccccttgtatgtgccaagcgctgtgctgggaaagttcgtggagcacccagaagtgctgtacacacggtccggctccagcaaagggtaactcattccagaggcaggcagagttggggtcaggagtgcagccctccccttgacagctgtgggcccgcgggcaagttacttccctctgggagattgtttcctccacttaaaatggggtaatgttgacccctagggtagctgacagaatgagttgttatgtgagacatgcttcgaacattgcacgttgtatatagtgcaatataatgcaataagcatttactgttactaagaaccctgaccaccttctagattcttaatttaaatgtggtcatgggcaacaaagcactttacagatatgcttgtgtaagggtttattgttactgaaggaaggcagtggcagtttatacttaaatgtaattatttattgagcatttacaaacctggctaggtgctactaataatatctgctgttgatagagtgcttcgtgtgtgccaagtgctgttctaaacatattcacatacattaaactcatttagtgcttatgccaaccgtatgggcaaaatatgatttttatcctcacttcacagatgaggaactgagacagtcacagagaggttaggagacttgcccacggtcatgcagctcgtaagtgctggtgccaggattcaagtatggctgagtgcttgtcttcaaccctcctagatcaccccctgtggtgaagttctattaccgttcattacgtgcacagttctcaaaataatcctatgtggtaggtactattgccataatatcctaatctccattttataagtgaggaagctggtgctcagcgggggttcagtcctttgcccaaagtcatatggcaagtaagtggcagggccaggatttgagccctggtgaaccacaacctgtatgtttccagaatgggcatccagaggctggggtctctagttctagtcttgccattaagtcatacggtgacctggagcggggggtctctggaacttggattaaaaagccctcacatagtctctacaggtccttttgttattaattctgatactaggcttgtatgtctttccttctgtttatagtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcaggtacgtaggccctcgttcctgtaggtttccttattttttgttgcaagggaccgagaaaaggatcaaagtcatccttttagtcattagaaatcagtgcagagccaggtgcactggtgtgcacctatagtcccaactctgcaggaggctgaggcaggaggatggcttcagcccaggaggttgaggctgcagtgaggtatgattgcaccactgcactccaggctgggtgacagaatgagaccctgtctctggggtgggggggaaaaaagaggacatttgaggtctgcctcaaatgagaaatagaggtttaccagcagcagggcaggaataagcaaatgcctggagtgggaactgcaattttcttttttaagagacagggttggcccggtgcggtggctcacgcctgtaatcccaccactttaggaggccaaggcaggaggatcacaaggtcaggagttcgagaccagcctggtcagcatggtgaaaccctgtctctaccaaaaatacaaaaaattaggcgggcatggtggcgcatgccttaagtcccagctactcaggaggctgaggcaggagaattgcttgaacccggcacgtggaggttgcagtgaaccaagatcgcgccactgcactccagcctgggtgacagagtgacactccgtctccaaaaaaaaaagagacggggtctcgctctcgcccaacctggagtacagtggcatgatcatagctctctggaaccttgaatgcctggcctcaagcagtcctcccttctcagcctcctgagtagctgggacgccaggcatgtaccaatgtgctcagctaattttttatttatttattttttttgtagagacggtcttgctatgttgcccaggctgctttcaaactcttagcctcaagcgatcctcccacccttgcctcccaaagctttgggattataggttcaaacagctctgcctgtccagaaactgcactttgtagtctggaaacttaagtctgatgtggccagcatggtacccctgtaaggcaaatagccagagttgaggctgggcctggtctggaaggacgttgactccaagttgagattgtaatgtatatcttcttatgtggggaccatcacagctctgtaaacagaggaatgacatagccacatttgtatcgtagagggagcataccagtggcagtgtgaagaataaattgatgagagatactagaggcagtggatgtagccagatcagattgagggaccgaggggtgggggtggccacatataaacacagtgtgtacagcagtgggacttggtgatcagttggctgaggcaggaggaggagagagaaagatgaagagtaactgggtgtaaggcctgccagctgggtggagggtgctgcttttaactgggggagggaaagtaggaagagagccttatgtaatgacttttggttcttctcagccacttaggattggcatatctgcctttggcagtacagggccaggggtggggtgatgcccatgggagcctgtctgcacagggagggttggctagcggatctaggagggaattagggcgttccttgaaatctttgtgttcctaatatattttggctgtgagttgggctacacgctgctatcactaccccctcaaaaaaaccaagaaacaaaacgccgtagagttaatacttcattcccacaacatatactccctatgcatcaaacactgcacaccctggggatgcagcagtgaatgagcccaaatgtcccccagaagcatatggtctgggggttaatggagtggagatgggaacaaggtgtggagcaagtacctaggacccctgtagattagttctccgcaccgcgtgatctcagggttcaaatcttggtcacatactttactgacacagtgaccttgggtcagttacagaaactactcagtttcttcatcctttaaatttgggataatattactgatctcatgggattgttgttgtgaggattgagggaattaataataagtgtaaaattgccagcacataatacacactcaatatctgctacctagtctcgtacatactcaagcaagataggtttataaaaaggcctatggctttttcaattaaaataagttggaactttcacacttctgtgctgtcatcctaggaagccgcaaggcctccattattcatcatccttaactatattagggtgatgagcatttctgttcccatttttgtatctagcgagacaggttaaataacttgcctgaaatattggcagagctgaaattctccatccctagttctgcccaccaggtctgtgttccttctttgttttttattttaaccatcttaaccattttaaagtgtacagttcagtagtagtaagtatattcacattgttgggtaacagagccccagaacccttttcatctggcacatctgaaactctgtacccattaagcaatggggttccttcatgacagtcccgattggaggtggagttcttacctgctagtaggctgtaagcttatgcagcagaacctgagtggagagcgtgtcatggagaagcagtttaaactggaacaagttgaattaacttttcaagtaaggtccgtgtctgtctgttgagcttgtggatgccgtcttctgttccaggtcaccaggtctgtgatgtcagtccgtccttggatggtgggcggggggtgcctattgcactacagtaggaaaagcctttttttcttgagatggagtcttgctctgtcacccaggctggagtgcagtgggtgcaatcttggctcactgcaacctctgcctcccgacttcaagcgattctcctgcctcggcctcccgagtagctgggactacaggcgcctgccaccacacctggctaattttttgtgtttttagtagagacagaggttcaccgtgttagccaggatggtctcgatctcctgacctcgtgatctgcccaccttggcctcccaaagtgttgggattacaggcgtgagccaccgtacccggccgaaaaggcttaacaagctggcccaacttaatagttttgatctcagctgttggctcacgcctgtaatcccagcactttgagaggccagggtgggcagatcacctgaagtcaggagttcgagaccagcctggccaacatggtgaaaccctgtctctactgaaaatacaaaaaattagcagggtgtggtggctcatgcctgtaatcccagctactagggaggctgaagcaggagaatcacttgaacctgggaggtggaggttgcagtgagccgggattgccccactatactccagcctgggtgacagagtgatactcagtctcaaaaaaaaagaaaaaatagttttgatctcaagtccaagatggcatcactgcgaattttcaaggccgttttagagcagtctcaaaaggtgcactgtcactcagaggacagtctgggttgctgactgacttctggaagctgacctttgtcctgtggatggaaatcttaaaagactagaggagaactcatttgtggagcacttttacagtttatagaccatccactgcaatacagtttataccgttcacatacaggattgcagtgaatggtttttcctcactacaaccctgtgatttggtcccacgcggggaccattatccccttttcgtagctgaggtgttaagtaactcatttgaggtcacccagctaataagtcagggctcaaggcaagttctgtatctcaggatttctgactctaaaacccacgctctgttctgtcatctgtagcaccaccttgctctcaccagtcatcagaagggcaccaaggactaaaatggtccagggaggctgcttctgccctgagtgaggaggtgcccttctggccctgctgcatcacactcaaggatcatttagagggcacatgtgtccagtggctctccctattgtaaatatttcagtaaagagttaaaacaagagacattgttatgtgtggggaaatgtatagtgttctgcttttctcctgattgggttatcttgcctctgctaagtttggtttgtcccgtctctatctcagtggccactggagagagggtgtctgctgttcttccctgattccacctgtaaatacaaacgttatctcttctccctggctttgctctgtgcatttgaggtgggaatgtactcggtttggcgaaatagtctttcatgtccctaaacctgaagcctctattgactgtaaatggtagagaaaaggaaagtacccccaaggtgtgaactctagttagggaaaaaaatatttttgggcttgacagtgactcttagttaactcaattactggaataatagagtcagaaatatttctttgtttttcagggaggtagaggcaggagcgtaagatgtggaagctagaaatatccacttgtaacacggtattagaaggaatgttattttacatggaagataatcctcagtgatccttttttttttttcttcaagacggagtcttgctctgtcacccaggctggagtgcaatggtgattctcctgccttggcctcccgagtagctgggattacaggcatgcaccatcatgcctggctaattttttgtatttttagtagagatggggtttcactatgttggccaggctggtcttgaacttccgacctcgtgatccacccaccttggcctcccaaagtgctgggattacaggtgtgagccaccgcgcccggctgatcctgtctcttgatgtcctcccattctgggacgctaaatggtatccgactttgttttcccttatgtcattcctggtgtgaaggacacgggatattatagaggagagtggcagcatgctgagtggtattccgatctgaatcacactgtcatcctttatccggctcaggcccagggttctaactccacaggaatgggcttatctggggactgctgctgctgcagtcaggaagactccactgtagtcgggagcagcactggcctgagcactgcactggaggccagcctcttcgctgtggtgcccaagtacttctttcaggtgaacacatttttagttcctcttccaggtgtaatcgagcagatgggtgttttgttttccagttagcagtcgagtctgcagtgtcctttgtgttttttatctcccggtataccagtctcacctaagcttttatagtccccgctgcgcacttctctcaagaaacaaagcatttgtcaagtaggagggtccatggagggacctttctcacatatggacgtgtagtttcagttccgtgtgcaggatgtttggtacatgttgttttgtgttttgtttgcagaaagtagatagaataagggccgatttgatttgggtaagggtgagcatggtacagtagaaaaagcgtcatacaaggagtggggagtcctgagttctggagatgactgtgtcgttttgttttcgtttttgagacggagtttagctcttgttacccaggctagagtgcaatcgtgtgatctcggctcactgcaacctccgccttccgggttcaagggattctcctgtctcagcctcctgagaagctgggattacaggcatgcgctgtcacatctggctaattttatatttttagtagtgacggggtttctccatgttggccaggcttgtcttgaactcctgatctcaggtgatccgcctgcctcggcctcccaaagtgctgggattacaggcgtgagtcaccgtgcccggcccattttgtttttttatttttatttttaagagatggggtctcactctgtcactgaggctagagtgcagtggcgtgatcatagctcactgtagcctcaaactcctgggctcaagcattcctcctgcctcagcctcctaagtagataggactacaggcatgtgccaccatgctcaatttatttttatcttttacttttggagatgggggtcttgccatgttgctcaggttggtcttgaacttctggccacaagcgatcttcccacctcagcctcccgggtagctaggattataggcatgagccactgcgcctgtaccatttcttttctctgagacctgacacatcacctccctatgttgagaacctctgtgtgaggtgatgtgatggcattagatgagctccaaggtcccgctcagatctaaccttccacaaagtagtggccaaaggacgaagaaatgacctgcattataacccctgtgatggggtagagagacctgctttataacctctgtgaaggggtagagagacctgcattataacccctgtgaaggggtagagacctgcattataacccctgtgaaggggtagagacctgctttataacccctgtgaaggggtagagacctgcattataacccctgtgaaggggtagagacctgcattataacattgtgaaggggtagagacctgcattttaacattgtaaaggggcagagagagggctgttttgcatggtggggtacttcattgtaatacaaaaaaggactgacactgagcttaatgctttcttaatctcactagcttggggaaagttttcctacaatacccaagatcagcccctcctccttgcatcctgatctatcatgggacattgtagctccctccagaccctaaagcatgcagtgctggaggcaagaagatttgggttgctggaactcacagagtaccctgtacttgttggggtttggcttgttaggggagggaggttcttggggtcccagtacttatggccgtgttctgtcttcattctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcgggtaagtgcatgcagccagggctgggggtggaatgtagtggtatggtcataagatgtaatgttttatagaaagaaaatgtcgaagcgttctaggaggaaatgatcgcaatgataagtgaaaaaaacaggtttcaaaagtatgtatagagtgatcgtcattacatgcatctagaaagaaacataccagatattacaaacagttttctctgggtcatgacgtggattatctatgtcttatatcatgtagtcttccctgagattttctgcgtggagcaaagtattctataatctaaaataaaaacaaaattactaaaagaacttactaggacagagcttctggggaggaagtaaattggaaggaaatagggaaagagggcaggtttatgtcctgtgtcctctctgctatttcagatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacaggtgagaagggctgctgcccctcctgggacctctctggactttcagtaccactcctgcactcagcagatgtttcctgagcacatctgtgccaggcactgtgccagcacttgccctccatgccaggcccttctttctggggctgaggcagctgtggactgagcaggcatgggcagagctcacgtgcctctctctcttgccttggcagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtaacaaggtggttctcatggtgggtggggtttgagtgctgagcaccatagtgttgttggcacagatcagtgtcccaggcttgccagaaagactgaggtcttacagcttccgaatcctgtgtacctcagcagcatttggagatccatgcttgttattcttttttttttttgagacggagtctcactctgtcgcccaggctggagtgcagtggtgcgatctcgactcactgcaagctctgcctcctgggttcaagcgattctcctgcctcagccttccgagtagctgggattacaggtgtgtgccaccactcctggctaatttttttgtatttttagtagagacggggttttgccatgccggtcaggctggtctcgaattcctgacctcaggtgatccacccacctcggcctcccaaaatgctgggattacaggcgtgagcctggcctgttattctttattcttgtgtctttaatcgtttctcatgttttagtcctacttacaacttctaggaagctataagaggcctcctccttcctatattcttgtgcccatctctcctttctagttttctcactctgtgtagattgcatggtgacatgaaagaattttttttttttttttttgagatggagtcttgttctgttgcccaggctggagtgcagtggcacgatcttggctcactgcaacctccgcctcctgggttcaagcaattctcctgtctcagcctcctgagtagctgggattacaggcacacgccacaatgcctggctaatttttttgtatttttagtaggggatggggtttcaccatgttggccaggctggtcttgaactcctgacctcaagtgagccagccgcctcagcttcccacagtgctgagattacaggcatgggccactgcgcccggcctagagttcccattcttgctgggggggaatgtaagatggtgggaaccgtcttagaggaagcatgtcttttgaacagagtaaaccctcaaaaccctttaaattctgccctgacaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaac

SEQ ID NO: 38670 - DNA, 47072 bp, Homo sapiens
tgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggaggtgagcgcccggcccccgcgtcctcggctcgcgcccctttcctccccttggcgccttcccgcccccagcccggccgtgcgcgagccaccgacttggagggggtccaggggagcgggtccagttgagggtttggggtggggagggacgccaaaagcccgacctcgagctgccaaatgagggagcgcggtgctggtggcggaggggcaaccaggatcggtggaaaaggggaaggagggagtaagcgtctgggctggaggagcgcgcgcttctgcccctttcagagccggtgcctcccgcgcccctcaccccaagctctccgcagcgtctggcggttggggaggggaggggaccgcgggcgcgccctgggacctctctcccagaacggtgctgttgaagccagggtcagatgtcgtggctaaaaaaaggcagccggcggcggcgtgactggcagggtcgtcggcagctgcgggtgtcagtctcgccccgcgtcgccgcgggaggggcccacccaggtagtggctggggagacccgcggggcggcggggggatgctcgccaagctgttgtgggagtctccgagaggccgcagatttcccgggatccacgcaaacaccgttgtcaggacaccttatctgctctcggtatcaccacctggacatggcagtgcctgcccgggagtgagcgcgcggcggggaattctttgcttcaatagtgaagcaaactctttttcctgttctagaagcgggttttagcaatcgttcagcttgtgggggcttcctgcattttcttaaggtgtaaggaagttgagagccttttagtattccagagaggttaaactttttttagtttccctcagaagcgagcaaaagttcctttactgtaaggtcacttggaaaggtcaatagaaagcggctgttaaacatgatgttattctcagtgaaactgtatgcatccaagagaaggaactaactttaatgtttcacactgaagaaattgtgtgagagatacaagtacctttgtgactattgatttttaaagaacttttattgagaattcactgaacttattttaaattctctatgcaaagcttttctcactagggtagtttcattattctacatctggcaggcacgactttcaatgaatcagaaaggaaataaagttaactatgccttgcgcctggtagatgagaaagcagcctctcaagtcaccctttttcatagcgttttctctcttgggatgatttgtgctaattcctcatttgcttaaactgatgtgtgcacctttgtgctttctgtcttctgcactcccggtaattggtcttaccgttgagcaccaggccacatttttgtagataaaggctttcagccgttttattggagtctctagagctaccttccgtaattaaattgttcagtcgcctcattattattcaaattccatttgttagctcctcccagattcttagaagactccggagagatgcagaatagggatgtatttgcaaggtatttgaaatggtggacacagtagggtgtgtgtgggattctcttttttaaaaaagaaaaaaagtgggggggcggaggggccatatccaggagggaaagccctgtaatttgatactgtcctgaggcctggagggtccagaaaaagtactggacccctcgtttattctgcagttctttaagtgggcacttttaaaatttgatttggggacttgaaattgaagtgaaattaaagccctgcttgagggatgggattcccggaacaaagggcttccccagagcccagacttggaggctccttagctgttaacgtaaaggcaaacttgcctgtaactgatttttggtgactcgcataataaaatccttctgaatgggcttttgggatcagcttgggatcttgctataaaaggattaaatatatttatattgtgagaagagcaacatgtttgctcggcaaacgttgcttaagcctggtctctgtccacctgggcctgcagtggataggtggtctgcttctcagacttcctccgttatattttggcctctgttctttccagatttccctggctttgacttttgggtttaggccttgatgcagaatcccttgtcaggacatttgctctctagtgtcagataggctcctcagtcagcaattccagcgaggactgctcctgatggctgtcaggccagctgatatggtctggggagtggggattgggaggaggaggttgggagttgtgacttcccttcctgtgcccttcaaaaggctgattcacgtgttgcattataatcttgttttatttttggtaaaatttacatttacctactctcaaacttaagaaatagaatgtagggaaaaaaaggagttattctgagaaaagatgtactttgaaccactagcaaagcatttctctaatgaacccccactcccctttccccttcctaatagcttggtttagtgcctgcacttagtggagacgtgggactttttccactaagttcagaaatctaccctggtgggtgggaggctgagggtgggatgtgggaccaactagtattgccagttaagttgcaaagcaatttatcaggagctgtgcaagagaagtggactaaaggtggatatgtaatgcaattttcatttccctcagtctgtaggacttataaaggaacctctggtcttatttttaaaccgagtatgccttgtaaattttaccacattgtactgagtttgaaaacatagggcaactaaggtgagacttaaattgcacttctctggcttccactccatattttattcatgaatagcaaaagtgttctcaggcacattagttctgttagggcagatttgggcacctctcaaccttcctttcatggtagttaattgcaggtaaggtgagtctcaccttcaatccccacactccagataaaactaccagagaggagggaatggttaggccgttaaaaacaattgcaccaaaaataatgattatttttagattcatggactttaaatcttttgataaattactgtgctttaaaaactgtaataacagggaaagcaattacaagatcatatttaatcagaaagtaaaattgttttccccccaaaacccctcccattttttaggagaaacttggctaacgtaagctgctcacccacagtccagtgaagttcggtctttgccttcatagcagcctgtgcgcacccttagggtctgaggaagtgactgtgtaggtggtttctggaggcatgaaagatccagggtcttccttcctgaaggatgtagatggggtgaatccagcaattcatatgtattaatcattagttcattaatgttagccttttgtggggaagggactgggtctctctatattgcctaggctggtctcggacttgtgggctcaagcaatcttcctgcttcagcctcccaagtagctaggattataggcatgcatgactgtgcatggctttttcctaaaataattttaaaaatattagggaattcaccttttcattgttccttggaagtaagtagagataacagttatactgatactgaaatcatggctcagagataccagggggcttttctactgccctatcatgagctagaaatgagcgaagtatttagaagaggatcaagtatatggaaatgtaagccccttttcttgtaattctgccttatccaaaaagagctggcttgactacagccctggacacagcttatctcttagatttccttctggccctggaaatacagaagagttggaacagatgaaactacataataggttaaaatgatgtgcccaaagttaaactttaggtaaatacttgttcgaatgcctgtatttagagagtatctttctatatcagatgttttataaacctgtgtcagtgattcagggcatcagagagtactgactctctacttttattagcgatctcttccattttaatactagatagagggtagtctaatggaaacgggaggcacaaacagcaagttctggataagagccgatgactttgggtttgagagatcatcttttgtctttcaaagataactgagtctgccccaagttcaccccctgtgttattcaatcctcccccagcccatagtaaatgctggtgacaatcaatttcacttttagcacagacacttcgttcctgctcatttttcttctttctttccttcttttgagatggagcctcactctgttgcccaggctggagtgcagtggcatgatctcggctcactgcaacctccaccttctgggttcaggtgattctcctgcctcagcctccccaataggtgggattgattacaggtgcccaccacaatgcccagctaatttttgtatttttagtagagatgaggtttcaccatgttgaccaggctggtcttaaactcctgacctcaagtgatccacctgccttggcctcccaaagtactgggattacaggcatgagccaccgcgcccggcctcttccttctttcttctctacctcctttattcttttggtatccttttattttttaaaaaaatattttttgttctccctcctgtgccagagccttagagttctcttgtgatggcctttcctggttctgctgtgacactgcagacaaaaagtttcttcactcctgggctacagggtccagggtgcttgctggtcgaccttctcctcttgtggtcctctgagaaagacttcggctccatttctcagtgtataaaatagaggactgcgtaaagccaaccttagtgcactctcaaagtgattgttaaaaagtttgtaagaatacctttccctttttgcaggcacattggtaaatcagaacatttttaccaatgtaaaacgggaaaagttcgcttgtcccccttgcagggtgtgtgatgggggtttggctagattcttaagtgctctgctgctcaaacctctaggggagcacacagacaggcaagctgtggggctctgatcccacgacagtgtctaggggtggatgtttacagctcctgaagccccagtgggcatgtgttacagggtgctcttttagttttgccatctatgggcttgtgttaaccagctcagttagaccctctaccttgttgcaaggaccgagtgctttctgtatcctgggttcttgccttggtgtaccggaagaatcggatcacacctgggcttggagaatgagtgcaagattttattgaatagaagtagctctcagcagataggggagccagaagggagacggtttttccctggagtcaggcagctgttttctgaccactccggccaaactggtgtgctcccaacgtcctctcgacgtctaactgcttgaatcttcttccaccaatccactcctctcgatgtccagccgcttgtgtgttcctccactgatgtgctcctctcgacgtccagctgcttctgtgtctgccttgcttgggtcttgggtttctgtaggcacaggatggggatgtggcaggccacggtggtcttgcaacatttgggccggaaatgcctgacctcacctaggcctgtgggggtgcagccctagccagggaccatgcccttctctctgcctggcacttcccttctcccttccataccgtttaaagggaccacacccttcccttcccagcactccccttatcattaggactgctactgaatacatatgttaaggaaatattcatatgtggtatttatcatgttttttagttatttgccagtgtgacttgagaggatttcataaagatttagttttcacgctaaataaaagaatcaccttcaaaaatctttatgcctttgaaaaatatgtgttctgtttgcatttaattttccttactaagtagttaatcaaatggacagtgaatcttcgtgatttttgcatagcttttgttagtagtagtattagtcatatgattcattcccacttgggttggaatttcttattgaactcctgggtcttgaatgtataagtagttccattgatcaacgtaagcttcagaaatttaaaggagccacagagaaagctgcaaatagaaacacaccaggggcctcttcctaaaaccataagcacatagacgcttaagcgtttgttgattccacagaatactaatagcgaagaaattctaattttcccttaaggttgagtgagcctcttactatagtcacattccactgaagaccctctcgttgcctaggcttggggtgggaaaaaagaaggggagtgtgtttgtgtgcctgcgtgtgtcctgtgcgtgtgtccttgtgtgcctgtgtgtgtgtccgtgtgtatgcgtgtatgctgatagaggaggaaatgaaggctcatgggcaaggggacatgtatggggtcacatagctagtaaatggagagttgggacttgaatcctagtctgacactaacctagtactttttcaaccattccatttgccatcacttcgccactatgttatctcttttttttttttttttttttttgagacggagtcttgctctgtcacccaggctggagtgcagtggtgcgatctcggctcactgcaagctccgcctcccaggttcacgccattctcctgcctcagcctccccagcagctgggactacaggcgcacgctgccacacctggctgatttttttgtattttttttagtagagacgggttttcaccgtgttagccaggatgatctcgatctcctgacctcgtgatccgcccaccttggcctcccaaagtgctgggattacaggtgtgagccaccgtgcctggccactatgttatcttaattcttgcattaaatagtttattttcctgttttgagcctattcaaagatgctacctctcagagaactctccttaattataatacttctcaatagaatttctgaagtgcatttcatatgatatctcattcttcctgtagagatccttgagcttaggatggcagggccaaccttaagagctgtgtaaggaggtgaacattggctttcaattcccattttcctgatttctggtttcttctttgttgtaagcattcctaaccctcagatcagtcaggcagggtccccaggcagccctgttgtactcgaggcactaatccatctttttctcccttctttttttactaaggcctgttggtttttgacagggctctgctggttactggataattccggattaagtgattagccttcaggtgttaaagactgataatggctcaatttgatgacccctccccatagtgctgttccttgggtgattgaatttcctggggtctacagcagtccagttcgaaggctgagatctctggaaaatctgggtattgatagcaccaagtggaggagaggtgaggtctatttggtgtccctgaccacagtaaataaacttcacctaggcataaagctgatcctcttgatacccagttccaagtgctgatctgggccaaagtcagacatgaattttctttttaaagcttcagttaatttagcctcaaattctgctcagtcactttcatgtaatcatcccaacaaacatctattgagtgtttgttgtgggtaagcactgaggcctcagtttgttttaacaacaattttaattttgttaagctacaaactgcaaaatcgtgtgtttgtatttttctatactttgtgttacacaggccattgggcccaaattttagactaataggaaaaagccccctttggaatataatattaaaattttacagaaaggcagaagttgcttaccaatacctaatatcccttcaaatgacaaccgttttttattcttcaagcacgtgtgtaataacccatatgggaaaaatggcaaaaggccacattgatgtcttctaaatatagagaataaagatttaaatcaagaagttgccaggctcagtggctaatgcctgtaatcccaacactttgggatgccaaggtgggaggattgcttgagcccaggtgttcaagaccagcctggacaacatggcgagaccctgcttctaaccaccatcccccaacaaaaaaaatgaaaaaattagctaggtgtggtggaggtggtgtgtgcctgtagtcctcgctacttgggaggctgaggcagaaggatcacttgagcccaggagtttgaggctgcagtgagctatgattgagccactcactgagctccagcctgagagacagagtgagaccctctctctcaaaaaaaaaaaaaaaaaaagaaaaagaaaaccaatcaggaagtctattatcatccatggccatatgtatatatatatccccagataaagaacactttgttgccttatagtattccacagacataaaggttctcaatgcctagatgttccctaagtacctttgaattggtactttacaccttgacagttttttgtttttttttttgacagagtcttgctctgtcgcccaggctggggtgcagtggcgcgatctctgctcactgcaagctccgcctcctgggttcacgccattctcctgcttcagcctcctgagtagctgggactacaggcgcccgccaccatgcccagctaattttttgtatttttagtagacacggggtttcaccgtgttagccaggatggtctcgattgatctcctgacctcgtgatccacccgcctcagcctcccaaagtgctgagattacaggcgtgagccaccgcgcccggccgacagtttttaaaaatgtcattgtggtaaaaacacctaacatgagatctgtcttaatatgtttttaagcatataatatgctattgtaggtacactgttgtatatcagatccctagagcttactcagcctgcttgactgaaacatcatggccattgatgagtatctgcatgggaggtgtcattgacatttgtaaaggatgagtgttaccaccttgagagatgacactgtgtgctatgtaggtggtcagtaaatggcaaccacaggttgatgagaggttggagtgggttggtttgagctgtttcgctgtggccaaggctaaaactcctcaaacatgccctcactttcacccaacgaggtcagggggaaaaggaccatcaggcatgggctagctcagcagccttcattccctgcttcaagcctgtcacatttttacctcccttctgaggccctgagtcctttcccaatgtgagctgcagaccagcaagcccctcagactcaacaagttcaaatatttgttcagctgcttggtggctagctgcctagctagggttaggaagcccctaaccttcttggtggctgggctgccaggtcaggaacccagggcttctgtctcccttgtccctcatgcctaatgtgacacagatttgcactcacaagtcctgtttccacagcctgtgccttagttctttgtcatttgtgttctagaacaacctcctaattccatactgggacccgcaagggagtctgtttctggagtgaacttaatgaaatgtaaatcatattaatctccccttaaaatccttagtgatttccaggccgggctcagtggctcatgcctgtaatcccagcactttgggaggccgaggctggcggatcatgaggtcaggagttcaagaccagcctggccaacatggtgaagcctcgtctctactaaaaatacaaaaattaaccaggtgtgctggtgcgtgcctgtaatcccagctactcgggaggctgaggcaggagaactgattgaacctgggaggcggaggttgcagtgagctgagattgcaccactacactctagcctgggtgacacagctggactccatcccccaccaaaaaaaaaaaaaaaaaaaaaatccttaggatttcctcagtgctttcagggtaaaatccaaacttcccagtatcaccctcctgagctagcctgtcacctctccatcaactaatttcttcaaagatatgtattgaactcatgccatgtgctaccttgtattttgcctgtgcatatgtgagagagacaaacaaaaaacaagtaaacaaacaggaagacagacatactaaagatggactattaatagtaataaggactattaaaaaggcccagggttatggcccaggaagtgatagtgcctgatttagcagtgggggtgacattgcagctgggctgagctgaagaaggaggtcttctagatggagggaagagcaaagtgagatcctgagctgaggaaccttctggaaggccagtgttgctggaggagagggaacaagtggagaagatgaaacaggcatgggtgagggggaaaagaaggcatttggattttattctaaatgctgtggggggccgggcgaggtggttcacgcatgttatcccagcactttgggaggctgaggcagatggatcacccaaggtcaggagttcaagaccagcctggtcaacatggcgaaaccctgtctactaaaaatataaaaattagctgagtgtggtgtcaggcgcccgtaatcctagctactcaggagactgaggtaggagaatcgctcgaacctgggaggaagaggttgcagtgagctaagattgcgccacagcactctagcctgggcaatagagcaagactctgtctcaaaaaaaaaaaaatatattgtggggaagcccctggacagagtgttgcctcatcttgccttcaaactgcattccctaacctccagtttcctgaacttgcaaatctcttcctggaacaacctttccctcattcatctgttccatgcctcctctcctttaagactcagatattactcctccagggagcctctctcagtgcctagaacacctagctggccgtgcatggtaattgccagtttgtcatgtctgtattcccctctgattgctgggggatgaatcgtttttctttgtgtctgcagccctgcctcacacttggccagtgttcagggaaccttcctgaaattagaacaaactgcctgcttgaacatttcatctcactacagcaactttctgggtaggttgaaggggagccctcctgtagcggatttttgaagacttgtcccccgattgctccttttaggggggctgtcatccttcattctcttttgcctacctagaagcctgaggcagagggtaatgcctagggaggtgttggtggagaaagcccagccttctgcaggaggctgagaggctgaagtgcctcccttcctggcataagctcactgcctctaccatgcctattgtagagtgagaccctttggggaactcagagctgtactctaggggacttttttttttttttagtgcctgtccttgaaccctggatcctcagattaacgctttacctgggctaagctacccaggctctatgaggttcttaagtggaggtacttgaggagagggtgagaggagattagagggaagatttttgtcagcagtccatttccgatatataagaaacctttcctgatgtaaagccatggcctactacattttttaccctggcccacagtaaaaaacatttatactctgagcgagtacccacatacatgcaaataaacccagggaaatttcaccaagccgtaattttactcttgtgctgtaccatgtgctccgatattttctagttttttgtttttaaatctctttattgttatttaatgctgttgctgtttaatccccacaagttgattttatgaagactaatgtgttctgacttaaggatttgaagagcaactggaatgaagccattttgtagaacacctcaaggagaaggtcccctgtaaattttaattcatgagataagcaaattagactacagtttagtattaaatgttacaaacagagctgattggtggtgaaggttctgggtgagcactccaccaataccagtcatatgaccttgggcagtttacttccccgagattcctcaggggtagaacagacttatgctccctcactgggccggtgaagtttgtagaaatgtcccacccagaccgggaatggtgggtcatgcctgtaatcccagcactttgggaggctgaagtgggaggatcacttgagcgtaggagtttcagaccagcctgggcaacatagggagacctcgtctctacaaaaaaaaaaaaaaaaatagctgggcatggtggtacaaagtgcagtggcataatcacagctcactgcagccttaacttctgggctcaggtgatcctcctatctcagcctcctgagtagctgggactataggcacgagccactacaacttgctaattaaaaaaaatatatatttttagtagagagagggttttgccatgttgcccaggctgatcttgaactcctgggctcaagcaatttgccctccttggcctctcaaagtgctgggattataggcatgagccattgtacccagcctgcacagcgtatttccatacaccctagctgaatgtaataaaatgcatctattcggaactagggagtccctgcaaagttgatggtgttcttgctgatccaggccaccctttctcagctgtttaatggttggtggcccatgattgaatttggcaggcagggaaaaggaaatacttcagctgtatgtgttgttgcagctgtatgtgtatttagttcccagcatttctgtgtatgtaaacatgcatacatactccctccccccttcacagtggtgtctgtcacctcgccaccctcccaggaggaggagattcaacttctacaggtcatcagcgtggatgatcataccacatagagacttacagaccctgctggagaaacattaaaatctacgcccatatctagcagtataaattgggaagaaaggcatttataaacacatgaatatttttgcacttgtacataatttaacgaggagttttgcttgcattaattgggggcagtgttgcacagcagaaatagaatgcatagaccatgagtgggccagccctccgtttgaatgttacttgacctttctaagcctgtaaactttaaatcatgagatatgcaaattagagtatagtatttaatgtgacagacagctgattggtggtaaaggctctgattggtagtgaaggctctaggtggtgaaggctgtaggtgagcactccaccaaaaccagaatttcttcacctgtgaaatggggataataatatctattcttgaaggagcatgaatgggatgaagcatgtagagtgcctaaagtagtgcctggcacattgtaggcaccttcatacatgatagccatgagttctcattgcatgcatattttcctgttccatgtaaggcattgtgcctttgcttacatttggacttccctcttctggaggagctcctgcctgctccttctctcaaccccatccaaattctgcagtactttaaatctgcattcataatctgtgtgatccactgggtctctcccctggcccacaagcatttccctccactttgcattgtttaaacacttgctgtttgggatgtgatagcagagcaactataactgttagggtttccgttcttatctttaaggttacatttttttatgacagctgtaactgtcaattacaacaattaattgacataacacatatttgatacgttttcacatatatatgcacctgtgaaaccatcagcacagtcaagataaagaacatatccatcacttccaaacgttttcccatacttcttcctccctctgacctttccttactgcctactgcctcttccatttctttttttctttttttttttgagatggagttttgctcttgtcactcaggctggagcgcagtgacgcaatcttggctcactaacttccacctcctgggttcaagtgattctcttgcctcagcctcccaagtagctgcaattacaggtgcccaccaccatgccaagctaatttttgtatatttagtagagacagggtttcgccatgttggccaggctagtcttgaactcctgacctcaggtgatccacccaccttggcctcccacagtgctgggattacaggtatgagccactgtgcccagccctgcctctttcatttcttaggtaaccactgatacgctatttgccactgtagattagattagtttacattttttaaaaaaattttatgaaaaaggagtaatggcttctttcattaggcataattagagattcatccaggttatgtgtatcaatagtttatttttttattgctgagatgcatcacaatttgtgtatctagtcaactgctagtggacttttgggttgtttacaggttttttttgtttttttttgttttttttttgagacggagtctcgctctgttgcccaggctggagtgcagtggcgcgatctcggctcactgcaagctccgcctcccgggttcacgccattctcctgcctcagcctcccgagtagctggactacaggtgtttacagtttttgactattacaaataaagttgttatgatcctttatgtacacgttattatatggacaaaaactttcatttctcttaggtaaaaactcagcagtggaatggaagggatagtatgacaggtgtgtatgttcaacttcttaagaaaccaccaaactgttttccaaaatagtatcattttacatttctaccagcagtgtatgagagttctagtacctccacatccttgccaacacttgttactctgattcttcctaattttagctgtcttagtgggtatgtaatagtatctcattatagttttgatttacattttataatgattaatgatgtattgagtatcttttcctgtgcttttttaccttccataaatcttcttgggcaagttgtctcttcaaatcttttgcttgtttcacttttaaaattgggtcagccgggtgtggtggctcatgcctgtaatcccagcaattcgggaggccgaggtgggtggatcacttgaagtcaggagttcgagaccagcctggccgacatggtgaaaccccatctctactaaaaatacaaaattagccgaacatggtggtgcacacctgtaatcccatccactcaggaggctgaggcaggagaatcacttgaacccaggaggtggaggttgcagtgagccaagatcatgccactgaacactccagcctgtgtgacagagcaagactctgtctcaaaaaaaaaaaaaaaaaaaaaaaaaaaaattgggtcattggttgggtgcagcagctcatgcctgtaatcccagcactttgggaggctgaggtgggtggattgcttgagcccaggagttcaagaccagcctgggcaacatggcgaaaccccatctctacaaaaaattagctcagcatgatggggcgcgcctgtagtcccagctcctctggaggctgagtccaggaggatcacttgagcctgagaggtggaggttgcagtgagctctgattgcgccactgcactccagcctgggcaacagagcaagactctcagtaaataaataaataaataaataaaataaaattgagtcatttcttattaataagttttgagagttcttcatatattctgcatacaagtcccttcccagatacattatttgcagatactttcttctagtctgtgtcttgtctttattacttaacaatgtcatttgatgtttttcttttactttattattttttttgagagttgctgctgtcttttaagtcccaacaaattcttcatttttgtatttgttgtgcttttctttctaaattttattattgttattttagttttcatgggtattgaagttttattttaataaaatccagtttaccaatttttgggggagggtgtcatatctaagaaatttttgcctaacgcaaagtcataaatattttaccctagaagtttcatagttttagatcttacagttagaccaagaccaattttgagttgatgtgagttgaattttttttttttttggcatatggatgtccagttggtccatcagtcatttggtgaaaatgactgtcctttcttcttggaggtggctttacctcttggtgaaaaatcatttgtctatgtaagtgtgggtttatttccctgtctgttccagtgatctgtttgtctatttgtctgtctttacaccaacactcacagtttggactggatttctaagtttctctgagatgggaaccatgttttacatattttttgtctaaccaacatttaccaagcaactactttgggcccattaacccacatatttattgtatgcataaaacagaaaccctaagagcacaactgaaagagaaaatgtggagttgaaatcacaatttaaggagtatttaatattttgaaacatttgtgtttggcaaataaagtgaaagggaatatcaaaggttttcagtgaacttgtgcatctttggaattaaacataaaacagcatgtcagttgtctctttttactttgtaaattttgttttatcttatttacttattttcattgacagattatagttctatcgatttaagttgttatttcttttcccttctttctttgttttagagttggggtcttgctattacccaggctgttctcaaacccctgggctcaagcagtccttctgcctcagcctcccaagtagctgggaccacaggcatgtccaacaaattgttgtttctttctttttgagacaggttcttaactctgttgcccaggctggagtgcagtggcacaatcatggctcactgcagcctcaatctcttgagctcaagggatcctcccacctcagccttccaagtagctgtgactacaggtgcttaccaccaggtccggctaatttttaaattttttttgtagagatgaggtctctttatgttgaccaggctggtctcaaactcttgggctcaagtgatcctcccacctcaacctcccaaagtgctgagattacaggtgtgcaccaccaggcctggccaccttcccatttcagtgtccctcatgactccctagacattaaaaattgtttttctttccttttcaaagccaattttaattatatatgtatgtgaatatatttcatttttaaaattaaaaccaaattccttttcatgatcctcctaaattctccttctacctacactttgccatttgctgtgtatccttctggaccgttttaaaatgcatttttgtacatatttatattttcatttatatttgaaatggttatccttaaattaaaaaaaatacttaactatgcttttctagcagcaaccgtagcattctttgacttacctctcttttaccattcattgttttccattgctgattacattgtactcattttgggtgtatttttctttcaggagttacatccttgagtaattatttcaaagggattaagtgggaaataaacttcctaagtccttgaatatctgaaaatatctttatttcactctcagatttgaaaaataatatgattggtatattaatgagttcacagattttttttccttttgtctttttaagatctgttctgttgtcttctcatatctgtgttgttgataagcatctgatgcctttctagttctttcataggtaattgtttccccctctaaggattttattgttatccttgatttaaaaaattttttttcacttctctttttgttcctatagatatccttgatattttgaagttacactatgatttttttttttaggtgtgggcttgtttttaagtttctccattttattttgtgagtctgttcattttgagttttatcttttgttaatttaggaaaggcttctctattatttagttaaatgttgcttcctccccatattctgcattctctccttttggaacttctttagtaaaataatggttcttctgaatcttattcctgatgccactttaactttgatttcatactttccagtgctctattcttttgtactgcatcttgagagactttgactagccagtccactatttccatcttcatctgtgtttattctgctttttaatccatacattcatacatttttattgccaagatctatatacccctttttcataactgctcttcctctgaaactgtctgttcttgtttcatgaatgccatattttcttacatctctgagtctctgaagtatatttagcttgacagtttgctgtgattctgttattaactctgcttcttcaggtgtacattcttacatttgttgagtctatgttgtcttccataatcttggcattactcgaatatttgatgttcaaggaaatgttggagggaagatggtactgtatccacctctgatagtgctcttctccacacattgtagtgagagttaggagaggtgagaggactttgagggcagtagtggggatgcttccttgtccttctgggcatcactagcactgggggcactgccttccttctcatgcccaacctcctccatttactgctttcacctagaagatatcctagtgtgtgtagggtaagtttgggtgagtgggccatggtgcacagagtttatctgcttggctgttttcactgttattctccaaataatgactctgttgcttgtcttcatattccttcctgttgtgggattccaccagttctacactctacagcagaactctgccattcatagtcaaggactgcagattccctcttcaatctcatctttgtgtttcttaaggatttcctggttgtcaattttgagttctcctttttgtttcaaacttaactatccatgtttcattgtgcacctatttgtttattatgcacaacatttctattatttttagggagttagcatgggaagggaagatgaacatgttatctgtctgatatttttaaacttgaagtcctgtttcattttcagttcatgccctgctcttgctaagattgacttgtaatggcagtactgtgactgggtagcatgtaatcactgatgaagaagaaagctggttagattttgggccatttgcttccacattactgcctatactgtatgtcatcagcaatgtgttgaactggattcagttgaactggaaaagtatgggtggataaggtggggctgaggagttgcttatagtggagtaatatctatgcacatctgtacctgcttaatttttctttattcagtcattgtcttatctgaaatatgtatgtttgcctacacctattgcaaattcaaacatcaaagtattatatatagtaaatgaaatttactaagatattatcaagtattaacaagtgttttagacaattgtagagttttgggggaaaattgttggttacaatagggaaataaaacgttacttttcagtctgtattggattaggttagaccagagaaaaagacatgatgaggtatagttaagaaggaaataagaaatttaggaaaataatttaatgtatatacatctctatattttatattcttttttttttttttcgagacagggttttgcactgttgtccaggctggagtgcagtagtgcaatcaaagctcacggcagccttgaactcctgggcttaagggatcctcccactttagcctcccaaatggctgggatgacagctgcatgccaccatgcccagccaattaaaaagaatttttttttgtagagacaaaggtctctctatgctgcccagactggtctcaaactcctggcctcaggtgatcctcccacctcagccttccaaagtgctggcattataggcatgagccactgtgcccagctccttttcttttcttaagacgttggttccttttcttgatccttctttgagtttcatactgggttttttatttttgtgtatttactcatgaaaccttttaaaaaaattgagatatactttatataccatagtatttgctcttttaaagtacagagctcaatggattttagtatattcacaaaggtgtgcaattatcaccactgtttaattccagggattttttttttttttttttttgagatagggtctcactttgtcacccaggctagagtgcagtggtatgacctcagctcactgcagcctcaacctcctgggctcaagggatccttctgcctcagctcttagagtagctgggactacaggtgcgtgccaccacacctggctaatttttagcatttttttttgtagagatggggttttgacatgttgcccaggctggtctcaaactcctgagctcaagcagtccacctgccttggcctcccaaagtgctatgattacaggtgtgagccaccatgcctggcaaattccagaacatttttatcactccaaagaaactacataccagttaacagtcgctctctattttcccttctctctagccactggcaaccactaactactttttgtctctatggatctgtccattctgaacatttcatgtaaatagaatcatacaatagataacattttgtgtctgttctttcacttagcattattattttcagtgttcatccatattgtagcatgaattggtactttattccttttttatggctgaataatattccattgtattttttttttttttgagacagggtctcactctgtcacccaaactgtagtgcagtggcatgattgtggctcactgcagcctcgagccactgggctcaagggatccttccaccttggtctcctgagtagctggaattacagatgcatgctgccatactcagctaatttttaaagtttttgtagagatggggtcttactatgttgcccaggctgatcttgaactcctggcctcaagcaaccctcctgcctcagcctcccaaagtactgggattatagacatgagccaccattcctagcctgtattccattgtaccgcattcttttcatccattcatgagttgatgggtgttgggcagtttctacttttgggctattgtgaataatgctgctgtgaacattcgtgtagaagtttttgcctggatatatgatttcaattttttttggtatatttggaggagtggaattactaggtcatatggtgactgtatgtttaatctttttttaagacagagtgtcactctgttgcccaggctggagtgcaggggcgccatctcagttcactgcaactgctgcctcccaggttcaagtgattctcttgcctcagcctcccaagtagctgggattacaggtgcctgccaccatgtctggctaatttttgtatttttagtagagatggggtttcaccatgttggccaggctggtctcaaactcctgacctcaagtgatctgcctgccttgacctctcaaagtgctgagattacaggtgtgagccaccatgcccagcctatgtttgaggaactgccaaactgtttttcaaagtgcaacattttgtattcccaccagtggcatatgaaggttccagtttctctacatcttcactaacacatgttattatctgtcattttgattatagccatcctagtaggtgtgaagtgggatctcaatgtggtttttacttgtacttctctgatggctaatgacatggagcaccttttcatatgtgtattggcctttagtgtctctttggagaaatgtctattcgcatcctttgctcattttttattgggttgtcatttattgttgaattataagcattctttatatattcgggatactagactcttatcacatgtatgatttgcaaatgttttctcccattctgtatgttgtctttttacttttaaaatttttgatgaagtccagtttatctgtttttttttctgttgcttgtgcttttgctgtgatagctaagaaaccattgcctaatgcaaggttgccaagatttacacctatgttgccttcttaaataaaacattttgatttaagagttttatagttttagctcttcaacttagatgtttgatccatttgagttaatttttgtatatggtatgacataagggtctaacttcattcttttgcatgtggatatccagttggcccagcaccatttgctgaatgtcttagttttaataattgttttaggtccttgatctcatttattgtaacagccctatgagatgtttattttcattatcaagtccattttgtagattttgaaattgagtctcaaaagctaagtatctttttcaaggtctgatagtttaaaccccaagtcttgctgacttcacagccttaacactgaaccacggtctatacttcctttactcctgtgaaatatacacgctcttggtcaattaggaaggctgcttaccaattaagcggttttctaggactaaagaacattgtggaattaatactatatgtttcaagaacgaaggaaagagagagccctacagggttttgagctgttacaccaacttctttttttttttttttttttttgagacggagtctcacactgttgctcaggctggagtgcagtggcatgatctcggcccactgcaagctccgcctcccaggttcatgccattctcctgcctcagcctcctgagtagctgggactacaggtgcccgccaccacgcctggctaatttttttgtatttttagtagagatggagtttcaccgtgttagccagggtggtcttgatctgctgacctcgtgatccgcccgtctcggcctcccaaagtgctgggattacaggtgtgagccatgcgcccggcccaccaactcctacttttatccagtaatgcctaatccctctaggacccttagcaaaggattttaagattgaatttttgttaccaggaactggtgtagtgctggcctctagaactttctgtgaggataagaatgttctatgtcagggatccccaaaccccgggccacagacctgtaccagtctgtggcctgttaggaactgcgctgcatggcagaaggtgagcagtgggggagcaagcgaagtttcgtctgtatttacagccactccccattgctcgcattactgcctgagctctgcctcctgtcagatcagcagtggcattagattctcataggagtgcaaaccctgttgtgaactgcacatgtgagggatttaggttgcacgctccttatgagaatccagtgcctgatgatctgtcattgtctcccatcaaccccacatgggactgtctagttgcaggaaaacaagctcagggctcccattgattctacattatggtgacttgagaattatttcattatataggacaatgcaataataatagaaataaactgcctaataaatgtaaccagcttgaatcatcctgaaaccaccccaccatcccactggtccctggaaaaattgttttccacaaaactggtcccaggtgccaaaaaggttggggactgctgttctgtgtctgtgctgtccaatacgttagccacttgctggatgtggctattgagtacttgccacgatgaaactgaggaacccccaaatttttattgtgataaaatatatataacatcataacatttacagttttagccatttttggcggtgagggccacataacaatgtgactgttatgcgcccctcaccaccatccatctccagaatgttctcatattcccccagctgaaactacatacccattaaacatagaactccccattcgtcttttcccccaacccctgaaaacattctgtgtctatgaatttggcttctctagaaacatcataggaggaggatttgaatttctaattttaatcgattttaatttaaatagctgtatttggctagtagctaccttactggatgggggccctgagccagggtgggcctgagagatgtctgcctttcacaaactttgcatctgctgtgtaacacaatccaaacctgcgacatctagtccaaggcccattttccaggccttcgtggcttgggagagtactagccagaggagggtgactaagagaggcataactcacgtcaacaagcatctctttagtgatggcttctcagagaacaatatggctcctgaatgctcagacctggattctttccacagtctgctccaggaaataaatctctcttcacgctcctgagtccctgcttgtgatgtggcattatattggtgtctggcctccgggatggtgtaagaagtggcgagactctattgttgagtgttttgcacttagcaaaagctgtcccctttgcctggtgggaagtatagaccagcggttaagtgttaaggttgtgaagtcagcaagacttggggtttaagtggagggactgtagttagcactctttggaagagtggcatcatctgtgaatcataaatcacatttgaggtggaagtgaaactcctctaattaacctctgtgaaagcatctcaccttcattctcattttgtggtttctccagttctggacttcagtgaccccttcagcactgaagtgaagccgagaatcctgctcatgggcctgaggagaagcggcaagtcgtctattcagaaagttgtctttcacaaaatgtctcccaacgaaactctgttcttggagagcactaataagatatgccgggaagatgtttccaacagctcctttgtcaattttcagatttgggacttcccaggacagattgacttttttgaccctacatttgactatgagatgatcttccggggaacaggagcactgatatttgtcattgactcacaggtaaagctcagagtctcaggggtatgatggcctggccggtcccctccaccccaccccatgtttttggtttggtttttaaactctggaataggcctttctaccaaacaagtgtttcttggtcagggctctcagactttgccaaagttaaaaggctccagccgtgaccaacaatcaacccattgagcattagggaacaattgacacttcagcaaatcatagacctaggaaacctcactgatggaggggcccatttaggccaaatatgtcatccccactatggtaccgctagtcaacatctacaaaagatcacaggttctctgcaacaaaaacatgtgtataaatttacattttaaactgtttattatttcctatgaagataaagttctaggtgtgaaaatttttcttctgaaataaattattataattattgcttaagataatataattatgtattttatagatgattattacatataaaaagtaaaatttgagataaatatccctctttagaagatggatatttgatattttttccacttcatatatccatgcttgaataagacaatatttggcatcagttccatttttgttttctgtttatatagttataagcactgagaaactttattcacataagtaagtaggtggatatgaggtgagttttattctagcattcatactgctattcagattccttccaagttatatcccctaaattaccaagttttctatcatgaaaaattatttttagtagtttaacaacaggcttccagagtaggttctcctttcactttgttggacgcaaagaattgggaacctgtttcctatgctttgaagagccccattcccagtcgcgagtcattccctgtatcaggttcttttctagcattccacattggctccttggcaccctgggttttttacatcctgaggcttttctgctgtagttggtgtaaaggggaggcaaagggagacagtaggaccacaagtgtgtcaggcagatacattttaggaaggggatgtgcagcaggataggggcattggtgctttccaaactatccatgtctggggctcttagaaaatgcccatgacatatggcccagcctgaaggctccccaagggctcccttttgcagctggggggaaataaatggcatcagcccttctcagcatgcgctgaaccaactctgaggttcaggttgtgccctttccctggaactgtggacccacagtgagacaggttggccagctgcgggtgtgcatcgccccgctaagcacacctggcccttctaggagcaccagagctgttagggctgaagtgttacaaagactattcccgataatatcattctgagcccatgctcgagaaccatcctctgagtagactccccatgcctgagaggatcgtaagttcattcaggatctaggtgcctgtttaataataataacaaaattttcaactaagcctctcagttccaagtggctgcatttgtgtacgtgtatggctgtgggagcatggccaatggttagaagggttcttcctttcctttttggtaggggtgtggaggagggagacttcaaatccaatgcctgatctgtgatcagcagtttactctcttcccatgggcctacccagaaacacgtgttacctgcaccacgtccagggcctgctgtcagcagctgctttcctgactgtcccacttgtactgacctgttttctggcccatctgtggtcttggcagtatcccctgctttactgtctcaggtctgccagcaccataaattagggagcttagtgctcaaggggagtggatggggtgtgtgcacactgctgtagggaaggggaggctccagggatgtcatgctcatctctctcttctaagctccatttttctccctaagtcacgcagcagctgtttctgtagttgttgaactgggtagctgtagtagtcctacccatgggtgagtagatttccaaccagatgactcatcatttcaagacaatggattagtaagtacttacttaaataccacgttgtgcttacatagcaatttgcatttatgggaattcaaatttacagtgtaatctatttttaggtgtttctaatatggttataatgtggcgaaaataggtacatctgcctatttttaaattgaaggcagaccttcaatttaggttggtaaatgtgttttttattttaattttgtttcttgaagttttttttcttcctcagacgaggtctcactatgttgcccaggctggagtgcagtggctattcacaagtgtgattataacccgctacagcctcaaagtcctgggctcaagtgatcctactgtttcaacctcccaggtagctgggactacagatgcatgctactatccttggctcttctcttgggtgttttttgtggggcagagaaagatataggaatgtttgagaagttcattttttaaaggtatactttttttttttttttttttgagacggagtcttgctctgtcgcctaagctggagtccagtggcgccatcttggctcactgcaagtccacctcctgggttcacgccattttcctgcctcagcctcccgagtagctgggactgcaggcgcccgccaccacacccggctaattttttgatttttagtagagatggggtttcaccatgttagccaggatggtctcgatctcttgacctcatgatccatccatctcagcctcccaaagtgctgggattacaggcgtgagccaccacgcctggcctaaagttatactttttaaaaagagaaggctgggcacagtggctcatgtctataatccaaacactttgggaggccaaggctggaggaccacttaggcccaggagtttgaggctgcagtaagctatgattgtgccattgcactctaacctgggtgacagagcaagaccttatctcgaaaagagaaaaaaaccacacataaaaataaacagtaggaaaagcattgttgaatgctgtaatttatttaaaataaggaataattaaataagcagtttcaaaacctaatatacttttctgttggaagcagaatgtaaaaatcatgtttgcaggaacctttatgggatgtgattagaagcactgacaggaaaatcaaaactttagggaagtgtctccacagcacttgagtgtcctttcctttctttctttttttttttttttagatggagtctcactctgtcaccaggctggagtgcagtggtgcgatcttggctcactgcaatccccgccaactgggttcaagtgattctcctccctcagcctcctgagtagccaccacacccagctaagttttatatttttagtagagacaggatttcacaatgttggccaggatggtctcgatctcttgacctcgtgatccacccgcctcggcctcccaaagtgctgagattacagtcatgagccactacgcctggcccctttcctttatttctaagcaatactattttgttctcactcctcatatttttattttttgttcatgaattccttacagtcacaggattgccggataaatatatcccccaggagtaaatgtgtcctcacagaatgtcataaaataaaaaagaatgaaagcaagagtggttcccatgatctgtggtgacaccccagccccgctccccagcctacagaatgcaccatatctcctgaagccattgcacatgtgctatggatccaaaagagagtttcttcttgacctgtgctggtgcttgtgacctgcccataatccccagatctaatttcagagtagaaactatgcagtgtattttaccttaatttttatttgtcaaagaaagtaataaacgatgggaaaaatcacctgcaatccctctgttctaaccaaccaagtattttcttttttttagtccttgtagctgcatgctgctttttcagttagttggtaatcagaccattttatatgcttggcagggaggttagagtagcaatttccaatctttggagatgtgatgctctcttgacattgggtagttttgctcacagacatgttcccttaactcccctcctcagttaaagacagcaataacacttttcttgaggtgtaatttacatgcaataaaatgcattcattttaagtgtacagttcaacaggtttgaccaatgtgtacaccatgtaaccacccctccttcaagatatagaatatttccaccaccccaaaggttcccttgtgccctttctcaggtgatcccctgaaacactcagccccaggcaaccactgcagtgctgtcactttagtttgccttttctagaatttcatctatgtggaaccatacagtaatacctttagtttttaatgcttaatctgctgacccagaatccgacatttgcctttcatttaatttaatttttttttttattttttttgagatggagtcttgctctgttgcccaggctggagtgcagtggcacgatcttggctcactgcaacctccgcctcccaggtttaagcaattctcctgcctcagcctcctgagtagctgggattacaggcatgcgccaccctgcccagctaatttttgtatttttttagtagagacggggtttcaccatgttggtcaggctggtctcgaactcctgacctcgtgatctgcccgccttggcctcccaaagggctgggattacaggcgtgagccaccgcgcccggcctcattttatttaatttttacaggcaggctctcactctgttacctaggttggagtgcagtggcaagatcatagctcattgtaacctcaaattcctgagttcaaggaattctcctgcctcagcctccgagtagctgggactacaggtgtgcaccaccaagtctggttaattacatatatatatatatatatatatttctagagataggggtctcactgtgttgttcaggccggtcttgaactcaagcagtcctctccagtaggtgggattacaggcacaagccactgctcctggcttttgtcctttattctaaacaactctgtagagtgtgaaggatgggaaggactccatttgcggtttttccctcttcatagtttcctatttgtataattaatatttgatttgcctagagactagggatacatttttactgatgtttggagcatagaagaatgccagaaaacacccccaattatattggctttctgttttttccaggtttggaggcacaagtggcggggcagagggggaaggcatttagattctgtcctacaggtctctttcctttttttttttttgccataaaaacaagacctgttcacacccttcaaattggcaataagagatctgacaccaccaattgttggtgagggtctgaagcatcagatgctgtttacagacttccaggtacagtcaaggcactcctacctatgacctgacaagtcacccttcagagtaagccacatgtacatgagactgtacatatatcattgtaatcacatatacatgggaataatgtccatcagcaggcaaatataaattatagatcatccataaaaggaagttttatagagccattaaaaggaactaatgcactgtagttatgtactacagataacattcagcataggtgaatctcactgacatagtgttgaatgaaaaaggcaaactataatatacacacaacttaatatttctttccatttttaaacaatgtaaatgaattatatgtgatgtttggggatatatatgtctgtattaatgtatacatgagtgagaataaatactaaacttgggatagtggttgtctctagaggatgagggggtagagggatagcatgggttgggaggatgaggagaaacacagagggcttttgtgtaggtgttttatttcctaaatagagataaatacacaggtgttcattatataggcatgggaagaagaaaaaagttagtattgtttggggcaattcctctagaccaggggactttttctgtaaaggggcagatggcaaacatcttaagctttgtagactgtactgtctctgaggagtttctctagaggaaacttactcaactctgccattgtagcacaaaagcagccttagacaatatgaaagcaaatgagcatgttccaatacaacttacttttaagaaacaggcacagggcctgcagacggtggtctgctgacttctgcactgaaccagtggttcttaaaattgctcctcagctccttccccacccgcccagtggcctgtatcatgcctccatctctaattgttcatcacagttcacaagagactggaaaagttaggaggaacagtattctggggaaggtcttatgtggagtagggtccgtttctcttcctgaaaccgcaactctgatctttttttttttttttctttttgtgaccgagtcttactctgtcatccaggctggagtacagtggtgtgatctcagctcactgcaatctctgcctcctgggttcaagcaattctcctgcctcagcctcccgagtagctgggactacaggcgcatgccaccacgcctggctaattttttgtatttttagtagagaaggggtttcaccgtgttagccaggatggtctcaatctcctgacctcatgatccacctgcctgggcctcccaaagttctgggattacaggcttgagccaccacgcccagccaactctgatctttatgactgtcatcaacctcagtcataactgcctaaatcagctgcatttttttagcctttcttcttcctctctttgttaacagaacttaaattttcacactggaattataagaagccagcttgttgaggggaacctttgcaacgtatttcggggggttgcagccacatggtttccaggtgaagagtgtgtgtgggaggctcaggaagcaaagcggccttctctcacaggcgttgcctttggtcctaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcaggtgagaacagaaaccccttaaggatcccaataaaggatggaagaaagcaagtttggggttcggagtcaccatgattggcttggcatgggcagtaatttaccttctttttaccctgtttcatgctgtagatggataggattaggggaaaatgagctttgcatgtgctaatgctaatctttagtgaaagcgatgtttttttgttttttaacaaatggtcaaagctaaggttctcccctcacatgagaaacacattatagaaaacctatgaatataattttagtagttagttgatgctaaagtttacagttcttgataaagatattatctgtaattataagtaaaggagtagtctgaaaacaatccaaataggaatcctcacaaaggaaaacaatgtttccatcattttttgtgaggtagtacatgcatcattttgtaaattgggaaatggaaaaaaaatagttgcttcaatatcaagaatataagttactaattggacaacctaagaggcttgtgtaaagatgatctggcatggattgtcttgcagaatgtcaggaagctgggatggacacagattgctgcggttgtaagcttgccagttggcagatgagaataggcacagcagatgagaataggcacagctcgggctttttgggaggtggggaggaatggcttgttttttaccgaggtcactgtaaattctgaagggggctggactgtatgtgttaggactatacatacagaaggcagattaccggtgttttgacatagcctaagcagcctgttcctcattcaaagggaaaacatgatgaaataccgtttcctctttcagcttttatctgacaagcatatatgatcattcaatatttgaagcttttagcaaagttgttcagaaactgattccacaactcccaactctggagaatttgctgaacatctttatctcagtaagtaaataatattcctgtttgagtcacttgtagaatttgaaaataacattgcaagagtgaaaaagatcttatttccgattgcttctatagcatttcaaggtcatttaagtattacttttaaagattactcctacgtgttcttttagatcctttaaaatttaactcccagcccagcttgatggctcacgccccactttgggaggttgaggcgttacgatggcttgaggccaggaggttgggaccagtttaggtaacatagtgagatcctgtctatacaaaaaaaatgtaaaaactagccaggtgtggtagcacatgcctgtagtcccagctacttgggaggctgtggtggaaggagtacttacttgagcccaggagtttgaggctaaagtgagccatgattgtgccactgcactccagcctgggcatcagagcgagaacttgtctctaaaaataaaatataactactcagatgcattcctgcacttcactggtataattggagggtttattcaagcctgtaggcaatcattcaatattaatagagccccaccagaggtagggaacataaaacttggctttattgataagacgcaaactgttgaatagctttttataagtttaacatgctatgagtgatgtgctgaatgaaccctacacatcaccagctccaggtaggcgctgctgagttgaattgaggcagacctattggttatactcacgtttactctgtcactacacaattttgagtgtgtttgtttagtgtttctaagcttattttaaaatttacagtcagtaaaagtatttttacttggccttttcctaattgcaggtatgtatctctacgagttaggaaatattgctcaatttggttacctaaaataaataatttgtggtcattcgaattctttttttttttttgagacggagttttgctcttgttgcccaggctggagtgcaatggcgccatctcggctcaccgctacctccgcctcctgggttcaagcagttctccttcctcagcctcccgagtagctgggattacaggcatgcaccaccacgcctggctaattttgtatttttagtagagacaggtttctcccggttggtcaggctggtttcgaactcctggcctcaggtgatctgcccgccttggcctcccaaagtgctgggattacaggcgtgagccaccatgcccggcctctactttttatttcttatgcaagtccagtatagagaagtttatgacagtgaagtttaaattgtaataaaatgatacaatttaaatttttagtagcgagttttgctcattttgtattttacattaagaatggcattcaattttgtgtagtcatgacatggtctgaagttgactgttgctttaaggcaacttttttttttaaatttcagaattctggaattgaaaaggcatttctatttgatgtggtcagtaaaatttatattgcaactgatagtactccggtggatatgcaaacctatgagctctgctgtgatatgatagatgtggttattgacatctcttgtatttatgggtaagtacaacattcttaaaggccacaatcaagccatccttccttcataacctttcaggcattttgcatttacatttacttacttaactttaacatttttgtcttaaatgactgaaatctataaataaatataccagttagcatgcaataataacagttattgagcaaatgccacgcattatgctaatctcattgcatgcttcctattatttatttcaattttttagcaatagggtgtccctgtgttgtccaggatagatcactcctgggctcaaatgatcctctcacctcagcctctcgagtagctgggattataggcatgagccactgtgcccaggttatcatttaattctcaactattcgatgtggcaggaattacatttgacccttgaacaacacaggggttggggtaccaaccctttgaacagtcaaaaagccacatatatttcccccctgacaaacttaactattaatactaatagtctactgttgactggaagccttaccaataacatgaatgattgattaacacacattttgtatgttatgtattacgcactgtattcttaacaataaagtgagctacagagaagaaattataagaaagaatatatttactatttattaaatggaagtgggtcatcataaaggtctttaccctcattgtcttcacattgagtaggctgaggaggaggaagagaaggggttgattttgctgtcttaggagtggcagaagcggaagaaaatccatgtataagtggacctaggcagttcaaatctgtgttgtttaaggtcaactgtagtgtattcactttacagatgaaaaaactgaggttcagagtggttacatttcttactcttgctcacactatcagtaaggattggaactggagtttcaactcagatctgattcctgatcctctgctgaaaaaaatctgttaacataccgttcttagaaaacagagcttcctatacacttaatataaaataaacaaggagtgggggaaactgattatgttacccgatgtagaaacaattctacataattataaatgtgctgaacaggtggtgtacagactgactaggtgtgaactagttgttcatcttattaagatgttaaggtgttgctatctgtattgtatctgacatcctcatctaatcgatgaggtaaagcttttgctcatcttcctctttactcactgcctgtgacctgccttacacagcttgacgctctgcctttcagcttttgtgagagtctagtctccatttttctcttccattgcttaaaaatcctttgcccactcagctcggattctctctgttaactgttagacacacacacacacacacacacacacacacacacacaccacacacacatggaaagtgatacttacaagattgtattgaggatgaaatatcattaggctcataacgtgcctttacctggtagactctggataaatgtagctgccataatttattattactgttataattaaacgctgacatctggctttagaaataaaccttattgcccaagattactgccctgaagcattctattatttttaaaccgtttaaatggatgaccttgaaatagtcatggaagatgaacgcaccctgattacagtgcagattgccatggtaatcaagtacaatgaacaacacaattaatctggcacatgcttaacaatgtgcatgatcattattgtgccatatggtcattagctgtaagtggtaagttgttcatgtaaatgatgttaatcagagttacttttacccagctaaaacaaacatggggagggaggggttaggaggaggtggcctggctttgccgtcagattggtttttctgtggtggagtacagtgttctgagaacccacaggattcagtaagaaccagtctgggtcacagatggtttgtgggctctggggtttcctcagattgtttgctggagcagcaacaagccagtcctgttaaccagcaggaggcagggttgtgtgcagagcctggggccctcttaggcaatgaggaagcaggtgcccttgtaactggaggccttgctgcccctccccacctgcccagtggagaccagcaggccctagaatcaggtgacctggtgcctcaggaatctctcagctgaggctgtgccccagctggcagctctgtgctcactcatgcacacacatgcacacgcacatatatgcacacacacatgcacacactttaaaatatgttctatcttcatgtgttttcattgcttatagatgaaaaacttgagtagtaaaacagtttttgcagttgcaaacctcatcaatttctacttgtaatttttggtggagtctgtttttctaatttgtttaatgtttacctttttctgattgtgaaagtaatacatgcttattgcagaaaatacataaaagtctaaagaataaaattaaagtagcccataatctcaccacctagagacagtcagtgtttacattttatatagtttgttcttatttccatgtgtaatttttaggataatgagatcacatttgtatgtgaaatttttcatcctgcttttttcatttaacattaccacctgataattttcctgtattattaaatgctgttaataaacagtgtttaatatctatatagtattatatttacttggaaattttaaatgctattttcttcattgggtaaaacatgttaaatgtttcagtttcttgttctcagaacattacttataagcaagagagattgagccttaaaatatagtagttaaaacagtgcaatggaagttaatgaattctgttaaagcatctttaacatttgatgtccagcacttaaaaggtttttctttaatgttttggtaggttatagtgagttgaatcctttaaaaaaaacaaaaaatacgaacttccacaatttactttttttttttttgagatggagtttcgctcttgttgcccaggctggagtgcaatggcatgatctcggctcactgcaacccccgcctcccgggttcaagtgattctcctccctcagcctcccgagtagctgggattacaggcatgcactaccacgcctagctaattttgtatttttagtagagacggagtttctccatgttggtcaggctgttctcgaactcccaacctcaggcgatccacctcggcctcccaaagtgctgggattataggcctgagccaccgtgcccaccctcacaatttacttttaagtggccatgtatatggcagcttaaaatactctcaaaactaaaaacctacatttcctaaaaatactcttgtgcaattcaggcttttcattaaatctggcttgatactgtacccccttgtgtatttacaggattaaagcattaactttgaaattagccatatctaggtttgaggtcctgactttacccctatcgtcagctttgaccaagttatcttattttcccctagcctcagtttccttagaaacttagaggattcttatagcagacagaggataatgcattttaagaactaagaatggttaatatcacatagtaagctttaataaatgctagttctcagtgaatgtggtaaggtttaacacaattccaattaagtcaaatttctggtcagttattcataaatttggggagtaaaaataaatcagaaaatttatgtacagttttaggtaagggggaaaaggtttagggaagtgtcctttgcctgtgaggaaaggattcataacacttttattacacaggtatcttcagagggtccagtttcagtcattaaagccatgataataagtgtgtattttatgttctcagcattatgcttagtgctacatatgcattatttcatttaatcttcattagaaaactttgaaataattactgttagtgtacatatgaggaaattgaggctcaaagaagttattcgacttgtccaagctcacatagctagcaaataaaagaaatgagattcaaacccaagtcacttgtgtctgcacaccacaccttttcttaaatagacctatatatctttttttttttttttttttgagacggagtcctgctctgtcacccaggctagagtacagtggcacaatctcggctcacggcaacgtctgcctcctgggttcaagggattcttctgcctcagcctcccgagtagctgggactacaggtgtgcgccaccacgtggtgcctgtctaatttttgtatttttagtagagatggggtttcacccatattggccaggctggtcttgaactcatgacctcgtgatctacctgtctcccaagtgctaggattacaggcgtgagccactgcgcctggccaaatagacctatatatcttatttaactctttattttgaaaaaaagttaaaacctacagaaaatatacaagggtagtaaaatgaactcctgtataactcttcactgggattcatcagtttttaccaatttgccatatttgctgcatctctctttttctaatacatattgtgtatctatttcttttcagtgaaccatttgagagtaaattgaaccagttcacagttcagcaaatttagcatggctacattattatctaatatatagacgatattcagattttaccagtggtcccaattctatcttttatagcagtttttcccaattcaggatccagtctagcacttggctttcaggtctctttagactccttgaatttggaacatatcttcagcctttcttagtctttcatcagaccacgcttttgacagcctggctattctaggtgagaaaacaagaagcccttggccacggaggtggggagagctaacctcatccttcaactggcttcttcaggtgcctggagagtgtcccagctgctgcagacagccactcattgtcagtaggaaatgactgttgaggactgtgtatgtttttgtgcctgtgtgtttctgagctcttttgctgaaaggcactgcaagtgtaaacaacttatgattatcactttttgtggcttaaagccggtctcttgtcactggcttacagtttctagttctttctcaatggtcacatgttttggtttctgtccccatttagtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaaggtaactttttggtgtgatttaaaagaagcattaaaagaagcatcagactgctactgcatgtattgtttgttgaatgtgggtggacaacagcatagccctcgaaacttccagatgccagtcacaggccctcttggcttggagttcagagcggggcgggctcctgcccccagtgtcagcttctgggccagtgaactggcctgccctctagtggtgcatctgcgattgcagcgaggtggaagtggaaccccatgatcctcccaggggccttggcatctctgctagggggaagctagttggggcactgttgccaggctgtgaatgaagtctcttaccagggagcagactcccagcctatactgagggtggaggtctccactttgctccacacctctagaaggtcttaggtaaccgtgtgatcttttgttcttcccatgtaaaggaggggacaacaggtggtttgacttctgttcagcctcaaaatacttcttaaatcttcagaacacagggatggcatcatgattccggaaagggaagaccatgaatatatttaactccaccaaattttttttaggatcaaattcagttttattttgaaacaaaagcaattaaactaatttcccccttctataatatctaaacaaaagttactaacagaagtccctagcttactgatatggctagggacttttgttagtaatagggtatggtttactaatttgttgggtaaaagaaaatctccaacaaatagttacatatcctgaatatgttatagtaacatatcctgaaatagcctttttcttctatattataagcaatataagcccattaaattaaaaatgctttgaaaatttaggaaagtatgtagaataaaaccaggtatttcaccatctagagctaaacccatgttaaatttctgggattttctttctccctttctctctcttttttgagacaggatctcgctctgttacttaggctggagtgcagtggcacagtcatggctttctgcagctttgaccacccgggcccaagtgatcctcccacctcatcctcccatgtagctaggaccacagacacatgtcaacaacctggaatttttttttgtttttggtagagattggggtctcaccatgtttcctaggctggtctcaaactcctcggctcaagtgatcctcccacctcgacatcccaaagtgctgggattaaaggagtgagccaccacgtctggcccttctctcttatttcctctccctcctaccctcgctccttttctcccttccttcattcctttttttccttccttccaacaaaactggggccatattgtctaatatagttttatattctaatatagttttatatttaatacaaatatgaaaatatttatattttatattacatatatttcacttacgtatatcatgaaattttcctaattcattggccatgaaaacttaatttacattgtttatttttatcagaaaagtaatagattcttttagaaaatttagaaataatatttagcaaaaaaacaataattatcgatgtttctcattcagataactactcttaacatttcctgtatacttttccagtcctttcttgcatatgcattttctaaaaggactatgatagattgtatgatgaattctactttataaccttcacttaaattattacagacatgtttccaattcaccgtctttttttaaccacatcattttaatgattgtattagattcttctattttcagacatctatgttgtttctagattttaatgttataaataatatcattatgacctcttttgcactaaatatttatgtgcatctttggttgtttcctaaggaaaaatttaaagtggaattacttagatcaaaagggtaggcccattttgggggcttctaatgcatattaccaaaatgttcttcagaaagattttctggttttatgctgcgaagagaatatgaatacttattttgctgtgttcttatcaatattgggtattagtatttttaaaagttgttaactgaaaactggtatattatgtgaatttacattttcttgctgcttagtgatgtcctgtatttttcctgtgtgtaccatgactgaccaaattgccttttgtgtcctttggcctcagaactgtaaattaaatggtgttcatcttttactccttattttcatcttgctagaaacaagaacagattatataatagatcacggaattttaaagatagacaggaatacaccttgtttcaccctctcatgtcacagatgattttactcaggcctagaaaatataaatgactttctctcaacatcacaccaccactttatggcagtcagggctaaaggttgctggcctcaagtgatcctccctgctcagcctcccgaagtgctgtgctgtgcctggcctcctggtgtgcctggtgcctgggtgtttttattgtgcagctagggttgagaactcctgaaccagagaaggatgtggggccttatgaactgtaggtggggtgaagagagtgtttattttgtttatgtctctgttcatgtattttcaaaaacttttcatgagggttgaaatagcaaacactgtttatggatatttactgtctttaaaaagcctcagttgtgaacttttacttaaaattccaaacacagcaagattactgttacattttgaaatgtgcaaagatatgtaagttaaggtttgtcaagaacaataggggcgggtgccagtggttcatgcctatgatcccagcactttgggaggccaaagtggaaggattgcttgagcctagaggttcaagaccatcctgggcaacatagtgagacctcatctctaggaaaaattcaaaaatgaggtgggaggattgcttgagcccaggaggttgagactgcaatgagctgtgattgagccttgcactcccacctgggtgacagagtgagaccctgcctcagaaataagaacaggatatgtctgaaatttcccaagttgagtatttcattgtacccttctcattgagccaagttcttttagctaagctttttaagacagtttgttgcacataaaagcagagaatcttgaggctctcacatctcatattcaaattgccatttaaaaatcgttcctttgctcctttgtttttattacttttccccttgcttgtgacattggtctttccttgaggaaattgactcctggttttactgcactagtggttcactctctctgcagaagcagcagagggcactactcagaggttttcctgctcctggaaaccgagacggtgccctccccgccctccccttgcagttagttgtataactagtttgaagaatttaatccttggccggaatcctaattcttcctttggacgcggctctagaagcatccactgatagatagaaataattgttgggctagttattttaataaattcaaagatagtaaatagaactgaccaccttatcctaattggtgtaaacataatgttgctctcaggacttttacaaattactagtaatgatgaaaaatgcactcatcaagactttggattatcttttattctattttttgtgtcactgatacatttctgaaaacacaagaagattccctcctactatttctccacttaaaatacttaatactgaaaagctgagtgtcattggttgttgaatttctgctggagttggcgagatgactgttaacactctaaaattaggggcttcgctttccctcgggcttatgagaatggtttaaatataatagatactcagtaaatatttattgattgatacacagctttgggatcccaagtcaggatctgcctctactcagtctaataatgccctttggggagaaacatttttcattacagatttctcttaattgtaagaaatctttaattctgaaaggttaaaaaaaaagttcagttcagtcgttctttaaatcttttgggtcataggaacctttgaaaatatggtctatgctctgcaaccttgcatcaggaaaaatcttccttcacaagactttgcctataattcctaaagatttatagcaatttctgaaggccagctgcagacatcccagggaaatctctggtccttacgctaagaccatcctctactgccccctactggcttgtcctggccatgggtcccatgaaaagatggagattatttctacgtgacatttataaatatttttgttctcttctccagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggagagaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctccttctcactggtgataacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaggcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctggttggtgtttaaggtttgagcctcccaaggttctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaacttgt

SEQ ID NO: 38671 - DNA, 705646 bp, Homo sapiens
agccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggtgaggggccgggggcgcgggcggggagggggcggcggcggggacggcgccgggatcaatatggcgcttcctggaagggggaggagaggcgcagggaggcggggaaagggaaagtgcggccggtcgggcctcgcgggcgccccccgccccggactgcgggcgccaaagttctctgcgcgggccggggcgcagcctctgggacacccagccgggtcccgcggcccccgccctcaccctccgcccgggagctccggcctcggtagcgcggggcgagccgggcagcggcgcataggccggccctgggcgcctccccggagtctgcagacccagccaagccccgagccagcgcgcggggggcgcaggccgggaaatccagccccaggcctttcccggctcccaggccccgggggcacaggccggggactgggaacttttggtgtgaggagagtttcgtgactgcccttccgacagaggcgggttgcgagccttctgcctcctctcccttactcgggcgggggcggaacagcggcggggggcttttcctccatgtcccctgctggtaggggccggcaggggcggcccgtcgcgtccgggggctgcagggtttggggagtcgccggcttggggtcggggaggcgttcccgggagggccaccgctggcacttggcactcgcttgcgagcatttactgagctgatcccacttgctgggctctggaaagcacaaccttggaagagtcgcggaatgaaaagttttcctgcgaggacctcagctcctacctatcccgggctggttccatgtggctgggctgcggggccgggcctgacttgggagttgagtggatttccctttttcctggtggactgataacattgtctccacttcacagcattcctctactgtgtgtcagaagtgaaaaggcgttttgttaaattgttttaccgactgtgtctgtgtttgacaacagcccacgctgaagtttctcccaagcacccggggatatatttcctttgtagtagagtcctctttggtggggagcgcattcgtttgggtgcagtatttcccatttgttcccgacagtggcctggcccctgtgggcttgggggctgcaaatgacgttggaaagtggcttggtcagccctattgagcgtacacagggtactccggtggcatcttcagttctctcagaaattaagaagtaaaagctttttagacttttgttttgcttttagtatatattggaaaaaatagcataaatttggccttttaaagataattttgggggacgtttggagacccgacacaaggatggaagacgttggctttagtagctctgttatgttccttacagttgaactcttttattgaaaatcaaataaaattagtgggaattgggcacctgtttatcttgcaaagctgacaaagggaaagaaaaccatctaaatggacatttagcatttttaagtgttgtttatgtgtgacagtttatgctttaaatgttccaaaagagtactcaaattgttcaggcactctggaaaccaacaaaacaaattgtgcaaggaaagagaaataaagtaatatgcactctgcagtacgtctaggctcctgaataggaagagggtggtcaacattttctttcactttactaattttatgtgattaaaattgttttacctactgtgtcccatgtttcatcctgcacaaaatagacataggctgaactgcctgtttggcagtagttcaaatgtagttgttccaggcattcgttccacagaaattctgaagctttgactgtgtccatggcactgttctgggtgctggacatctaagggacccactggctgtgagaagctgagcaagaggctgcggggtcctccaggtgaaggagctggtgatgacatggggagaagaggtggcctctgggatgctgggtggctagagtgcagggccttggtcacggacctggtccttattaacgattagcagtggttgtttcacagggcgtagaaaagggagtgcagttttttaagggtgtctgggaaggtgtcacaaagagaaaaggggcctatgagctgaaggaagggagggtgatagtgacatgggagttggagatgagagggagggtcagagatgggtcaggggttccaacacttacatgctctttaagtacaacttagagttctgtaggtgaattttaacgggggctttgcagtataccaagttcagtcattggatcccaagattgttgacccttaaatgttgccagagctggagtgtcttctaggtctcctttttctcgtttttcttctgaaattgctagacaatgattaagattaatttttagtctttcttactacttttcccattctatattaagtgatgaggaagtgttaatatgtatttaacactgttttaacttttattctctatctgttccttatccgtattgcctaatagaacaagagaaattctgtgtgaagaattgggtggctggatagttgtggagtggtgtttaggttgctaggtgacatgtggcttgatgagctcccatctggtggggaaaagtgtgggcagatcatgtttatggctttggataataaccaaccaagccaaaaataaaaaataaaaaggaaaagagaaaggtcccaactctcaaatcaccaaggctttctctgcagtaaacattttctggtgtggtggggctaattttctggcattgcatgtgagctgttttctcttcagattacacaaatcaatttttctggatagtgaagtgtcatgatttaatactagacatgtcctcagtgagtagatatttgaaggcttatgcttagtcatgtgtgacatttcttttttcctctcctgaaagatggttttgtggttgtgatcactgatggttgggaatagctgttcatcctcatccacccatctgcattaggagcctcgctgaggacagtgcggtgctagacattgggaaccgcgttacatggaccgttctcatgagggcgcaggatgggaggatggaccgtgtctgcatctgttcttctgcgcttgcgacctgacacgcgtgattccaggtggacatggtgctgagctgcagcgctgtgtggggttggttgaagggctgctgtgtataaaaagtcatgctctatgaaaaaaatataagactgaattcgtgcaattttcaaaaaaaagtataatctaggagacaggaagaatatataacagtataaataacaggaggtggtagcattaattggcaccactgtgatacagtcagtaatcgcttctggattttggaggtgggtgctatcattatggggtgtgtgtgggagtctcatttagtcactaggatttgaactgggcttggttggtgggaaggctgaccttgatatagggcagtgcttgctaactgggtgaggcacctgcctgcaggggcagatgggctctgggtctgaggtctgcagttggggtctaggtgtgtgaatctgcagaatgtctgctacgattctgataagtgaaagggagggcattccaggaaggcagtatggacaaaggcgattcaggcattcagcccagggggtcaggatcaaactgaggaggacagaatgccagggcaagaccctgagacttcgtgcagtaggaaggactgtggtgtttagctaagagtcagggtaacaagtagttctaggaggatgacctgagcaaccttagatgaggtttggatggataattccttagcatttcattctaaataaaggttgctgagtgaccaaaaggggaaggagagagtgaagggcaaaagtgagggcaaggaggtgctggagcccctttgctcactgttcccacctccctcatagctctcctctcagcctgtaggggagctttggattgggtttggtgacttaggtttacaagccatttaaccttgggtataggggagctttgtattgggtttggtgacttaggtttacaggccatttaaccttgggtacaccaaccctacggagccccattatctcaagtggaatattccctggcagggttaatgtaagtattaaacaggatgatgagagggaaactctaaagtcctgggcccggcccatactagctgctccgtaaagatgaatggaatcaccaatatgttttatccaccaagcagttttacacccagggaactttcccaggtgtcccactattgctgcttggatttttcctgtttacttaaaaacgcagcatgtaatttcattgaaggataggtaagaatgtgagattgaatgacgtgcagcaccacaatcaggagaacaaaattgtgtgttgcatgtgtgtatgggctggggaagtaaaagctgcgggtattggcttgattacaggttgattattggggcctctggcttctgtccccaagcacatcactttagagtgatttaatagcaacctgttgttattacaggttgagcatcctttatccaaaatacttgggaccacacaagtattttggatttttctggactttgggatatttttgtatatataatgagataggttgaagatggaacccaagtctaatgtattgttagaatttatgtttcctacgtaccttatacacatagcctgaaggtaattttatgcagtatttttgtgcttgaaaataagtctgtggtaagtacttacatgtggaattttccaggtgtggcgtcatgtgggtgctcagtaagtttcagattttggagtattttggattttggatttttcaattagggatgcttgacctgtattttttaaaaagttgagctcatggacagaaacttttgaaaatgtgcttttttggtggcgggagactgttgattagtaacaatgacagtcatggtttttatgaaaaatcttgtggttggtatggaatttttctgtgaataaatgtatgactgcatgttattcatttacaagcgtattgaaacttttaagaaaatagttgtactgttgcagagattgaaagaaaatagaggcaagcataaaaatagtgaaatgaaagcagctttatttatttatttatttttttaacattttctgccttccctctaaaaaggaaaaagaaactaaacatttttgaaaggctgatctttccagaattcaagtcacattgtcctctggtgctgaagcgcctttgtcccgcgttctccaagtcctgccttctgagcacagcctgtccctgtagggacccctcttgccttccagccactccctctgcagctgctccaccccctgggactcacatacactttgctgcctctgttctggcattttctgtttcttctgcctgggacatttgctccttccttgcactcattcgtgagtcttagcccagacagccatctccaggaggctggctctccatcccaagctgctagaggatctttctccctgcctgctgcctctcctggggacgtcctgggtgtagctcctgtaccgactcagatgcttgggctgtgctgtgtggttttcaagtgtatccgtgcgcccttcctccctccgggtgaaatgcttgaagcggtggctgagcttcagtcttggtgaatagcccgtgtctgtcacattgcagtcagaatgttgagtaaatagaaagctgagaatcaacatgttacactgctctcacacaaaaaatacacttctgctgagaggactatcatcagcactcgtgaatttaaaggactttaaggtttggtgtgtttgacctactggcacaaacagcttgtaatggaaactaagatttaatgaggtttggagtacttggaagttactctttcgtatcagctgtcttgagggagttcagtttgtttttcagctcaagcagaggaccctcctgggattcgccttgggcgaggttcaaggcaggtggccagggctgtgtgagaatctggccctggaacacacctatgcttggtctggcgcctctgattccgtcagttgagatgcttggctgagtgccaggactaagtaggaatgtttaggatctgagattctcagagagaatctggcggatgtgaagcgcttcttggcttgtggtagacatggataaattggttgtggagggaatatttaaagtcccacttggatgcaaacccacagacggatcctccgtctgtcctgggaggttctacctccccacagagttgggtgcaagttggtgatgttgagctccccatagatgattagagccctcggtattttttatcaaggatggaaataaacatgtaagattgggccagaaggtgctttctataggtaattttccatcgggggagatggcatgctaagcccacacagcatgctttcatcctgcttggccactcgctcaacattcctggctgggaccaaggtcaatggcagtagagctggacatcagtaaatgtatacagttttacctgttttgggtaccttttctgtacaaaagcaaatctttatcaaaataaatgccgagttcagtgaataaagtagaaagatgactgatttttttttgtcttttagtcattatttacaagttttttctttctttcttttgttttttttgagacagggtctttgtcacccaggctggagtgaagtggcgtgatctctgctcactgcagcctcaacctcccaggctcaagcgatcctcctgcctcagtcccccaagtagctgggactacagttgtgtgccgccacacctggctaatttttgtagtttttgtagagacggcatctcgccatgttggctaggctgatctcaaacacctgagctcaagcaatccacctgccttggtcctccagagtgctgggattacaggcacgagccaccatgcctggcctaaattttagcaaataagtaaaaataactttgttttaacttatttagtaaataagtaaacattttagtaaataaagttaaaataactttcgtgtataggtctgtgccttcttgcatctggcctgctatctttacgtggtttttgccatttaaatattacttttgtgtattccttttttctccatcaactcatattggtccttgcaagtaaaatttcaagctccacatccaagtgactttaaatatcaattatttatttttttcacctaaacagagtatattttgtatatagtctctgtactctattctgtatatattttatatatactctttatatatatacacacacacacaagcacacaagagaaatgaaaatgtgtacacaaaacctgtacatcagtgttcatagcagcaagcccacatattgtataattctgttcctataacatgaccagagtgggtagctctatagagacagtagagtggtgttccgctaggactgggagtttggagtcatggagactgtgaatgggtatgaggtttccttttgggatgatgaaaatattctaagatcatggtgatggttgcacagttctattcaagtgtatactttcaatggatggagtttatggttatgtgattatatgtcaataaagatgttagaaaaatagactgcataagccactatgaacaacgctccatttttaggtattttgtagttctgagcatttcataaaatgacatatatatgtgtatcagagatgctcaaaacacttcaaatgaaaactggctgtctttaggagttttccatatagtgtggaatccctgctttctcaggcctgtccaatgtgtcctgtttagtgtctggtaagctcctggctgctgagcctccaggtcccctggtctctgtgtgctaccccctaccccctctaagggcttcaccaattgttctttagccagagactccttctacccagctcgccagctacctttgtgcagtggaggttgagaatgccccaaggatgcacgtaatggaccagcctttccagcatttggctttggctcccagaaattttgagctttggcaaatcttacaagctctgtgagcctctgtttccccatgttctcatattcagaggtgctgggctggactcccactgccagttccctgagctgtgcagggactcctgctctgcatggtttgttttggtgctcatgggaccataagtgatgtgcagtggcttttcagatggttatacagggtccaggacctcttactgcttccctccatgctgtgagaatattttgcctcaccccgacccccccaactttgaaatgacggggcttgctctccaggtcaaatggatgctattcagagttagggtaaattttgcttagggttggctgggtgagaaggctcacgcctgtaatcccagagctttgggaagctgaggtgggaggattgcttgaggccaggagttcaagacccagcctgggcaacatagtgagaccccgtctctttttaaaaaaattagccaggcataggccgggtgtggtggctcacgcctgtaatcccagtactttgggaggccgaggtgggtggatcacgaggtcaggagttcgagcctggccaaagtagtgaaaccccatctctacttaaagtacaaaaaatagctgggcatggtggtgcacacctataatcacagctacttgggaggctgaggcaagagaatcacttgaatcctgggaggcagaggttgcagtgagccaagatagcgacactgcactccagcctgggcgatggggagattcatctcaaaaaaaaaaaaaaaaaattagccagacatggttgtgtgcatctttagtcccagctgctcaggaggctgacgtgggaggattgcttgagctcaggagtttgagattgcagtgaactatgatggtgtcactgcactccagcttgggtgacacagcgagactctgtctctaacagaaaaaaaaaatttgtctagggtgtccttcagaatttccttccttcttcctttttttttgtctttttgagacggagtctcgctctgtcgcccaggctggagtgcagtgacgtgatttcggctcactgcaagctccacctcctaggttcacgccattctcctgcctcagcctcccgagtagctgggactacaggtgcccaccaccacgcctggctaatttttttgtatttttagtagaggtggggtttcaccgtgttagccaggatggtctcgatctcctgacctcgtgatccgcctgtctcagcctcccaaagtgctgggattacaggcgtgagccaccgcgcccggccccagaatttcttattgtctcaaggtaagtatcttttaatgtaaatcacatcatgctcagaagtgactaagacaattccctttgtgaattacagatgtatgatattgcatgatacgaactgtacggtgtatatatatatatatatatatatatgcacatacgtgtgtatttctggggtgatcttttatggtggtataaatttaagtcattttagagatgatagtcaagtcaacattctcccaatcttggtgtttttaactattcagacactgtaagatttaaggttttggaactcagatgtatatttttctagtgtctggtttttcccttcttgtatttgagacggagtctcactttgttgcccaggctgcagtgcagtggcagagtctcggctcactgcaacctctgcctcctgggttcaagcgattctcctgtctcagccttccgagtagctgagattacaggcgcctgccaccacacctggctaattttttgtatttttagtacagacagggtttcacaatgttggccaggctggtcttgaactcctgacctcatgatccgcccgcctcagccttgcaaagtgctgggattacaggcgtgagccaccgcgcccagcctttccctttttgttgattgtaccgcatccctttagattagaaaactaatctatgttatagggtttatatatttcaaaaagcctctttgagatagactacactaaaaatcagtgtttccttcttcaacacttaagaaatcaacttgatattatgtctcaaaaacctaaaattgctaaccaatcaaaagatgtgtattaatattaaaaacacaaagaaaggagtgttgtttttgtgttggtggtatatatgagactagatttttttgttcaatttcttttacatagacaatacaaattggaaaaaagtttttatgtctgtgttttaattttcttctctaagtccaatgttaagtccaaaattaaaaaataaactctttagaagtctgagggacaaaggaaaaaagaaaactcttccaggaaacgtattttcttataccacaaaggcatttaacatgtgtcatttataatgctgaaacccagtgtgcaaaaccatatgtgaataatggttagccagattcctgcccagcagggttatactctaaacttggatttcttttattacagacagcagcacctgcagaagaaggaggtaaaatgtgcaggatattggttcctgatgtactacaacacaggatgtgactaatcactaaattcattaatgttgaacataggatttggtacctttaccactttgttagagatctggaaaaaaaatcttctagacaaatcaagttgatcttggccaagtgcagtggctcatgcctgtaatcccagcactttgggaggccaaggtgggcggatcacttgaggccaggagttcaagaccagcatggccaacatgacaaaaccccatctctattaaaaatacaaaaaaatttagctgagtgtgatggcaggtgcctgtaataccagcaacttgggagtctgagtagtgagaatggcttgaacccgggaggcagaggttgcattgagctgagatcgtgccactgcactctagccttggcgatagagcgagacttcatctcaaaaaaaaaaaaaaaacaaaaacaaatcaagtagatccctaagtgcatcatttggattgataactattttttactgcatctggaaggtggtggcattttagcggttgtcatgttgaggaatatgaaataaatatattttaaattatgaaagcacatcctatcaggaatattttttccaaggaaacttgcaatgctaacaaactcctgaacttgattattgttattttttatttttattttttattttccgagatggagtcttgctgtgtcacccaggctggagtgcaatggcgcgatctcggctcactgcgacctccacctcctgggttcaagcaattctacaacctcagcctcccaagtagctgggattataggttccagccaccacacctggctaaatttttgtatttttagtagagatggggtttcaccatgttcatcaggctggtcttgatggagtcttgaacttctgacctaaagtcatccgcctgccttggcctcccaaagtgctgagatgacaggcatgagccaccgcgcccggccaactcctgaactttctatggtggagtcatttttgtcttttacgttttaagactcacacagatgtttgcaaaaacaccgttagctgaaagtggaaagtttggtgatgggtattttgcttctaggaagcaaaaacatcagagtgacacatcatggatcaggattctgaagaggaatctctcccagacatttatggagagttaagagaagtacctttgtgagcacgtgattcctgccttctatttttttttttttgttattatttatttttttgagacggagtctcactctgttgcccaggctggagtgcagtggtttgatctcggctcactgcaacgtccgtctcctgggttcaactgattctctcacctcagcctcccaagtagctgggattacaggcatgcaccaccacgcccagctaatttttttttttttttttttcatttttagtagagacggggtttcatcttgttggccaggctggtcttgaattcctgacctcaagtgatccacccgccttggcttcccagagtgctgggattacaggtgtgagtcaccgtgcctggtcgggagtcctaccttttaataccacctgctttgtggggttgttgtctgggttcaaagagagaatgtgaaaaggtattgtaggaggccaggtggactacatgttagccgtactgtccctttgtttttaccaggagtgtttgccagtgattaagtctcactagaataggcttttctaaattgttttatctcatcctcattagaacttcaccacatgtgggaaatcatgtggcaaaactgtctctcttaaaaaaaaagtcaccaaggaaacctccttctgcaatttaagaaataaaatcccagtgacattgatttggatgctccaaacatgtccataatggaagagcttttccaggttttggtttgggccccccagaccaaagctttgacacataatacaagctctgtaagtctgttttcctgtctgtaatttgggattgtcatctttgtagggtgtcatggagattaagttattcactgtagacaatgcccctttcatgtaatagattctgtcagtattagatctttttctttctcttcaagtttcaaacatagattaggcaaaattttaatggctatttcacaaaatcagcttgattcttgtttatgacatcaagtgttgtttttccaggttgtctgttaaagggctacttttttttttttctaaaagtgctttagaaattccagtgttagtatgtatgcatcatttagctaagaatgaagatataaagatcacccaacagtttaagctgattcttttacaggtcaaggagaattgtgtttgtctagctgtcttagccgtgtaggactttctacttgttacttcctaaataattgcagccgcaacactgctacttcaaaggaaattacataaattttatttgctgtatttaaagtacattaaaaggcatcacttacacatttttcattaaaaatacttttaaaacttggaaaggataaaagtataaaatgtaaatactgtctgtattaataaaatgcagagatgttttaaaggcctttagtgtttattaactagtaatagttctgagaataccctggagctcaaatagataatctgtgttataaaataaatgggaaagttgacatttttgtgacttttctaatccttactatataggcctctataattcatgtgcccataacacttcttaagatgtgattttgggcatcttaagatggtgatttcgggcagctaaatcagcaacaaaggaacacagaacatcttttgcttaggtaggtagttgtaagggttgacagattgatgcaacttttaatactttagtttggctaaaggcacccagtgcaaatcacctgaagacttcacccaggagttgacctatttatcatactaaatagggagtggcgtcttgaaggctcattcacattctgggcttggcaggcagtgcgatgaagtcagacttgcagttatcaacaccctggctttgtattcaagaggactacctcctctcatccgtctttttcataccacagtattgaaggggttgttttcctctttgaagaccttaaacatctcattaattaaagtaatgcttcttccctctccccatatgcatttagggaagtcgctaagcagtgattgaagtagtaaagcttatctaatggcacagcactcctattttgactctgatcccttcctgtatttatttgtaaacattttttcatgtgagtgtgtttgaaattccaagttttagtttcctacaggatgtgaaaaagacctagcagcacgggagataggaatgtatttttgtgcgtctgtctcttgccttcacgcttcccctttgtttttgtgctttgctaatggaagtgatgaatggtgctttcaaaaactttccagaatactcaagtgttttataacaaaattgcagagaaataattcggagaatttttgacagatcttagagtgttttgataggggggattttagtccgaggcagaagagttttggccctgcattgtttctttaccgatgagaagtgaagctgctttctttatagattccggggagtggtattttcagctcagtctctgcttttggtgttagaaagctttttaggtcaggactcatgatcgaaagctcttgcataagaggtgcttttatcaggggcattatttatctgcctattagtttaggaggttgttgggaaggtaccgttttaacaacagtgaaacctgtcacttttttttcattcctaacttactgtgaaggagtctcagacagcaaggaggagatccaggagacagtggtatcagaaaatggtagtattaccattattattttttattttttgtttttttgagatggagtctcgctctgtcacccaggctggagtgcagtggcatgatcgcggctcactgcaagctctgcctcccgggttcaagcaattctcctgcctcagcctcccgagtagctgggattacaggtgcccactaccacgcctggctaattttttgtatttttagtagagatggggtttcacctggtttatcaggctggtcttgaactcctgacctcaggtgattcgcctgcctcgacctcccaaagtgctgggatttacaggcctgagccaccgtgcctggccagtattaacattattatcaagagtaatggtaagcactcatggcacatgttgtatcaggccctatgtgctggggtcagtgctttatgtgtatatgttaatctcatggagttgtgatattggtgtaatccagagtttacagatgagtaagcttgggctagagaggataagaaactttttttttttttgggaagttgcacaactgagggtcttgctctgtcacccagactggagtgcagtggcatgatcatggctcactgtagcctcaacctcctgggctcaagcattcttcctgcctcagcctcccgagtagctgggactacaggtatgtaccacctatgcctagttaatttatttttatgtttgtagagatggagtctcactgtattgcccaggctggtcttgaacttctgggctcaagtgatcttcctgcctcagcttcacaagtagctgggactacaggcatgcgccaccacacttggctaacttgttttttttttttgtagagatgaggttttactttactgcacaagctgatcttcaactcctgggctcaagtgaccctcccactttggctccccaaagtgctgggattgcaagtgtcagccaccgtacccagccggcttggctgcctttggcagactctaacttcagagcctgcacagtgagttgctataccatgacaaactgatgtgcattttaagatgctgcaattccataagaaagagtaagtgatcccgcgggagaagaacagggttttttcctgacttgggtttgcttgaatggcttatgggttcagggaagaagtgcacctttgggatcagcttcaggctagtgagggtaaaaaaggtgcatggctagctgtcaaagacccttgcttctctggtgtggcctctgggccagcagcactggcatctcttgggaacttgctggaaatgtacaatctcggggcccattctagacacctccgtataggaatctgtattgaggctgggcatggtggctcccgcttgtaatcccagcactttgggaggccgaggcgggtggatcacctgaggtcaggagttcgagaccagcctggccaacatggtgaaaccccatctctactaaaaatacaaaaattacctgggtgtggtggcaggcacctgtagtcccagctactcgggaggctgaggcaggagaatcgcttgatcccgggaggtggaggttgcagtgagccgagattgcgccactgcacttcagcctgagtgacatccccagttggtgctagagcaactgctcttaaccttggcagcaaaggttttagaatgttgatacctaagctccatataaaccaagggggtgaggtctctgggtcacgtttggagattggtgtttctgtaaagctcttcaggaagctcttcaggtggttgtctgtgcagccgggttggaggactcctggcccaggccaacctccagaccttttggagttgttgcattatgtgatttgcaaccctgctcgcctttggactgtgcatggaaatttccaaaacacaagttgagatgatcagccagcatgctcaaaggctggtcacttgtgtgacagtggatcagcctgtatgtgtgggtttttttttttttttttggagacagagtctcactctgttccccagtctggagtgcaatggcgacatctcggctcactgcaacctctgcctcccgggttctagtgactctcctgcctcagcttcctgagcggctcgggttacaggcacccaccaccacatctggctaatttttgtatttttagtagagatgcagtttcaccatgttggtcagggtggtcttgaactcctgacctcaggtgatccacctgcctcagcctcccaaagtgctggaattacagttgtgagccactgcgcccggcatgttttttttttcttcttcctcttctcctcctcctcctttcttctcatttcttcttctcctttctccttctccttctccttcttcacgggacagggttttgcacttgctgtgttccccaggttggagtatagtggtgccatcaatagctcactgcagcttcaaactgctgggctttggtaatcttcctgcctcagcctcctgagtagctaggactacaggtacatgctaccatgcccagctcattaagcattttttttttctttttgtagagatgggttcttgctaagttgcccaggctgatcttgaacttttggtctcaagtgatcctcttgcctcagcctcccataacactggggttataggggtgagctaccatatccagtctgtatattttctttgtgtctttgtgtgttttcttttttgagaccgagtcttgtgctgttgcccaggctggatatattttcatttttgacttttgaagtcattcaattctcctgcctgttaattttgttgagttttatttgtagaaacagagacaacacatgtgcaaggtcatccttaggttttagctgttgactctaaatgatgtctagtctaatagccacttctactaaacagaaattggttaaggaagggcagtgagagacagcacgggggagttgtaatgagatgggggaaggaaaggccaatttggataaaatatatgagttatcctttgagccaggttatgtcctctgggtgtttgtatatatagaaaccggtcaactatggtatttggttttgggtaaagcagagatgagggcttctgagtagtggacagaatacttctcttgcaagagttgcttttcgagcttgtttatggatacacatccatttttattggatggagcagtagtattagagaagactgttggcacactttcacaaagtaggtaagggattccttttctacatgtttagactttactttggccaggtgcggtgcctcacgcctgtaattccagcacgttgggagactgaagtgggaggattgcttgaggccaggagttgagaccagcctgggcaacacagtgagaccctgtctctacaaagaataaacataaattagccaggcgggatggcatgcacctgtagtctcagctactcgggaggctgaggtgggagaatcgcttgagcccaagagttcaaggatgcagtcagttatggttgtgcccctgcactgcagcctgggtgacagagcaagaccttgttaaccacttacttagctccttggaacagtcccactgaacaagtcccctcatgacaccagattgccagtgggcctggctgttgttggcaaatataagctcctggttgtgctgcctcatgaacctaaccatgggtctgacaatttttatgtccatggattgattttatttcatttattttattttttttgagatggaatctcgccctgccatccaggctggagtgcagtggcacgatctcagttcatagcaacctccgtctcctgggttcaagtgattctcctgcatcagcctcccgagtagctgggattacaggcatgcaccaccatgcctggctaatttttgtatttttagtagagacggggttttgccattttggccaggctggccttgaactcctaacctcaggtgatccactcgcctcggcctcccagagtgctgggattacaagcgtgaaccactacatctggccaggaaataatttcttcaagggtactttcagggctgcaaagtgcagttctttgaaatactattttaaaatattttcttcaaatctactgcaactatgggaactgactagtactgaattttatagacctgatagaaattactctaaagacataatgtgtctgatagtaatgtccatgtaagaattttaaaaataatattcagcagtttcaaataacacttaaccccaagttgatagtaaaaatgttttttgaaccctagtttatatttaggtgttgctgcataaccaacccaaaacttaatggcttaaataaacaatgatttaattatatctcatgattttgtgggccaggaatttgggcagggctcagctgggttattcttccgtgccacttggggttacttgcatgtatttacctggcagatgatgacctggcctggaaaatcctagatggctccattcatatatctggtgtttggtgggggtaactaactagaatgttgggctcagctgggacttttttttgtttttgttttttcaggttcatagtttattgtacaaattgaattatcacatgatgagttgacattagcttttccatggaacttagattagcatgggaatttaacagatgaggcacagtttggaacccatttatactgctttcacagctggagtttttaaagatcttaacttgaagtgtaagatcatgaaagcaatgtctctatgtgtcaattcatcccacctgtgtgagtataagagttgactttttaatttttttatttatgttatgttatgttatgttatttttgagatggagtttcactcttgttgcccaggctggagtgcaatggcacgatctcagctcactacaacctccacctcatgggttcaagcgattctcctgcctcagcctcctgagtagctgggattacaggcatgcaccaccacgcctgactgattttgtatttttagcagagatggagtttctccatgttggtcaggctggtcttgaactccctacctcaggtgatccgcccaccttggccaaagtgctgggattgcaggcgtgagccaccacgcccggtttttttttgagacagggtcttgctctgttgcccaggctggagtacagtggtgcagtcagctcactacagcctcaaaatgctgggctcaagtgattctcccacctctcagcctcccgagtagcagggactacagatgcgtgccaccatgcctggctaatttttgaatttatgtagagatagggtcatactatgttgcccaggctggtcacaaattcctgggcttaagtgaggctcttcctttggcctctcaaagtgctgagattataggtatgaactaccatgcctgctctgaaatacgttttactaccagtgaactggaattgggcatctccctccggacctgccgtgattttaatcttgccaaagccacaatcaatcccacagccagtgtccttcagtgcaagcaaccctcaggtgggacttgttgactggagcacctgcatgtggtgtctccagcatagaggcttccggatggttggacttcttgtactgtggctcagggctcctggacagtatcccaagagtcaggaagaagcagctgtcactctctcaagttttagacctggaagacagcacagctttattgtccctgtattctatttgccaaattagtcagtaagcctgcctaggttcagggcagggcatgcagactccacttgtcagtgtgaggagtgtccaaggccttgtggtcatctttattctgccatagatacgtgtgtatgtgcgcatatgcgtgtgtatcacatataacatcaaacatttttttttattgttatgtgtcatgtttcaaagtcatctttttcttgatctgggcaagggcaataaaatgtatgtcctgaacttttgaagctgacaaacttaagaagtagtttgtgttcatatttcatgagcccaaagatctaacaactttcccaggctatgtggtagaaagagataatgataataacatcttaggtttatgtggcatcttctaagaggttcaaagtggtggttccactcatttctttatgggaatatactgtgaagtccataagcagtagtacccccaagttcatacacagaggtgggaatgcagtaatttcatcattctactaatgaacagtgttcagaaggcagttcttgtagtgatctgtttactgatagaacttctgtgaatctgcctttcttagataagattttggaaaatgatagaaattaacttttgtgtgcctggtaatacataatatactatttatcaaagagatgtcatatttgaagaagagtcagttatttttctgaagtgaaattctttgggggagaagttttagaggtatggcattgcagggatgtctgtagtagattaaaaagtctacatcctcagcagaggcagaaaaatacagtggaaagggtataggtggttatgtggccatccctgtactgagtatatggccaggactgagggtgacactgcaagtggaaacccttgtccccttgtgatatctgttcatgagtccccccaacccccaccccccgctgactgtgggagtgtctctttgtacttacgggagattgaatggagttttcaagtataattcaaccatatgttgagtttgcttacctttgctgtttagagcttatcctttgagtaaggtgcaagtcgactgtaaatgtggtattacttaaatacattccatttttcttaaaatgagatactttacctctaattgaaggtatcaggggataaacagtttttcaggcaccatttgttatggattatctcctggttcatgaatattgcattcttatgtgaagtgatccacccttcatgtttccccagagtaaaattttttttttttttttgagatggagtttcactcttgttgcccaggcaatggcgcagtcttggctcactgcaacctccgcctcccaggttcaagcaattctcctgcctcagactcccaagtagcagggattataggcgtgtgccaccacgcccagctaattttgcatttttagtagagatggggtttctccatgttggtcaggctggtctcaaactcctgacctcaggtgatctggctgccttggcctcccaaagtgccgggattacaggtgtgaggcaccgtgcccagccttcccagagtaaactttctaaggatggcttttatatccctgactagtacagagaactccatgggttctgtgtggttttccaagtagaattcaaatttatcagcctgaaaactgaccccagcctgccctcttctctttaccgccacgaccccttccttccctctccctgatcatggcagaactgactctcactgctgccctggagtcctactgccctccagctcccttgtgttcgtgagttgtccctggcctgggatactctgcccctccttttccctctcctcttggctctcccattttttcatctgcactgctgccagagctgtgctttttgttcagaaagctctttgtggcctctgcgacggccccccggctccccaggtgggctcaaggctgactgcaccaccctgggcttctcagtgccacaccaagtgccactgctggagcccacacctgcagtccctgctgcagccccaggcattgtccagatggtgcctttgcggattctccacccacaacccagggagatgcaaaagtagattatgttgaattcaaggtatataaagaatcactgtacaaacatgtgctttttgaaaggaagttactccgataattttgaccgtgttattacatgttttattagttgtaaataattaaaagtggatgaacatttaagagcgagtgagctgataccatcaaggaggatttctgcagtctccttctttggcgagggtgttcacccagcagcctgtaggcatgagcagtgcctggagtcctctgctttctgctgccaaatttgctgctgcacaggtcactgtagacctcctgggtgcaggtgcagctccagcgggtggcgacttgttcctaggtagacagaacagggggacatgtatccttgtgggaaaacagtgtacttgagaactgcagggcagtcacgactaatgctgttattaagaaatactcctggctttgtgactctgggtgtttttaatcttttataattaaacataagtgaatattgaggtgtattttagcatttgctgtactctgctaagtagagtttgtgacgtgttgataatgggagaatgggtgctactgtagtaaagaaaaacagagagctggtgctgggtgcggtacctgtgcctgaagtcccagtgctttgggaggctgaggcaggcgcgtcgcttgaggccaggagtgtgagacctgccggggcaacacagcgagaccttgtacttttcttcctacagggaagagcctgtagactctattctgtctccacaggtcttctcccacccagcgttgggtggagccagagagctccgcaaagagcacgtgggcgcacgtccggggagagctaggggtgcacaggtccggggcaagcacgtgggcgcgcatcctgaggcaggaacagggcgcatatctgagcaagcgagcacctgggcgcatgtcacgaggcgagcacgtgatgcatcctgggaggtggccgagggaggctcaggagagattggagtggagttgaaaaagcaggaagcagagagggaagtccgtgtgtaacaaaacattcagtttgtaggcccttgggtcagaggaggtgacagccataattttggctccctgggaagggtctcaggcagtgtcctgatttttttttttttttttaaacgaggcagggtctgactgtgtctccttagctagggtgcagtggtgcaatcacagctcactgtagcctcgacctcctgggctccagtggtcctcccacttctgccactcgaagtgctaggactacagtgactaatttaaacaatttttttttgtagagatggggttttgaatccctggcctcaggcgattgtcacagctgggcctcccaaggcactgggactctaggcgctcactaccacacctggctctgacgggttgaggctgtggggacctggctctttcactgtccttctttgccacatgtccccgcgtcttgtctcttctcgtgagggctgaagccatcctttggaggagctcaggagcttgtcctctttatccagggctcggtgttggcttcgagccggcttcctggggaggaggccccggcctggtcccgggcttggtgatgacgctgcccacagtgggatgctggggagctttggagccttggttttgcggctgccagcagtgtggtggagcatcgagagggacgcaggtgatgagactcaggccagtggcttctacctgggactgtcagggttgcctgcgttggctgttggctccctatgtagctgctgctcgttggtgacgggtacaagcgtcagtgcttctcactcagggcagtgtagaatgttacacagtgatagtttatgtctagccaggttttgaatgctcttactggaaacagtcatatttcctattatctaactgaatagagaagtaagcagttgagaatacagttgggctgcacttgtctttttttccaagtgagttattttgtattttttgatactctgaaatgatcagtaagtgtgtgtgtctgtgtgtgagcccatgtgcgtgccacgcatgcgcttccctgtgcatgcgtgtaggaggctgggatggaagggatggccataactgactgttggaatttccaggaaaggcttggaatttatttttgggtcacaggccatttttttggtttctttcaagcactaaatgatttttttatgtaacttcacagattaaagaaatgcagtcagtttttgtatgacttagtaaatcttaaggaaaaaaccctacttacattaggatacatttgctggaatatttacacaaatcttacaataaaacttttcatcttttaaaattttttatcaactcagccataacttatttattttttgcttcattttaaagagaatactcattctttttttcctctttcctggtacttcagcttctcatttgcttgcagcctctgcattgcatggatgctggtttttcagcagttctggccctaacagaagcatcctaaggataggaggatttcagtctgggcttgctagccttatcagggggagagcagagttgctaagtttccattctctgtcactttcagttactctgctgtggctgctcagtgctgttcccagtgaaataattttagcatattttttcctcttgtttctgcatcagcgtcattactgttcatgcctccctggggatcagactgattggtaaattagtgccagcagaggaagtagaagacaatgtgtgagcgtgttttatttaaacacatacactctacaatttgttttattggattttgtcctttgagaacaccacaagtaatcccattacagtctagaaactgcttgctcaccacgcctccacctttgaaagcacataagtctttaataaatgaggcaatttccagattcatcaataattaacccagaacatgacaagttttatcacaactcaaagctttcccatgattcaaacggtctgctcctgccactgaattgtctgtatagtttctggttcagcttcccagagctcaggattctgccatggagacactggtttgagcaagcatactggatgttttcttgaaaaatgttaagctttaattgtttataataaaataaattcatacttattgtaggaaatgtggccagcacagatgattttaaagaagatagtaaacacccatattcttaccacccagaataatctacaaaagagcatttctttcatttctttgcattctttctgtttgtttgtgtatatataaatacaaatgcttatttttttgggggggcgggtggtaacaggatcttgctctgttgcccaggttagagtgcagtggtgctatcagagctcatggtggacttgacctcctgggctccagtgatcctcttgcctcagcctactgagtagctggaactacagacacatgtcatcatgcctggctaactttttgtatttttttttttgtagagacagggtctcagcatgctgcccaggctgatcttgaactcctggcctcagacgatcctcctgtcttggccagccaaagtgtttcgattacaggtgtgagtcatggcacctgaccaaatgcttttaaaaatattgataattgaaatcataatgcatacacagttgttcctagttactttacttaatttatcggtgtcttcccatgtctcgcaaaaattttggtaatttttttcctttttgagacaaagtctctgtcgcccaggctggagtgctgcggcacaattcttcatggctcactgcggcctcggcctcctgggctccagccattttcctgccttggcctccagtagtgctgggattatgggcgtgagccactgtgcccagcccataatactttttagaggtcgtatagcacttcattatgtggatatacaagtattaacctagttaactattgttgggaagttaattaattttctcatttttcatcatttaaaatattgtaataatcttagtgtatattattgacaagttttctgaagtataattattggataggaaattatgaacatttcaaggccctcagtttctgcacttggccagtttgctttccagatggggtgtgccagtgtatacctggcctgcatgggagagtgctctctgcctctgccaaggaggggacctcctgggtcagtaggtgatggtgctgccactgtttttgcagccgttgttgagtggctgggcccaggactgcagtctccagtctcattttgatcatatgttagtggagctgtaataccctcttctccttgaagattgtatgagagatacatatgtaaagaaccagacctacaagagatcgagaccgtcctggccaacatggtgaaaccttgtctctactgaaaatacaaaaattagctgggcatggtggtgcatgcctgtagtcccagctacttgggaggccaaggcaggagaatcacttgaacccaggaggcggagtttgcagtgagccgcgatcgtgccactgcactccagcttgggtgacagagcaagactgtgtctcaggaaaaaaaaaaaaaagaactggacctagagcttggcccaggtaggcagtggctgcgtggtagatgcggtggtggtggtggctgatcttatatcaggtgtttagagtcgtccatgttaatggagcagagtgctgagttgggagatgacatcaactggtcctgcgctttctgggtgacacacaaagtgcttctttgaactggggttctgtagaaaatagtttggaaagcaatgtgtaatattaatttttttctttcctgagaatgttacatggagtgaaattcaaaagtttcctgatgtctagataacttcctatctgtccacgtggtcttgtaagacccttgcatgagcctgtcccatttgtgctttataaatgcatgctggggctggggcgacgttacttatacctgtagtcccaacactttcggaggccaaagcaggaggattgcttgaagccaggaattcgctagccacctggatggcataacaagaccctgtctctacaaaaaaaaaaaaaaaattagctgggcatggtggttgtgttccttcagtcctagctactcaggaggctgagttgggagaattgcttgagcctaggagtttgaggctgcagagagctctggttgcgccactgtacaccagagcctgggcaacagagtgacaccctgtctcaaaagtaaaaaaaaaaaaaaaaggatgttggttgcccatttgctgtgtgccttgggtgtggacatttttcatatattttctcctagcctgactggattatgactatgacggttatcttttctccccttcaagacatacacatgtaatttgctttttcagtcttcagggattgcttccatctttaacgagatataaaaatgctgagtacctctctgcagcattgtttgtgctgctgctcaaatgctctgcagccttactgagaccagctgtaaagagcatctgcccttagcattttccttgacaagtcttgcttggctgctcaccttcttacggacgtgggtaacttcatctggttatctgattagtaccttgtctttccttaagactctgccattttggaattattattattgtttttgagatggagtctcactctgttgcccaggctggagtgcagtggcgcgatcttggctcactgcaaccttcgcctcctgggttcaagcaattctcctgcctcagcctcctgagtagctgggattacaggcgcccgccaccacacccagctaatttctgtattgttagtagagttggggtttttccacattggtcagctggtctccaactcctgacctcgtgatctgcctgcctcggcctcccaaagtgctgggattacaggcgtgagccactgtgcctggcctatctttatattcttggtgtatagtagattcatagggatttttgctaagtctctaaggattgataaaagatgtaaaagatctagcagttttctggttacttgacttttgagctggatgtggtgctaatttttagactagtcgttttagataacatgtgtttagagcattgcaactgtctatctaccagtttttttgtttgatctacctaaaataatgatctctttgaactctgcatgccatttttggccttccaaaaaccaaatctatatatgtatattggaaaagaaatatatgtaggatcctaaaactcatttttcagtttttaaaaggcccctagtaagcagtaagtgtcaggagtggataaattttaagtggctttttacagagtacttaaatagaaacattaattggatcagtgtgtggatctcatggagatctgtccctgtcatacgctggcaggcacattccatttctttctaatccccagatgtaataagatgcctgggtctgtggttacttgcatttgccattcataaaattgctgatcagtcctcccaggtggcactgttgtttataaggctgttcaaaatgtcagtggacttctgccatccctaagagcctccttgttatttctcttatggggcctaactgctgtaaaatatgtattttaacatctagtgggatatatttctttgtttctttgggctattccttcatcatctgttgaccacttttagtcaatagttatgggtcaaagctttggccagaacacaaaatacttgataggaagagtcattgtgagaataaataacatgtagtggaaactctgacattgggatgggacattgagtgggctcatctgctgagaatatttgcaagatggagcttccacagagcctcatgggcaaagcctaaagagatgagttagctgggtgagagggaaaaagtaagttgtcagagttctgtatttcatatgtgatttcgtttgtatgtctgcctctgtctgttgacattacgtcactgattattggctttaccacacacatgagtgaagaagaggaagatgcgcagggtggggagaaatgcagggaagacactgttccttttttttgagacagggtcttactctgtcacccaggagatgacacgtaactacatcaactggtcctacattttcaggcgaacatacaaagtgcttctttgaactagggttctgtataaaatagtttgaagagcaatgtatagtattaatttttttttcttctctggaatgttacgtggagtgaaattcaaaagtttcctaatgtctagataaatttctctctgtccacacggtccgcccatgtcttataagaccttcacatgagcctgtcccatttgtgccttataaatgcacattagtgatgtgatctctgctcactgcagctttgaaatcctgggctcaggcaatcctcccacctcagcctctcgaatagctgggactacaggcatgcaccaccatgcctggctaatttttttgtagacatggtctcgccgtgttacccaggctggtctctaactcttgggctcaagcaatctgcctgcctcagcctcccaaagtgctgggattacagacgtgagccactgtgcctggactctttttctttctaaaaaaaaaaagtatgatgcaaaaaatgcttttacttcaagaagattattctgtacttcaagagtataagttgcaaaatgcaaaattaaggatataaaattgtggatttatatttctggggtttcaaaagcataaatgtgtgatacatgtgcaggtttttggatattgaggttttttgagatttgaaaaaccatttattttttaaaagataaagttatatctcatttgtgtgtttaaacaaaaagtataacatctcagatagctttgcatagacagaaagattaatgacattcctgcatgaggcattagcaattattttccctgtaatcgtccttagaactctttgtctagtagtccacatatagaatttttctgcagcacatatattaagtaatcagtttaatatttgttcctataaattaaataaattccagtatcctttttagccatttccagcagtctaaggcagggaggaaacttagtgatgagatttctggcactaacttttcaaagaggacattaagaggtgaaaatgggaatgaatgctagaaaaatgactgttgtacatcacagcagggaggttttgcgctgatgaacagtgatgtttccgcttgacagtgtgaggatatttaactttcccagccttccacaagatgagaagggatgaagagacggggaaaaaaggggaagaaaatccttaaaaaagtatattggggccgggcacggtggctcacgcctgcagtcccagcactttaggaggctgaggcgggcggatcgcttgaggtcaggagttcgagaccagcctggccaacatggcaaaaccctgtctctactaaaattacaagaattagcctggcatggtggcgtgtgcctgtaatcccaacttgggaggctgaggcaggagaatcgcttgaacctgggaggcagaggttgcagtgagccaagattacaccactgcactccagcctgggcgacagagtgagactccgtctccaaaaaaaaaaaaagtatgttggaaaataccaggagagtgtttatctccactttgccctactcttgttagtattcacatcttcattggggaatgtaaaagatcctaaaacatgtgggtctttttttctccttctgtctcacatggggctgcagttttctttctttactcttttatatattgctatttatattttatgacttggaatactattaactttttagaatactgatgtttttattttattttttgagacaagttctctccatcacccaggatggagtacagtggcgtggtcacagctcactgcagcctccaccaccccagctctagcaatcctcctgcctcagcctcccaagtagccgggactacaggcgtgtatcaccatgcctggctaatttttaagaagttttttgtagagacatggtctctttatgttgcccaggctcatctcaaactcttggactcaaatgattctcctgctcagcctgttaaagtactgggtctacagccgtgagccactgtacctggcctagaatactgattttaaatgacagaatgatagttataaaactgtgaaagtttgaaaaaccacttaatgagttgctgttacatatatagtctagttccaagtagttagaaaaaaaaatgcactaagtgatttggcaacgtactaagccaataatagtatttgctttggagtaatgggattatgggttgttctccctttttttctttctaaagtttttatgatgtggttgattatacttttgtgacaaaactgtataatcacttgtttttattataaatgtgcaagaggacttacattctttttttttttttttttttttttttgaagacggagtctcgttctgtcgcccaggctggagcacagtggcgtgatctcaactcactgcaagctccgcctcccgggttcacgccattctcctgcctcagcctcctgagtagctgggattacaggcgcccgccaccacgcccagctaattttttgtatttttagtgaagacggggtttcaccatgttagccaggatggtctcgatctcctgaccttgtgatctgcccgcctcggcctccgaaagtgctgggattacaggcgtgagccactgtgcctggccgaggacttatatccttaaatgattaaaatatatcctgaggcaaaactattccaaataaaaatggaggccaatcagaaatatttaaaaattcagataaatgtattttagagagtgtatttagaaacccagtttctagatcagagtgccatcattcagtgtgttatactcccaaattaatgctttttacctattgtcccttggattaagtaaattcaacttgactcaactaaatcttaaggtttgacaccctgacaaacatgtcttaaaatgttttaaagtacataagatttaaaaccttggccaggcatggtggctcacgcctgtaatcctagcactttgagaggtcgaggtaggtggatcatctgaggtcaggagttcgagaccagcctggccaacatggtgaaacccgtttctactaaaaatacaaaaataactgggtgtagtggtgcatgcctgtaatcccagctacctgggaggctggggcaggagaattgctggaacccgggaggcagaggctgcagtgagccaagatcacgccactacactctagcctgggtgacagagcaagactcagtctcaaaaaaaaaagaaaaaaaaaaaactttcctaatgtttgtatattctcacgttaagtccttcttggaataaagttggtgtagagtggggatgggagaaaaattaatctccgtaagttgctggggtagaggtaacagtgttttatgtgtagaggaaataatgtctactgttaagtctttcgatcagccaaaagtggagtggatagtgcttaaaatgttttgatgtcgttgtgaggattaaagttatttaaaaagaatggatgtggagttgattttaacattttgggattaagaagggtggagagttctcactggaggttgtttgatgtgccctaaggctggttgagcacctctggctgcctctgagcatgttgcagtcccctgtcaagattccctgggtaacctttctaaaattttgctccagcgcccagtggaggaggctggattctgcctctgctgtcttagaacttcagtctttccttacaggtatagctctcttcatacacactgcttgactgcaatgtgttcaggttacatgctgtccttaaatcaggcctccataatttcttggcagctttccttttgcaatcaaattagcacttgggtctagaagccagttaggatgattggaagaaaaaaattacagatggttaaaattgggtcaaagtgcacttccttactctgttctctttacaagttaaaaatatctaaaaaatcattgcagctgtgtcagcatttctcagtaggtgccagatttaggtactacctttcagaatgtttatgtactgtgaaggggaaaatccattaattatacagttctgtttgtctaaaacgttcaagaacatttccactgccctctgcatgtttgtgatttttgggccattcagttcagtctggattatccgatagagcacagtgttctgtcattggttcaggcatttggctgtcttaccccacagaactgtgtgttctaggtcgggggcaatattttatatcttttacactctgtgtatagtgctgagcatgttacagttggaaactgttaattaatttttgttctattttcctgcactcaacttttcctcccagaggccccacctgaatttaagaacaaataagttattataaagtcttgtaggaaaaggcctggtatatttagagaatcagatccagctgtcacctaccattcatacagaaccatactaaccttttcctaaaagtaccatcaggctgttggttttgtaagttttctttcgttcattttccttttaaaccaagcctcatctgtgaaaggaggctgaaatctggcagacctctttattatgctctatttgtccacatgtggaaaccaccagaaaccagtaaaaaagaatgggaagtgaccaaagagcagacagaaaataccagttgccctagggagcacccagctcttccaaggactgcatgggtcctggtcagaggggcaagtgaaataccgcagctgcctcctgcagaggggtatctcttttacttgtgagcagcgtctgcagctgtgcaggctctcagcagtgcttagtgtcagccatgtcccttgatttatgctcgtgtgagcctctgcacatgtgggtgctccagcaggctagaggggggaggggtgccccaggtccccagaggcacagagctttttttggataccgagcctgagctgagaagcgtgggatgcaagagtgatgtcctgctccaagttcaaggaaagtacaaagtaagcggaaatgcatcccttcaaatagaggaaatcccaagttgcttttatgtttcccgttatagctgtgtgaagtcatatcttgaggtttagctttcacgttgagtttcagctgctttttatgtgtggcgtggtgaatgttagttttcagcatttccttatttcagcgtatgttgcctccgcactgattattgtcctttgttagtttagaagtcttgttttatccagagaaacagaataggaaaataacagcaattttgaatggcagcttcccctccttttatgataaaaaatacagcttctgtaaaaaactgcggcaagagaaaagaaagggcgtactgttgtccctggggataaaatagacaggagaccaaagactacatttctactgagcagtgcttttattaatgaattctggtagagttttaacagcagggcacgatttcctcctattgtgactcctgatgacctccaagaaataattcctgaatgtcacgctcataagacatttttctgattatgggcttgtaataattagatgtttatccctagaaaatattgccaacaaaaatttattaatagtgcaaaggaggtgcttatgcaccttattatgtaaattgttattttatattcaacatcattacaaacgtgttttgagagggctattgagatagatctccaagacatctgccgtaaaccagtacttggacttacagccagtgctctccacatctctatggtaaggagcattcaggtcaggaggtagaaatggaaaaccaggaaggtatttggtgattagtttgtgaagttagttgtgtcaagagcaaattaatttttttaataaaataagtctcagcaattttaaaaccattcatacaaaagaagcagagttaaaatggacttcacagtagtttccatggggattaccagaaggtgtaatgcatcttccggggaaagaagaagatggagggaagtagaataggatggggaatcgtagagagtcacagttgatttcaggtgccactcggtggcattactgtcattgtttacttccgagcatttagatctacagctagaagggactcagagaagacagacccaagaaaatcaccaaggaatttgcctgtgtataggactttgaaatggacacgtctccttgaaagtgccacgttggatgtctccaggcatggatcttgtctagatggcatttgcagttttgcatgctttgctattgaaatgttctagctaatgaatgtcttccactgcctgcctgtgtgtgtcaggtaatgcatctttcttcacagaaggactgaattcagagggtttcttgaagaaaatttaaaagctggtgatatctgcatagttgctttattttattttatttttgagatggagtcacgctgtgtcgcccaggctggagtgcagtggcgtgatctcggcccactgcaagctctgcctcccgggttcatgccattcttctgcctcagcctcccgagtagttaggactacaggagcccgccaccatgcctggctaatttttttaattttttttttatttttagtggagacggggtttcaccgtgttagccaggatggtctcgatcgcctgatgtcgtgatctgctgggcctcggcctcccaaagtgctgggattacaggcgtgagccaccgcgcccggctgctttattttattttattttttgagatggagtctagctctttcacccaggctggagtgcagtggcatgatcttggctcactgcagccttcacctcccaggttcaagcgattctcctgcctcagcctcccgagtacctgggattacaggtgtgcaccacctggctaatttttgtatttttagtagagacagggtttcgccatgttggccaggctggtcttgagctcctgaccccaagtgatccgcccacctcggcctcccaaagtgctgggattacaggtatgagtcactgtgcccagcctgctttagtttatttggatggtgactgtaactttaaacatattaatactgaacaactaaatatactatgtatgctgaaggatgctagatttttctaagtcagaatctgacagctttctcagttagctgctgtttgtcagtcctttgtgaacaaaaatactggtctacctcatgttaaggaaacgataggtgaaatgagatttatttaatcataccaggtattttaaacagccagctcttttttttggcaagctcttaatgttattaaaaacataatttgtcacttaagtcttttcagcatacatatagtttcttagtcatgtaattcataaaatagaatttagagttgaaaggaacctaagaggtcccttctaaatgtgtagatcttctgaacagtgtagaaattttcctccaccatgtctctgctggaggatattgtctgtggccatgcacttggcacctttcaaggcagccaattctagggaataacatttcttattggaaaatgctctgttggcctgattgttgctgcattttcccccttgttaattcatgtttgccatttagcaacacaaacgaagtctgttccccttcattcatgatgctcagttcttaaagctgagaacatgatggttaaggcagcacagtgaaattgccaactacttgccaaacaagtggatttgaaccagcctttgcctcatttctgtccttggcccgagggatttagaatccagcagaccgcaaccttcctccctatttcccctgtccatttacagatgaatacctggagataccacaagcttaaatgtcttgcctaaagccacacacattggcttggagcttagtgagtttgtattaggtactataagtgatttagagctgatttagagtatacaagaggttatatgcaaatgctgcgccatttcatgtcagggagttaagcatccttggattttggtatccacagggatcctgtaactaatccattacggatatggagggacagtggtacctctgaaggctgctggaggataaagctctaactcaagagccgtggatgtggtggtaacttggcagcagtctctttcccaaaggcctccttgcgggagggagggcagtgctcatcttaattttctggtctctttcctagactcaccatcattcctcagggaatcagttgattaattaacaaatgcttggctgggtgaggtggctcacacctgtaatcccaacactttgagaggctgagacaggaggatcatttgagcccaggagttcaagaccagcctgggaaacaaagcaaaacccccatctcttaaaaaaaaaaaaaaattagctgactgttgtagtgcatgcctgtagttccagctactcaggaggctgaggtgggaggattgcttgagcttgagagtttgaggctgcagcgattgcaccactgtattccagcctgggtgacagagtgagaccctgtctctaaaaaataaaaattatccaaatgtctaatgagcatctactgtatacctggtgctgcactgtgaggatgccctctaagagccccctgtgcggggagagagaggttgtataaaatgtttgcaaaggtggaaatggagtaggagacacatatgtgaggacatggggctgcagggaaggccttctcaactcctctcaggctgatggtgagttagagaccagccagggaaattgacatctgaggcagatctggctgagtccaccaggggaagagggtgggatggtggagggaaggggcttgaaggactgagtgtagagtcctttgtcacataggaagatgtccgtgctttgtgagcaggcaggagtcttcgaaggttccaaagcagggaaatgacataagactactgaaggccaggcatggtggctcacgcctgtagtcccagcactttgggaggccgaagtgggtggatcacgaggtcaggagtttgagaccagcctggccaacatggtgaaaccgtgtctctactaaagatacaaaaaaaaaaaaaaaaaaaaattagccagacatggtggcacatgcctgtaagtccagctattcaggaggctgaggcaggagaatcgcttgaacttgggaggcagaggttgcagtgagctgagattgtgccattgcactccagcctgggcgacagagtgagactccatcccccacccgccccccccccccacaaaaaaacacgactgaaaatacttggaaatagtctccttaatttgtttttttttgttttctttttccaccaatggtggaattcggatgggaggaggcttctaattttctgctcacaatgttgttccttcactagtttgaagattcttctgttgtgaaagaccaagagaacatatgattagttaataggagctgtattctatctgtagcttatctcttcctggccccaaatatagcttaaaaccttgctgtccttcctctgcttactaaaaaaaaaaaaaaaattgttcaagaacttcagctaattctggatttgtcttctgacaaagttccctgtggttcataccacatttttgtttcctccctggccatgtgctggcccctgaagtgtttagatctgctgttttaaaaactgagctccctagccagtcagattaattgctttggatcatgccattctgtctttctcagattgtcgtatgttagtgtctcctgtgccacataaatagtaatctcttgtaggtgtctgaggtatatttttcttggacttgtcaaaattagttctcagagcttagagatggtgtcctgctgggtttattgttcccttgtcttcttgttactagttccaaaattatattctcactttcttccagggttcttggctgcctaactgatcaattcttttttggtcagagttatggatgaattttattggcttcgtacttttccaaaatttcaaccatgagcctatagggttgtatatataaatttttagtagagacaaggtcttactgtgttgcccaggctgatctcgaactcctgagctcaatcaatccttctgccttggtctcccgaagtgctgggattacaggtgtaagccaccatgcctggccatatattactttgtaaaatgaacaaagttattaattgaaaagcatgaaggtggtgaggatgatagctttgcttattgctttttcagaggtgggtcaagagttcttatgatatgtcttttaaattctagaataatacctacagatttctctttacatcttgattctgtacaaatttgtgtggtttaaaaaaatgagagagttctctccacttctttggtttctttaggcagtaagtgacaaactctcatagcaatacttcatctactttgctttcctttatatttgcacccaaatttcttcattctctcacgcatatatctcttgtagtagattgtttggacaaagggcaccttgaactggcagccttgcattctgcttgcctgcccaggcttggtcctgtaaggagacttgtcctttctttttgtttgttttttgagatagggtcttgctctgatgtccaggctggagtgcagttgtgcatcacagctcactgcagcctcaaactcctgggctaaagtgatcctcctgtctcagcctctcaagtagctgggactgcaggcacacaccaccatgcctggctagtttttttgcagagatgaggtcttgctttgttgcccaggctggtctcaactcctgacctcaagcgatcctcctgcttcagcctccgaaactgttgggattacaggtgtgagccaccatgcctgactgatttgttccttttggtggtcaatcttggttcagtagtatataaatttagagtgctgctgtattttgagcagctgctctgtcatatgagcttgaaatattgggttctatgctgcttctatgttgtgtaagtctccaaactgaaaggatttgtgactttaaaaaatgcccacttttgctcatattttttgtttcctttatttgtttggcacttgttttcacagcggtgacttcagagcacaattactgagaaaccttgagtgttgatgtaaatcctccactgggttctactattacatacatcttcgtaactaggtaaacttccaggagtcactgaaatttggtatctgtaaatgaaaaattatatcaaatacagataccagtgaaattgctagatttcattgatgatttcagttcagtattctaaagtctggatgtcacttagtacttggcaggattgcaaagcaatgacatatgtgcatgcaggtagttttaattcaagccaattgtgagaaggatgttttattggtataagatcagtgtagtgttgagttggttgtggttttcaattgctgcttttgttttggttttaaattataaattagttcatttgtctttatcatcagtttacagttgcattgtgtcatgtgcatttaacttatactaattcaagtctcaatgtttgcttaaaaataattaacaatatgtatttttttcatgcaacatctccttaaatacaggccagatgcgtttcttctggtattcaaccatagaaacagcaatcccttccaatgctgcaggaaaattggcagggttaggctttgtgaaaggtaatgcagcactcagaaaaccacatgtgcttactgtgtgtgctatttaagtaattttcaaggataattttgtcttaaccttagccttgattttagaagccaagccttgcctaaaaggtgactccgtgcagtttgtggagagttctttggccagatctataggatgtagtgctgtgtttttagcatcagtagtgctttggagttataatttcctaataatgagaattgaagtcaggtatgttttgctgttaaaatatgactcatttgtgactctgtttctaaataggtgtgtattttctcccctctgtttacgtggtgatagtccatttttatcactgagtttgttctagtggaaagcagtagtgggtgagaaatgtggactgtgtttagtaacttggaaagccactggcttaaagtaaagcacattttatttcccagaggtgggagtccttgggggtagtgataatgttggtttacttctgaacatttatccaactaatcagtgatggaattaagtctctattattctttcatattatgaaagcttctaattgaaaatgcaaaacaattatgaggcactttaaccccatcaagtttatgagaagaacattaagtgcctagtggatgtttgcccaaaggacccaagtgggcaattcacaaaggagggaattaaccagtaaaaagccacagaaaagcaccgaataaacctagtcttcagagactcaaaagttaaaatattatcctatatcctgttaaattggcaaaaccaaaaatgattaacatacctgacgctgcaaagtcacagtggcctggtgcatttggacgttgttggtgatgttgtgtaaaagactgcatcttctcggaacagcaatttggcatgattatcaagatctacaaaaatgttcatgcccttgcagtcctctgtaatacttgttatccctagggaactgaaattatgggtaaggatattcagtcccacattatttaatttccgaaaccattagaatagcttcagaagttcaacaagaggaaaatggtgaagtcagccacggttattcattagaagaaacaacatagagtctatatagcagaatgaaacatgcttgtactaggccaagtgaaaaaaggtaaaacattaaatgaacactgatgagaacaaggttaaacatgttataactaacataatatctaagtgttattagttgtggggcaagcgtttatagatgtattttctctttttttgtttataattaaattcctcatcaaagtaaagagaacattaaagaattagataaggctatggtaggatgaaaatgagatgctgggatgactttgttttaaatccaaggagatgtgtcagctgtttttggtgtgccgtgtggttctacaaactgctcatttgctgtgtaaatggatgtagctttccaagatgcctgggtatgaatgagaagtaattttggtaaagtaacatgttaagggcatattttaaagttcacattccatctgctgagtgttctgtatttgcaaaggtatttattacaggctttcttgctccgttgagaatacaagctatagaaccatgtagaaatagttttttttttttttttttttttttagatggagtcttgctgtgtcacccaggctggagtgcagtggtgcgatctcggctcactgcaacctctgcctcccgggttcaagcaattctcctgcctcagcctcccgagtagctggagttacaggcgtccaccaccacgcttggctaatttttttgtatttttagtagagacagggtttctctatgttggccaggctggtctcgaactcctgagctcaagtaatccacccgcctcagcctcccaaagtgctgggattacaggcgtgagccaccatgcccggcgtgtattcctcattttaaagctttagatcatttgtatttactttgatttaaagatactgtcttacatttgatattgtcagttggtatcaacatttaaaaacaggtttacaattgataatgagaaaataacttttattcgaggaatgcaagtccttttattttttatttgtttttgagatggagtcttgctctgtcacccaggctgaagtagctgggattacagggggccttgctaattttttgtatttttagtagagacgggctttcactatgttggccaggctggtctcgaactcctgagctcaagtgatccacccgcctcagcctcccaaagtccggggattacaggtgtgagccaccacgcccagtgagcttgggttttctgctatagaactgaccagggcattctggatttgtgagtgaaagcaggaacccctggaggggtgcatcttgcattctgcttgttgggcgagatgaatgtaggccactctaccttccagactgcagaacttccttggtatttacctttgtgaaagggatccacaaatgactttttacccctgccaggggttgatggaagttgtttccaggtgtgacccatcttcattggcttatcctggcgagctgttaggaaaaagtgtcattttaacttgctgtattcctctgaagctccagaatacaagatctgagctcactctgttgaaaaactcctttgtttctacctgaaagcacaggatgttcatttctatcagatcagttcttttctgtataccagcctgaacatgtgtgtgtctttgtctaagcacctcttgcttcataagatacaccaccaaattgaaaagagttagtgacaactgttccttggctggcatcaaaaccagacaccaaagaaaagccagcaagtaattttgtaagactaggtcgggctgaccgacgtcatttttctttctcagttttgtgtaacttttctgttttaaaaaattgttttgcattaacacgctgacagaaatatgctgctaatgacatagtcatgatcttgatgatggtgataataactgtagccagccttccttcactctttgctccccatgtgccaggcactatgctacacgtgggacccctttaatctcacagtgatcctgtgtggggggcatagttgttgctgttacctcagatgaagaggggaggctgagcaatgttgagtcaaaccacagggacaggcagagccacgttctgagctgcaccgtctttcttcctgatgtaaccattgtgcccagcacatttagcatcaccatttgctttcaaaagccagaacattttaatcagaggaatgcaaacttttaaaagacattatgaatttactttttgtgcagtttcctgatgaaaatcacagggcttgcatgttttcaagtgaccaattttaatactaggttggtattcttccttccctccttcctcttgtctctccgtctttcccttttatgtcttccatcacagggagttctgcatctccgttgcagaacaaccctgtagacttttagggttttgagttcccagaggagcatctcaaagcctttccaaatccaatgatgtcagaccttaaagatcacggggcccagggctggcaaatccatggcctcactttgctgcccacctttccgggtctgtcatggaaactgagaacagggcacatccctgtctggagtcttggaatctctacatcattgcaggtgatacccctaggaaactggaacttaagatacaatttatctgcctttcctaatttactctgaaagcaaaagttctagattagattcctgtggtccgtggtgggagagtcatctgtccaaggccacataccttgtaagtggcaggtgagtcttgactgcaaggctagcgttttctgctctgccgggacaccttgattttctcagaatgcaggtccagcgcaagagtttcctgctcagaaatgcccatggctccctttcacttacagttcttcctgaccctcagggcctctaggatgaaaagtctgggagcaagttacttcatcacatccagataacccttttatgtgcagggtgtttggttggaggtgctgccctcaaggcgtttacaggctagccgagggctcgaggtgtcatctccgtttaagaatgcttagaataccaggcaaaaagtgatagttttaatcagcagtaagaagtgcttttgcagttcaaaggtgtgagatgatcatggattggccataaccaggaaagacttttgggaggagatggcattgactagatcttcatagaaggacagatgtgtgggcatggtgactgaaacagcatgaagggtgacttgtgtctaaggagcaggaaacatttggctgggtgatgtggtctgcaggcagaagataaggctaggaaatgactgtcccggagggtcttggatgaagggccatccgctaatactgaggaagtcattgggagccagtgaaaatttttgagcagggaaattggggctgtattttaaccagatggagctggtttgatggtaagggtgtactagagaaggggaaccccacattctgaattaatgtcacttaggaaaggaccccttgtaagtatgaaatggttataattgtgtgtgtgtgtgtatgaatttgagaaaagtgtataactgaagaacactaggtatggttttcttgtttttttttttgttttgtttttttgttcgtttgtttgtttgtttgtttttttaaagacatggtctctctctccctctgttgcccaggctggtgtgcagtggcatgatcacggtcactgaagccttgacctcctgggctcaagtgatcctcccacttcagcctcctgagtagctgtgactacaggaacgtgccactatgtgccaggctaatttttgtattttttatggagacaggtttttgccgtgttgcccaagctggtgtcggactcctggactcaagtgatccacctgcctcagcctcccaaagtgccgggaggtatggttttagacaaagaaaaaaaaaattacagtaatgattttcacctggagaggataaatgggaggaggtgggctgaattcagggctgactgtgttttttggcagtgtcgatttggtgttcagttttcagaggcattccgttaagccatttggaggcagtattttaagtgagaatgtggctataggggtgggcagataagcttgtgactgattcggtcagggtgttggtaggcagacctagccctggtggtcgccgtaccggtggtgctcagtatccgtggaggtctgccagcatcctagaagccctgggggttggctgtgccatcagccctgtgcagacagctgcaaagcatgacttggggcagaaggggccaccttgtttatgtggagggtgaaggtttgctgacagtgacaccagcttgagattgagagacggtggggtaatggaattcattcagttttggcaggaggcagaagtcaagggagtttattgatccgagccttgagagggcgggtaatgagcagtgtatcttaggtgggctgagcggtaaagtttgggcaccgagggtgacgtgaactggagttcggcgctgggaactggatattcacctcccttcagagctctgtcaccatgcctggggtggagccgcaccctgagtgcgctcagcagggagtggcatgtgtgcagggcttcagccagggctggcagccaaggaccaagccatttgcctggctccaccatccagagtgcagagaagaaaagtgggccagagccaagtaagttttcccttctctttttcactctgctgtgacaccctcagagtgttgagtaatagggcttgtgaaaggaaaataaatcttgggggccccaaaatcactaagcagggaaaaggcaagctgggaactgctcagggcaaacctgccgcccattctattcaaagtcacccctctgctcacagagataaatgtgtatctgattgcctcctttggagaagctaatcagaaactcaaaagaatgcaaccatttgtctcttatcttttatctacctgtgacctggaagccccttcccaacttccagttgtcccgcctttgcttcgagttgtcccgcctttgcttcgagttgtcccgcctttgcttcgagttatcccgcctttccagatggaaccaatgttcatcttacatatattgattgatgtctcatgtctccctaaaatgtataaaaccaagttgtgctctgaccaccttgggcacttgtcatcaggacctcccgaggctgtgtcacaggtgtgcatccttaactttgacaaaataaacttcctaaattgaccgagatctgtctcagatttttggagttcacaggctcatgtatggagaacttggacagtagaatatccttagagcactgaagtctagttaagtgaggactgacaacgtaaggagatgttgaaaaatagtttcaaagaagaaaaaattgcacatatgtttttgaaaacaaactcatgcttcttatagaaagattagaatctcattgcttaacatttatattttcatccctttaaaaatctcttttttttttgagacagagtctcactgttacccaggctggggtgcagtgtcacaatcttggcccactgccaccacagcctcccaagtagctgggattacaagggtgcgccaccatgtccagacaatatttttgtattttaccgtctgtactaaaaatacaaaaatattagcccagggtggtggcgcgtgcctgtaatcccagctactcaggaggctgaggcaggagaatcgcatgaacccaggaggcggaggctgcagtgagcccagattatgccactgctctccagtctgggtgacagagcaagactccatctcaaaaaacaaacaaacagacaaagaaacaaacagaagaaaggctgtaattgtatagtcccaccagcataccaaagtctttttggaagtaacctctcattagctcaattaatgaggttgaattaaaaagtcacggagtccgtcaggctgctgagtgttctgggcactctgtgagggccagttaataggatgtgcacctcctgagctgtgttcctttctcccctaccctgagcacacgtttcagaggaacatggcgagttctcaggtagcgacgcttcccagctgctgtgccatcaggtggcactccacctgtccctctctatctcgtgatcttgttttattttcttcagcgtgtttcttactaactgaaattatcttacatgtttgactttgtctcattgcctagactcccagctctgttaaaacaagcactttgtttttctagttcatgctgaatccccagccttgggcccatagtgggtgctgaatatatgttcattgcttgaactccagagggtttctgtagcctctgtctccagtttgccccaagccactgtctcaggccatctttatgaatgacactgcaggagtcctgggcgctgcagctcctgtttagggatgtgctgcttgtgggacctcttctccctgggatgcctcctttctcgctgagtctaggtctgaggacatgcggattctttaggacctaactcagttgctggtttcttccacaaaacctttcctaacatcctaacaggctctagtgcttgcctgtttgagcctccgaaagtcactgtggttatcttaaagatgccttacaccacgttcctgcgttgtaattgtgtgcatagttgtctgacggtaggtccttttgagtcagggagtcccttgaattttttcctcaaaggcctttgtttctatacccctgctttttttcctcctctgaaaattttctcaacatctctcatcttagatcttctgggtcttttttttttttttttttttgtcaattaagtattttaaaaatattagagctggtaggaatcttggctgatgtctagtctcattagaatgtgtatctgtactgtgatttttccattaacttttgcctcaggagtttcgaatcagctttggggctagtagcaaatgtagataattgtttcctgattaggagtcagatttgacacttccttattgaaatgttttgctgtctgggatatgaagcagatggtagcttctggcagagcagatgtctgtgttgaatcagagtattttaaatctgctcttgtaccttgaagtgtttcccttggcaaatacccacttctgacctgctagtgtcagctttgggtgatccccccacgtcccccatacaggattacacagatccttactaagaagtctgataaaatacaagtaataaaacataatttagtattggttaatccatgatgctttattctgatgcaagtacaacgtgttgattgacttggtaaccagtgaatcattaataaatgcactgttaacttggactgttgattcataacactaaaaggagtaatttcaataaaagatagtttgattcttcagattccctattggggtggttcagagcacagactgtaggtaggctgtctggatttgaaattcagctctgtgtaatctttaggcaaattacctaacattgcagtacctcagtttcctcatctgtggaatggggtgtgtgtgtaataatagtacttacttttaggattgaatgaggatcacatgagttaataaatgaaaattgttgagaatgttccgtggctcacaatccctgcagagatgttagccactttaatactaccattaaggtctcttcttccttctcctctgagaaataagcgcttaacgatatcactgctcctgtttttagtacaaaggctggatgaagcccaaatctttttttttttttgagtcttactctgttgcccaggctggagtgcagtggtgtgatctcagcttactgcaatttctgcctcctaggttcaagtgattctcctgtgtcagcctcccgagtagctgggatgacaggtatgcaccactatgcctggctaatttttgtatttttagtagagacggggtttcaccatgtgggccagggtggtctcaaattcctgacctcaggtgatctacccgcctcagcctcccaaagtgctgggattacaggtgtgagccactgcacctggccgaagaagcccaaatcttaagaagaaatgctctactcaaaaccatgcctggtttatgtaatgtggctttctttctcctgagctgggggttgcactagctgttacctgggacacaaatagtatggatggaatgctataaatcggaagtatgggtttttggacatcttgcttagatttgagctttcacccttaaactttgtatttttctttggacggaagtattggataaaggtaccagaaaatcagtgcgttgaatttgaactgtatctttttgggggaaggggcaggtgtgtctttctctcaatactatgtttacttttggctctcgtataccaaaaggaagggaggatgctaaagtctaatagttggcaaatagctgtctttcctgctgtgggtggcactgagaaggatgagacctaatcctaacttcgtaaacttttcatcttataggaaggtgaagtacatagattatggacagtgcaggctgtttatgaagataaatgttttcatcttaacagtactttgagcactgtgtgctgggctaatgagaaacacaagacagccaggtgcttatctataagagctgtctcagaaaaggtggttcagagccaacttgtgagggaaaccctgctcccactcctgggctcagttttgccttcattttctttccagtcaacagttcccaccatttacctcttagcacactacccttaacacacaccaagctatttttttttttagtaatgtttcattatggaaattttcaaagtaaacagagagtagaataatgagcactcaggcacccaccactcagctccagcagctgccggcacagacacatggccggtcttgtttatctgtaactcccttccccacttcctccagtacctgctggattagttcaaagcaaatcccccaaaatatatcatttttcctatagattcttctacatgtatcactcaaagatgaggaaggactcttaaggaattctattttaaactgtattttccaaccaccattttttattcaaggagattgcattcattggctaaagtacgtaggcgggccataacatgtcaggtgagtgtataattaggagatcttatatttaatgagcaccctgcatttagaatgccttccttcagaagtttcaaagaaatcctaggttgcccattttccttaaggtcttgcagacaaactcttgttgattaagaaatttctattgggtttcttgagaatcataaagctgcaataatatatgaccagtgcctgggtcatcttcccaactagcatgcaggacggtgatgcaccttagtccttgaggaagccaggtatgagcagtcccacggtgttgtacaaattccgttttctttttatgccattgagtataaaagcttgggaaccagtgcctatttattggtaaactaagtgaaaatccagtgacttcactgacatatttggatcttattagtatatggctgggaggagattaagtcatttgaatttatttcaattctgaaaagaaagtgctgcctaaaaattattatagtatttgggaatatttctacccagtatacatggtggcagaaaatcacataatctgtgttgtggcaaaagcattgaataggaagccaggagatgtgggttccagtacccacatgccgtctctcctgagtacccaggtggccgtgggctagacacagctgcaggtgtctagtttgtaggtgatgggttagaaatgggctgtaaatgagatgaagattgctttggccttggtggggtggagtggtgacatttatccttaccttaaagctgataagttcatggtgatggttctcagccccatatgactcaacatctctattttttcttttaattttgaaataattacagatttgcaggaagttgcaatgatacagggaatgaccctgtgtctttctcccaccttcccccagaggacacaggttggcaagctgatgcaggtgggtggcattgccacttaatatcacagacaaccttgctgcagccctcagctcttcaaaaatagtgacctttccttagaaagttactatttcaggaatgcattgcccatgcactgtcaacactgggcaaaaatactttgtgtttatgagctcaaggctcagaaaattatagacaaatttctgacccgagtgtctggtgggacctttagatattgaagacaatttcttccttttgtgggactgtcccacacattgcagaatgtttagaggtccttgacctccgccactaaataccagcagtgacctccagtcattgtgacaacaaaatttccaaaatgtcctctgggcagtggttctgcccctttaagaactactaagatggtgaacaaatacgccttctgatagaatctgtccctcagtgcccccactggcatgaaaattctcagtgtatggagtgttgatttgaatcatgtgataatgttgatggtctgatgtacaatgtttcttattcttaaaacataccaggtgtgtattatatttgcaaagtaaatgtagtgcttctagtggtagctggtaggtttgctggtagctgaatgtgggaaccctagaagtcatgtctatggctcatcttcactgtgagtgcagagtcctgccagcccagcacaaatggctagtgtttcttcatcagcaacagtcattttccccgactcccagtctccaatacatcaagactattttgtggaacgtaagagtttttgtcaagtatttaacatcatatagatagagccttttaaaaagtaaacttttggctgggtgcagtggttcacacctttaatcctagcactttgggaggctgaggctggaggattgcttgagtccgggagttcaagaccagcctgggcaacctagtgggaccccatctctacaaaaaaaaaaaaaaaaaaaagtcaggcatggtggcatgtgtctgtgttcccagctgaaggctgggatgggaggaaggctgaggtgggaggatcacctgagcctgggaggttgagtctgcagtgagttgtgatcgtgttactgtactccagcctgggcgacagagtgagaccccatctctctctctctctctctctctctgtctctctgtctctttgtctctctctctctccctctccctccctgcctctctctttctcacacacaaaaaagtaaactgtttagtaaagtgggttgataaatgttttagggttttgttttagaacctgaacctattgtaggagtgacctgggtgactttcaggtttggaaacagcattagagtttctatttatgtgattttcttttttaaagaccaacttatttcaatgtcaataaaagtatgggtgtaaactagggcttcaaaatagcttcgtgaaataaaattgaatgctcttttgtggctgtgttcaaatcacgtatacctgtatttatattttatatatatgtatttgtatttatatctatgttatgtttatatgtgtgtaagcactttttctaatcccatccttgacacatcatcctccctggttcgtttatcatgatatacataatttttttggtggctgtactttgttcctttaggactcatcgttttcttaagtagaacaccatagccctttctttgtagaagtatagtgcactgcagaacataaaatactacaaaaagataatggaaggcaggcatttgtctttgcttaacattgattctccagggtaatctgctcattttaatcatcaagggaggaatgctgaatcattttatgtgagttagtagaagaaataggccattatttgccactggaaatctcccaggaattttataacttggctatatttctaaaatgtttcactaattactttttaggactgaaaaataatcaatctgatttgttttgttttaaactagcctagataccagaatatgtgtataattttttttatgtttgaaagataatccaaatggggattccttttattttttgacagagtctcgctgtgttacccaggctggagtgcagtggtgtgattgtggttcactgcaacctcagcctcctgggttcaagtgattctcctgcctcagcctcccgagtagctgggactatgggtacacgcaaccacacctggctaatttttgtatttttagtagagatggaagttcaccatgttggccaggctggtctcaaactcctgacttcaagtgatttgcctgcctcagcctcccagagtgctgagataataggcatgagccactgtgcctgaccccttttgtttttttaaggctaggtacttgaatatatttgtgtttcaccccactttttttttgtttttggttgaattttatgtccaaataatgttatatgttctgtgacaggatcatatataaagaaatatattaattatccaatttaatttaatttatttattgcagtataacacattatcccaaaacttagtggtttaaaaaacagacatttactgactcatagtttctgtgggccaggacttgaggtgtgtgttagttggatctccacggctgtctgtctcaggttgcagtcatctgaaggctggagcagggctgggcattctgcttccaagcttattcaggtggttgttgacaggaggtgtcaactcctcaccacatgcagctcctaatctgagagagagccagtgagtgcctaaaacagaaggcacatgctctttataaactaatttggaagcaacatcctgtcacttctgctattatattagaagtagaatggggctgggcacagtgcacatgcctgtaatcccagcgctttgggaggctgaggcgggcagatcacttgaggtcaggagttctagaaagcctggccaacaaggtgaaacgatcttctctattaaagatacaaaaattagccgggcatggtggcaggtgcctgtaatcccaggtacttgggaagctgaggcacaagaatcacttgaacccaggaggtggaggttacagtgagcagagatcctaccactgcactccagcctgggtggcacagtgagaccctgtctcaaaacaaacaaaaaaagtagtagattgggaccaggcataatggctcatgtctgtaatcgcagcacttttggaggccaaggtgggaggatcacttgagtccaggagctggagaccggcctgggcaacataataaatactgtttctacaccgctgcgctgtcccccacaccccgcctgccaaaaaaaggtagattggggaggggtttacacagagacataaaaaccagaagatagggagatcattttagaggctgcctcccacattgagattacttacataatatagttggctaagattggaattatactaaacttgttgaaacctatatacctagtggcattgtgaaagattttgacaggtaaagtcatgtgcaaatacgaataaaggaattccactccccaaaacgaagtatttttagattcataagtgttctcagctaataaagtagacaaaaatcagaaagcgcagcagtatgtgcagagcttttcacatgatattaaaaattaagccataaggcagtttgtctcttattccacatgtggaataaagtgacttgtgaaatgccatggtgggtgcctttattcaagaatcctcttcagtagtatttttaccgcagcacacacgttatgctggctgaaatccttgtgcgtagcatgttgcctgctgaaaataattctgccttggccttaggcgatgtgctgttgaattggctgcctcaaattgtccctctcacttcctgttttatatgaatactttttctttgctctcttttacttgcttaaaatcggaatgtttgattgctatgtgcatcatccttcagtgaaatgtttgaggtggaaagttctagaagtttctttttcccttttgttgatgcgtggaatagataccagtcacttttagaaatacttgggtggttctagctaaaatgtgatattctactttagcaaggccacttgtgaaacagttctcaagagcacagtgtatctagtaagtgcttactcattgattaaatattatgtacattgtttttcttctaatgtgataggaccatttaggacctaagtttaaagatttacacgtgtgaataaaatccgttgcataccctgttctgagccagttttctatgccgtagtatatttctttggttcctattagaaaaaaaaaagtgcttcatatccaattctcattgagttgtatctattctcagtattgagtttttttttctttttttctttttaaaaaagtttcagtattgaattttgattactggaagccatttaattttgtcttcatttattttagttttcatttatcttcagtgcctatgattctgtagctttttccttccgcctctttctattctttttgtgcagcaaaaatcatcctccatgtcatagtctttgtttgcataacctgttctgtctgacacaaccatctatcatgacctaatttagccgtttcagtcacacctagtataatttataccatgggggaatttcctgtgctgttaaaccttccttgtcatccgtcaccaacttaaggagcttccaggtgtgccctttcacagggtgggcttggacttttctagttcttgcattttaggtaggagctgttctcaggaatttttttcttctgtgaatgagtaaagtgaaattaatccaaactcagtgcttccaggattaaaacacatttccatattacactgtctgtaagttgaagggccttagtgcttgagtgccccaactagaaaatgactcatcatgaggtgtccttctgtagacagtgtgacgtgataagaggaagaaggaaattgtgggcaacacagtgacttcccagtgacaattcacttgcctctcctaatatccttcattccaaagctgctcttctgcagatggttatgaggcatagtgtggtggagtggaaagactttggaataatgctctgccactttctagctgtgttatttggaaaaattgcttacctctccctgaacctgggtttccttatctgtaaaatggggagcatactacctttcttgaagggatttgttaaaaagaatgtgtaaaataacatatagcagtggcatgtggaaattgttggatactccaaaaaagttgatgtgattttaaaactttttctttactcagctaatgtttatcctagcttttctcatgttagtactaagccctgattgcatgaggttttcttaaagtggcccatgtagataattatagcattttctagcatttcatagtttaggccaatattggattacagaatgaatactttgagtgcttgcaaaggggtcaggaacagatgcatttttaggagtatcaaagtctgccaataaggaagctggtttaggaaattaaattatatgcccaaacattttatgtctacagatgcaggtttatctagaagagaggagaattttctaatagtatactgaagcatcatcagcagaacccttccagtgcaaggacaaaatggggcatcgtttactctgaattttatgaccagcggcagaaaaatgtgtcactgatgaggttaactggggaccagaatcctgggcatggtcctagttggcatgagtagaatttgcaatggttttcaggatgtattttcttcttttttcttttcttttctttttttttttcttggagacaggtttcgcccagtggcacgatcttggctcattgcaacctctgcctcccttgttcaagcgattctcccacctcagcctcccgagtagctgggtttataggcgtgagccaccgtgcctggctaatttttttgtatttttagtagagatgtggttttgccatgttggttggccaggttgctctcgaactcctggcctcaagtgatctgcctgccttggcctcccaaaatgttgggattacaggcatgagccaccgcacccggccaggacatgttttcttaaagacaatttaagagtcaggaagtggaaaaggaaagacaggtagatgaaggacaggctgtagcatgtcacacctcacagttatttgcaactttctgttaaccagatactgtgttagatgagaataagaacttaaattttttatttttagtgctgactagtaattaactataattttcagtcatgatcactgtgtttgaacctcctgtgcagatattgtggaaatatgtattttagatgtgaggaagttctaatataaatgaaggctctaagtaaagaaaaagatgcaaaatgctgtcatagacttcgaaaacagatttggataaaaaacattgcacctaccagaggaatcaaggagaaatttttcctcacagatattcaagacattatgttatttatcttgtttatgactttagaacctttttttagggggatgacagtaccttttggtgatttgagtctaaaatttgaaactaagattcatgcagaaaagtaaaagaagaaaattttcggagaagaaagcagtggttgaaaaatctgttagcagtgttcccttttgtcttttcagcctgttcaccaggaactcggagctttgcactgtgattattttattggttcaaaggacagagattgtctttaaaatgatgaatggctttgattatgtgtagtggctcacacctgtaatcccagacttaaggaggctgaggcgggaggattgcttgatgctagcagtttgaggccagtttgggcaatgtagtgagaccccatctctataaaaagtaaaaaaactagtcaagtgtggtggtgcatgcctgtagtcccagctacttgaggctgaggcaggaagatcacttgagctcaggcgttcaggactaccactacgccacagcctaggcaacagagctgactctttttttttttttttttttttataagaaaaaaaaaaaaggtgcattggctgggcgcggtggctcaagcctgtaatcccagcactttgggaggccgaggcgggcagatcatgaggtcaggagatcaagaccatcctggctaacacgctgaaaccccgtctctactaaaaacacaaaaaattagccaggtgtggtggcgggtgcctgtagtcccagctactcaggaggctgaggcaggagaatggcgtgaacccaggaggtggagcttgcagtgagctgagatcgtgccactgcactccagtctgggcagcagagtaagactccgtctcaaaaaaaaaaaaaaaaaaaaaggtgcatttttttgccatggggagattggaggagggagggtgaggggtactgccaacctgtacagtgatttcaacccagattagcatcctagcccctctctctgctggtttggtttaacaacttattgtaagtttggtgctcctgtgtgagactagagtaaaggaccatgggcatcttcatggttgttgggaagctgttagtccccagaactagagcaagtggggccagtaggtacaattctcagatatggtggcctttgaagcaggtaagcacagcctgtcttgggccttaacattaatgcctgtcttgttgatttgtcattatcattttagttttgtaattggttgattgagacagaaggggaaaaatggcaaaaaaaagcatgttatatatgcttaggatggaatgttttctttttcccattcctcatctcaattcccagtttaatgccaaatctttgagtatccatattcttgaggagagactgttcttggaaatcatttgatgagaaaactgctgagaagctgatcagatgccaacatcagagggcagtttaggttatctgctaactacaagcagatccagatcctagtagcactgagcatagacagacaccaagttatgacctctcaagttgctagttgagcctcatgaaaggaagatttgctgtgggagggcatacccttgcactgggctcttgtgatcggcccagcaattctttttctgttattttttttgagacagagtttctctcctgtcacccaggctggagtgtagcagtgcaatctcagctcactgcaacctctgcttccctggctcaagcgattttcctgcctcagcctcctcagtagctgggattacgggtgcatgccaccacgcccggctaattttttttttttttttaatttttagtagagacggggtttcaccatgttggccagactggtctcgagctcctgacctcaagtgatctgcccgcctcagcctcccaaaatgctgggatcacaggcatgagccaccgcgcccagcctcggcccagcaattcttcttgaagctgtcagtcatcctttgcctcattgaaaatgtcgatttttggctcactctgcctgttttaaggaccttggaaaagtgacaatctcacattgaccaaaactttccatttgctcataagctttaaggacttcttacacgtagtcttgtgtccttgtggtcaaggatgtaggtccctgcttataagccccacctcatgttctcatcactgttgacatcatggctttagctgaagtgtctctttctgttattagttactcataaatgtcgtttattaacaggaggaaggttattcttagaattatttctgatgaggtatttgtatgtgtatagtttaagtcaggggattgtctgtaatccaacgcagtctgaaatagtttttggaggttggcatagtttcatttcaccctgtccaatttgttcagagaagcctggaatttttacatgttagtaaaagaaagaaaatctgcctgatttaaaaattagtggcttttaacaattgtatctatgatatgaaaaggagagatttgttgcaacaaaagactttctattaataaagtatttgagtattttctgtgtagccatgtgggtgtgtacacgataggtaaatgtaaaatatgatccttgcttttaaagaacttgcttatttgggaaagtacaggacaaagcacgtgatgtttcataagacgggttgtagaaagagctacttatgacttgaaagtgtttttattggtaaggtaaatagatgcttgtatgtttctcaataaattaatctagcagtataaaaaattccaggccaggcatggtggttcatgcctgtaatcccagcactttgggaggctgaggcaagaggattgcttgaggccaggagttcaaatccagcctggataacatagcaagatcccatctctacgaaaagtaaaattagccacatatggtggcatgtgtttatagtcccagctattcaggaggctgagatgagaggatcacctgacccaggaggctgcagtgagctatgactgcatcagtgcacctccagcctgggcaacaaggagacgatgtctctaaaaaaaaaaaaataaataaaaccagaattccatatgttgtctgatctacgatgactatttttgttttttctacgttatcataaaaaacacttattcaggggaagccactttaaaagtatcctagatgagaactgtgtgctcctttttgttttaaggttgtgtgttctcccttgtcctttccctgactccctgcatactttgagatggcttgtgcagccccggcttttgcttggcatactcttcctgtctgtgattctctgcttctctccatggctggatttgctggtctagagatacaagaagatttgaaacctatgtcctcttggattttattaatcaaacatatgcatgtccagaattcacacaaccctctgccatgccctccagggatgggctactgggaggatatttttatcaataagtaggctaaatatttatttttatcccactgggtggtttcacaggcatcagcaaaatacaaaattgcgttattcaccagaacatgagctactttctgtgttgtccatgtggcaaggtctttagaaatatttgtgtgggcctttgccatgttaaatggctgtattccaaggcttcatttgtggtggtctagtcttttgtaggaggatagtaaggacgaaatgaattggtgtcttccagcagtcagatgtggcacacagggctcagggcttgcaccagtcgtctgcctgttcttcaaggtttgcctggagcttatttgccagcttctccaagggtgtccccagctcttagtttgcttttccatttgtcagtccaagtgcccttggggatagagtgtcatcccctttggctcctcatgtgggcatgtatgaagaagagagacttcgtttgtacacacagcaatcaggacccctgctggagctggagaatcgaggtgcttttcagaccaatcctgaggccctgtccttggaactgaaacaacaggctgagatgactgaagtgcattaaggaggaggctttagcctgctgccttggctgttttcttccattagaaaacatctcatgaatggagcatttggaaaaacaggtagttttagaaaaagagaatttccactcagactttgagaccaatctctgtaattgttttggtagggtaaggataggctttcttgaaacactagcctttagctgaggtattcgcacacagcccctgtctctgcataaggagataataaccccaaatcaaaggactgtcttctgttaattactaaattcccatttttccactttaagttgtgtggctggtaatagcgtccgccttctgatataagtcatagcatgcaacatgcactttgcaagtgcattttgcttgaatattttgcaaagatattctattgaattgagaggcagcaagtatttgatgtaatgattacacttgatcacacaaaaacacttcacagtgccatggctggtcttcatagtagtcagctcttgactttgcttctgtttttttttttttctccccacaagactgttagcttttgctgtggcttcaggagcatttacatgtcttaaaagcttataaataatataaaaggctgactgtgttagtagtgcagtagtcagtgcataatgccaaattggtagtgatgtctgcacgacatgctgacttgaataagttattttcaagttgtctcattaaggtttgaactggggatgggacagagatagcctttatcacatatttctttttaatttttatcttactttttttttttttaagctaaaggcaaaaagaatgcacatacttattttaatgtgattagaagatgagttgttccctggtaagcttgacccaccagtatgtgacagttttgcagcaaccttagaagctgggtttttctcatcccacagaaaacccccccacaaaaatacattgttattctgtaagaaaatatgactaaattatcatgtactgagaaaagcattaggttaacaaattaggaaaactatgtcttagatgtacaaccaactttacttcccgttctctggtgggcaggcctatacaaacctactcgcaaagtccgaggaagctgagaggctaaagaaagaggctcacaattccagtttctcataaagaaacatttaggttaaggtgaggtggcccaggttggtaatcccagcactttgggaggccaaggctggaggatcacttgaggccaggagtttgagaccagcttgggcaacatagcaagacctcatctctattaaaaaaaaaaaaaaaagctagacaggcatggtgacatacacatgtggtcccagctacttgaggggctgaagtggggggattgcttgagcctgggaagtcgaggctgcagtgaggtatgatggccccacaacactctagcctgggtcatagagcaagaccccatctcaaaaaaagagagaaaggtttaattgggacttaggaacagaagccacgtctgtgtctctgcactacccccagacccagggctgatacactgtggggaaagggtgactctgaagggatgtgtaggacaattaaagtactataatgtcaaggttgtttgacctctgggcagtgccagctcctgcaatagataaacgggaaatcttagaggccttcccagaactggggttaatcagaagtcagcatggcagattaatatctgagatggagttgctttggccactgcacctctctgtcttataagcatggagtatcaagataattgttattttgacccaaatcatcagcacagcaaccaattccatttattaggtaattatgtaccaaatacgaggctatttttttttttattacatttaatacttgtaacagctcagttgagggtattatccccattttgcagctgaatggatggacttaatgggagataagcagcttccctgagacacatcaacagtgtgtggaagtgacgggtgtgaacctggttctgtctgttggcaaaacctgaactgatctctatgcctcccactcctaatatacagtgtaagagagtgtaaataaaacatattcttaggtcatctgggcgcggtggctcacgcctgtaatcacagcactttgggagggtgaggcgggaagatcacttgaggtcaggagttccagaccagcctggccaacatggcaaaaccccgtctctactaaaaatacaaaaactagctgagtgtggtggtgtgtgcctgtaatcccagcaactcaggaggccgaggcaggagaatcacttgaacccggggggcggaggttgcaatgagccaagatcgtgccactgcactccagcctgagcaacagagtgagactccatctcaaaaaaaaaaaaaaattgttatgtcattaccaagaataatccaaattaacattaaaaatgcattaacatttataaaacttaattagttcagagaagaaataaggctccctgcccctaactcctcactcctctcctgtaaatgtaaacatgtaaattgtgccttctgtgttgctttcctgtcctctatagtcttagggtgtgtgtgtgtgtgtgtgtgtgtgtgtgtgtgtgtgtgtgtgtgtgtttgaaagagagaaagaggatgtaactgtaatggtactacaaatgtgtctgtagctttctagaaatggaatttcttgatcattttattttaaaaataatcactcttttctgcttttgcttgaaatgtcctattttccatagattaatatatgtttgaccttttctgaattagatatactgttttatttgtttttttctcttcttctgttttcaatcccaaactggttttaattctaaaaaggtacttccatatcgttttttgttttcataatttttgcgaattttctgcttttattttccaagcttatgactttgactcattttgccaaagtggacccatcccatgaaaacaacacaaattctgttaatttttaaattgagactgcgggttttgtgtgtgtgtgtgtgtgtgtgtgtgtgtgtgtgtgtgtgtactttttttgagagggggtctcgttctgtcgcctaggctggagtgcagtggtgccatcttggctcattgcagccttcgcctattgggctcaagggatcctcccacctcagcctcctgagtagctgggaccacaggcgcacaccaccacacctagctaactttttgtatttttagtagagatggggtttcaccatgttgcgcaggctggtctcaaactcctgaactcaagtgatctgccctcctgcctctcaaagtgctgggattacaggtgtgagccccactgtgcctggccttatatattattttaggagggaactgacatctttcaagtagttacttctgactatccaagaagtccatatatccggcaatacatattaaatgctctttcacttatcttcttttttgtcactttttaaagttctgtatacatcatataagttctatatgtttgctaagtatttcctagggatttaaacttaacattgctattttcagttttttcttattatgttttttaaactggttataatttatatatagtttattattttattatatattttttataaccttcatttttataaccttcaaaactaataatcctcttagttgtatattaattcaagttattttcttgggttttccgagtatgcagttttattgtgtgcaaataataacattgccccctttctgtatttgtagcaaacatttacttctctgtttaattgcactggctagcatttccagaataatgggaaataatcatggtgttaggaagcatctaactacatgcaagacttcatcataatgatttttggtgtcaggacatcatggtctaccataagaacatgtgactgctatatttacaattttggaaacagataaagggaaaataaaagcaaaagtatatggggtgaagtaagagaataggactagaatttggaaagtacataatggacaaatctagtgggaggaaattgaagttgatgggttacgcttcatgccgttagtatttaacagccagttgtgcatcaggtctgacaggtgctacaaagataaggaagataacatccactgtgaagggcctgtggcccaggggcactctgggtgttgatgagtacaactgaggggaacatccttagtgattagtgcagtggtagcccgaatgttataatgtgtcctgagttacagcgtcataggattttattagaaggcaccatcacccacctctactgctgcagtgcctgcactgcagcagggagcgggtgctcaagtctgtcttcatgaatgaagccacttcactgttccttgtggttcttggccagtgttacggaggaggtgagccaggcttttgctggtagagagagtgggagcagggggggatgctgctacttgaagagtttgctacagggggtttgattccagacttcagggcaagtctgttctgtctgaggtgtggagtgcttacagaggagcgaggggtgggaggggaggatgtggaggtgactgagaacagagcttcctttcctttctttttctttttctttttttgagacagagtcttgctctgttgcccaggctggagtgcagtggcctgatcttggctcactgcaacctgcaacctccgcctcccgggctcaatcgattcttgtgcctcagcctcccgagtagctgggattacaggcgcacgccaccacacccagctaattttggtatttttagtagagacagggttttgccgtgttggacaggctggttttgaactcctgacctcaagtgatctgcctgcctcaccctcccaaagtgctgggattacaggcgtgagccaccacgcctggccaagagcagagctttctaagtgatgcagcatggaggggttccggtggctgagatgtggattgcagcccttgatggctggctgacctagacacctcctcccgcattttctgctttttccatgatgttccggacagcaaagtggcttgtcatggtggtaacccccacgtccattcctgtgctccctctctgctccatggctgcctgggtttaggtctccttggttaggaaactgtcgtgtgaccatgcccagctacaaggggagcctggaccagtgagtacaagatttttacttttccagccgctgtaggcaaagaaaggcagggagagagagccttaggagtggatgctgagtcagccagttgcagtgtctgccccagaaccatcctataaaagccattttcaaactttattcattgtatgtgaacatgtttcaacatctttcacaagtggcttttaaatcgttgttagtcatggaagctttgattagatgaactcttgtgagggaacctggcatggtgggcataccacgacaccagctctcagagactcagatggagggagccaggctgggtgtcgtggaagccccttgaagctaagtgaagagggtattggcaaagagtagttgaaaatgaaaacttttcatttttagttgagataagatgtcagtaaaagttaccactatgaggatttggctttgcatttagcgatccatttttgcttttctttttttaaagtaggagaataatatgttttgaacatttagaaatggcctctttattgaaatacataaccttgtgtggtttgggctggtgcttagatcctcaagaagaatttccacatggaaaacgaattgccaccttagtcttctccaaagatgctgtctctctctagagtggctgtctgcagcccctgccgccccagctcccttagaatcgtggctcaaatgatattcctaattcctaaagctaaagggaaaagaaaaaaagccaaaaaagcaaaccagtcagaaaatgtacattagatttttacattgatttccaatgtacaaatttctgttctttataatcttagcagaagccagtatctcagcagaagcagaagcaaatatctttaattgaagatacttggtttccatgataagcagggtttccacaaaaccacatatgagagcaggaaccaatgctgctttctctgccttctaatccccgcagggaagggtcgaggagcagaaatgtggtgaccctgaaccccggcagcctgggtgtccactgcagaagtcagggtgtctcgcctgggcatggctgaaagattgttctccagctgtctagagggagacacggctcccttttagtaaaaatgtcacagaaacttatttatgttttatgttatttccaattgatttattagtagaagcaaataaattcctgtttgtcagaggagattcctggaaacctagaaacttaacacagaaaggaaattgggtatgtacatagctgcttttttgagcgtctttcataattttttatcatttaaaaagtagtgaaatcagtgaagttgacaattttcattacagatgcttgtgattatttctacttgatatgaagctggctacaagtttgggctacttatgggcatatttgcaaaagtacatagaatcttaaatttgagacatttgactttcatggctttaataaatgtgttactattttaaaatagtattaagaaattattattatatttagagacgaggtcttactctgttgcccaggttgagtgcagctgggtgatcatacctcactataaccttgaactcctgggcttaggcaatcctcccgcctcagcctgccgagtagtggtgactgtaggtgtgtgctgccatgcccagctaattttttttttttttaattttgtagagacagaatctcactttgttggccaggctgttcctgaactcctggcctcaagtgatcctcctgctgagattacaggtatgagtcaccgtgcccagccaagaaattatttttgatagtagagttattgtttagtggcttctttgtttcttaatttttttttcttttttgttttttgagatggagtcttgctctgtcgcccaggctggagtgcagcggtgcgatctaggctcactgcaggctccgcctcctggattcacgccattctcctgcctcagcctcccgagtagctgggactacaggcgctcgccaccatgcccggctaattttttgtatttttttagtagaggcggggtttcaccgtgttagccaggatggtctcgatctcctgacctcgtgatctgcgtgccttgacctcccaaagtgctgggattacaggcgtgagccaccgcgcctggccgtttcttaattattttctaagaattactgtgccatttcctttacatagtatggactatagtggcgtgatcatggctcagggctcactgcagcattgaactcctgaaatcacttgtaatcccaaagtgctgggattacaggcatgagccactgtgcccagctacaattttttaagcaatagaaggcctgtccacattgccgagtcttcctttggtgatggttcatctgaggattgcatgcccaaagccctggagtgggaggcttagattcttatcctagcctttcctccaacagtcgacaccccagagcgtgtgtattcatttctttcttccctttcttctctctctctctttccctctctctttctctctctttccctctctctttccctccctcccttcctccctctctttccttcctttccttccttttacttcctttcttttctatcttttgtagatatagggtctttctctgtcatccaagctggagtgtggtggcatgatcatagtacactgcatcctccaactcttgggctctagagattctcctacctcagcctccgaatatctgggactacaggctcatgctaccaagcctggttgatttttaacattttttgtagaaacgagatcttgctttgttgcccaagctggtcgcaaactcctggcctcaagtgatcctcctgccttggcctcccaaagcactgacattacaggtgtgagccactacaaccagccttgtttttcttatttgtaaaacgatgaggttggttgctaggttattgctgttgatttttctggggtcaggccagagactgggttcctgggagaccacagggtccaaggggtggtcgaggatgcagagggtcctagttgcccgagctcctgggtgtgcacccacttccttcagtccactgcagctctttggtcccctgtgattgtgatgaccatctggagagaaggtttctaatctcccctcttatcagacaggacactcagatgagtctgtttttatttaaaattttggcattttgcttatcttggatttttgtgcatcagtttttttgttcaattattacattaaactatttctcttgactactgagattttggtcctcccttaaattttgtgtcagaggcaagtgcctgtagtctcacctctgttccagcccttgtaaacgctatgattccttgtagtttgtcattaaaaatagttatcaaagccaagtaatttggaagttaaatcaagagattccagtgaaacgctggtaagcgatgcctgtttatgctcacttagttgctgggcattagcaggtgtaaaaatctaacaaaaacagctggaaggcagacctcaaagctgctggcagtctctccccttggggacaaaagaagcctttcagctttttcatcttggaaggtaaatcataaacgaccaaatattggattaacttagaaaaagtttttttatttttgagatggtaaatgtaatatccttgctgttgaattcctcttcatggtgactatgtattaaaactgggattttgcatggaaaatatttcaagatttgcatggataatggctaatgtactgtctggcttgttgcattttaactataaaattaagttgttgcgctatttattgttatttctaagggacaccatggagagccatttggccagagggagatgggcggtgaggagcgtggtgactggtctagttggcacagctgagatttttgctgctctagtagtcatctggattggctcaggcctggctgtttgttgcttctttcacgggctcagagtgtctggagatctttttaactagccgagacatgctgttactctgagcaattctccaggcagccatgagtgcaaagggagtctgtgccaggtgcccagcactgctatatatggcagagaagggtggcaggggaggacccaccatgcccttatctgggggctgcagccaggcgtgattgtgggggcagtcacacagcttccgtgtgctctcagaccaaccctgtttttcctctccctcctccaaccttggcattgattttagacagccgatgtgcaggttcaatcttcatgtgaaatggaacaatgacttcaagttcagatacccatcactggcagtgctgtatgtacaatctatcaaggctagttaggatgtctttgtggctcgagaaagcagatttttagatacgggagagtttggttacttgtgtttgtgattctgtgctctctattaattggcatgggattttcggacctgaaatttagtgtagatttcagtttattctgaaagataagtgtgaggttgagatgtggtcttctgtgtgacaggtgctgatttatgttggagtcctattaggatagatgcgtcccacattcagttgtatgtttcttaggtcaatcaaagaaactgatctgaaggtgtaccaccaccttctctcccaagatgacaaagctgtgttgggtcattggttgggagcagtgcagatgagaagacaaatgctgttgacaagttgtgtgtctagttccttaggaaaccagtcacctggtgttgaagacagcagcagaggagtaccgtggcctagcatggagctctgccatgcctttggttctttctgtggacacattttcatggaacctagagattttctggtttggggaaggatacaatggaaaaataattatgagatgatgatgataagatttaattgaatatttgctaagtccagtgcatactattaggccttcaacatatgaatttataatccaatgaattagatattacgttcctttcttacaaaaggacattgaggcttggcgatattaataaatggctgagtggtacttggcacccaagaccgtgtgactccgaagctcctgctttcagtgaaggagcctgtggtaggaacatagggtctgcagtttcagatgttgtggcctgctgtgccttgttggtgattgtagattcttcacgatcaatatggagaaggctgcctgcattgtctcccttcttcttttgaaaaattagtttttacagataattgcaaacaatgcaaaattaaggaatgcaatctctttttgacgttttactccctagtagtgactggtattaaaaagcctccacgcagtacaggatgtgggtagatcaaccctggattggttggttgggatgtgattcattagatcatctatgagattctctgttttttaggtcagagtaattgccattgatcttatgatgcagttctgcttccaggacacttaatgaacacggaaactgaaaagtaaagaacttggcctgtagggtctgtgagacgggaccacccctgggagccgtgttgtgtagaggccatccagccaaggactgcaaacgtggagatctgttgtggcagtggattggattaatctctattaatcagtctattaatctgttgatctctagctgaacaatctcttttgttgaattgttgcattatgatatttatcgtgactactgagattttggtcccccccttacattggtgtcagaggcaagtgcctctgatctcatcccagttcctgtccttgtaaactctgtgattgtttgtagtttgtcattaaaaatagttatcaaaggcaagtaatttggaggtttaattgagtggaggaaacttggaagaaccaagtttcagtagcatgtagctatcacgtgaattttcatcctcccaaggttgtgctggggagattgagacaaaagaagtacaaacaccttgaaaactaaataggcagttcctgtgccaggcaatgggatgggattgtctcattgcttctgagtattgtcgctgaacctgattattatgaatttaccttattgttatattgtacattttaagaaatttttaggtattttatattctaatgcttgcaaaatctggaatcatcctgtgagtttacaaaaaccagtaatggtctttttgaagtactttatcaacttttgttaatttttctgtgttgtatgtgcttcattaacttctgttagactataagagatttctcagtagtgcctactgaatccatacacaatgagggacaataggatcccaggatcatctgctccacagaagcaggtatcacagtggcaccgaccagcatgggaagagtttttgtgctgacagcagggcattctctttgttctgtggtccatttgtagatggctgcgctcctctgcacaggggctgtcgcttctgcatggattggtgtctaaaaaccccacctaaatgagaattagatattccctttcttctttacccagaattttctttttataaataaaaataggctgggcacagtggctcatgcctgtaatcccagcacttttggaggctgaggcaggaggatcgcttaagctcaggagttcaagaccagcctgggcaacatagtgagactgtaccactacaaaaaataaaaaaacttagccagatgtggtggtgcatgcccgtagtccagctactagggaggctgaggtgggaggatcacttgagcccaggaagttgaagctgcagaaggttgtgatcgcaccaccacactccagcctgggcaacagagtgagactcactctctctcaaacaaaaaaaaaaaaaaaaaaaatttggtttacgaaaacacagcagttgacttttccataggcaatttgtaggtttggcattttactgcctttagagatgtagtattgagtatagtctgttagcctgttggtctgttcacccacaaataggccagttccaattagctataatatttgttttagggggaaaaagtcttatgtaaacaaattatttgcatttatacttttgttaaaagttgaactcgagttagttatttgagacaccaacattacctgtctaccatattgttcatatagtgatagttctgtgtaagtagactttagtcaagcttcacattaaaaaaaatttaaccactgtttaccctacttggtataattagtaggctttatcaatttttttatgctgtgaagtctagatctcaaaagatatacgtcaattttttgttgttcagaatgaagattctgtctgaatcagtaggaaaagaggggagggaacgtgatttgttgttcacatgatatagaagaggctggtgagagaggcctttggaagccttaaaacagcttggtgtgaaagttagggtgccctgggagctgacaggtaggaggagtgggagggggagatgggggcgggagtcagaagaacagctcagctctgaacacacctgttacagtcctatcactcactgatgatagaaaaccgcattttgttggaacgggcacagtgattgtcaaggaagttgtcttgtgctactgccatggattcaaaagattcttgggtcgtgaaagaggtggcatcagaaggatatgtttgttgacagggagaccagatgcactgatccattttttatccttttgccttcagagcatccttgtctccttgaattcactgctgtctcagaacccaggagggctgtcggagccctctcctgcagctcagctcccagggggctctcccagcaggctggggctgtctcccagccggccagctctgctggaactggaggaggcagccagctgcaatgggactgcctctttttcgtcttgaagtggtttcaggtttcctccctttctcctcttggggtggggacgggaggctctcaccagctgtcgcctttgtgtttttctctctctccagctcaagtcagctgacacctttcctttcttcccttcccttctccatgaacttgcacggagtcgctggcgggtcagtgtgtaggagggtgaaccgtagcagctgtccttgccttccaactctggttctgccctcctcctgacttatcctttctccctttctttgacagagatagggaatattttccagcaagcttcagaaaacattctatgtggtatgtgcagagagatcctctatgcatagaatcttgcacaggatttaagaggtcagtgcatggggcattttctatcccctgctcccactttattgaatatcatactgaactcagtagtttaggatgcattcctaagtttagggaaagctgtgaggatcttttgattcattctagaacattccaaagcaccactgaggttgcacaaggtggttcatagcaataggaccgtgatgcttatagggcaagaggaggggatatcacaggacctctgggacagagggaagcactgaggccttctgcaactctgcaacaaagttcctgtgatcccctgccctcgcctctctcccagcactcctgggatttcagcattttaattaatataagtcaggtggacgcttatcttgctggattcctcagtagtacttgatatggttgatcccttcctcatttcttgaacagccctctggtgcggtcattctttaacataaactttttattttaaaataactttagatttattaaaaactgcaaagatagtagagagagtgtacccctcacctcatcctctttgctaatgtcttacatcactgtgatgcatttgtcaaaatgaaccaacgttgactttaactaaacttcagaatttatttgctgttcaccagtttttcagttagtgtcctctttctatgccaggatccagtccagagggctacattgcatttagttgtcaacttcattttatgtaataaaaactttacctacatttcagtggttggtaattttgtttaaggaggtgatcccttaaacaaaacggagaaagtgagttactttctgctagctgaagtgttactttacatccatttgtaaatttttgttcagatatatcaatcattaccatttactgaacacccccatttgtgcttgttctggttttatgttttatgctacaatgtgctctaaacattttagaaataaaattagcagtactttgtgtgaagtggcaataggcttcctccccttgaccccttctgtccccttattttgagacagggtcttactctgtcacccatcctccccctgacctcttctgccctgtttttttaagacagggtctcactctgtcacctaggctggagtgcagtgcggtggcgtgaacacagctcactcactgcagcctggacctcctgggcttaggtgatcctctcagttcagcctctctggtagctggaaccgccgatgagtgccaccatgcctggttaatttttaaattatgtgtagagatggggtctccgtatgttggcttttcttccattttaatgaggtattttaatgaggtagtgatgtgctgtggagcttattaaaaatgggattctgaggccatgtgaggtggctcacacctataaccccagcactttggggggaccccaagacgagaagatcccttgaggccaggagttccagaccagcctgggcaatatagtgagactccatctctaaaataaaatacaaacgaaaatgggattcttcctgtctgagtagatggatctagtaccagctttcccaggactagtggtgcttataaaatcctgatcattccctccagctatcttattagaagtgttttccttaaagtcatacatgcatgtatcatgtaggatggttagtctagcatatgtgtgtttgtctttggtggtggggcaagagtgggagaagaggaggttgtatttcttcgtaggttaaaattggctttaaagacagagaaagaatagagtagaaaatattcgagggtattgcctgtagtaagacccatatcctgtatgaggcagtccagagtctcagctttttcagcaagacgcccccatctgctgttgccttcttcctcctgggcctttgcctaatgggccctttgctgtgggcattctcaatggcagttctgagaaccacctgcgggcccaggcgtccctagcgtggtgtgctgtgttcttgtgttcctactttcctagatgtttcatgctggtttgctgtgtgtcttagttcattcgtgttgctataagaaaatacctgaagttgggtgatttataaaacaacagatttatttctcacggctctgaaggctgggaagtccaaactaggtgccagtgtctggtgtgggcctggattctgctgctaggttggtgcctagcagctgagcactcacgtggtgggggagccgagggcccttttctaaggctaatctccttctaaaggcacctcctctctactgttgcgttggggattaagtttcagcatgaattgtggaggggacacaaatgttcaaaccagagcactgtggttttgcctcccccaaatagaatgctcattgtgggaggggataggattttcacctctgtggtaaaatcggctccatagtgttgggcagacgtctttcttagtccttgttggggtggaggtaaccgcaccacttcagctgtcctttaaggcaaaatgtagccaagcacctgagtggagcttttggcttctgactgttgttagtggagaagtgggaaatcttccttgcctgagcacatagttacagaataacccttggctcctgttgaaaagtgaaaggcacattgtatgcatgagatacctttgacctcaccgactatttgctcaaccacctaaataaacaccccgtattcttgggaccaggtcaatactgcagacccctgcttctctccgtccccctttctccccttcacccgctttctcatttctgtttctgtaactgtgtcttgctgttctcagttgggattgtggagcatctcaaccgtaaaaggggagggagacatgagtttgttgcttctgaccttttgggatgtctaaagtcacctattttggccaggcatggtggctcatgcctgtaatcccagcactttgggaggcagaggtgggcagatcacttgaggtcaggagttcaagaccaacctggccaacatggcgaaaccctgtttctactaaaaatacaaaaattagctgggcatggtggcgcatgcctgtaatcccagctacttgggaggctgaggctgaggagaattgcttgaacctgggaggtggaggttgcagtgagcctagattgcaccacttcactccagccagggcaatagagcaagactctgtctcagtaaataaataaataaataaataaataaataaataaattaattaattaataaagtaacctatttccaacattttgaaataactctttcttcagtgtagttgtcactttctttatgaacacagacagtggtgcggattcaagtgatctatttttgtttcatttcttttatagctttgtctgctgatgaaaaaaaaatttagctaggtgtggtggcatgtgtctgtgttcccagctattcaggaggctgttgtgggaggatcactggagcacaggagtttgaggctgcagtgagctgtgatcatgccactgcactccagcctgggtgacagagcaagaccctatcaccaaaaaaaaaaaaaaagggccaggcgcagtggctcacgcctataatcccagcactttgggaggccgaggcaggcggatcatgaggtcaggagattgagaccatcctggctaacacggtgaaaccctgtctctactaaaaatacaaaaaattagcgggtgtggtggtgggcacctgtagtcccagctactcgggaggctgaggcatgagaatggcgtgaacccgggaggtggagcttgcagctagccgagatcgcgccactgcactccagcctgggcggcagagcgagactcttgtctcaaaagaaagaaaaaaaaaagtaacaagtttggtgtggtggctcatgcctgtaatctgaacaatttgggagggcagaaggattgatgacttgagcccaggagtttgagaccagcctgggcaacagagtgagactctatttttattactccaagaaaagtgtcattacacaagtggagtgtataccatatatataaaaaatatttctgttaaaaatgggattatactacagtacatatattgcattgctgaaatgattacaggcaaagtgtactgatatccgccacttactttaaaaggaataaaaaataaggggggttgtttcaaattttttttccttttatactgcaaagggcctgatgagaatcttttcagataaatcattgcatatatctactttattttcttacgggaaagtttggaagcccatgtgggtaggttagcccattttgatattcattgctgatgaagcccaggagatggaatgcttaatataagccagattttgggactggcagcagatctgttgtgttggaacagatcattcaaggagcagggacagaactttgaatgtggttagttgtattggggttcaatgtcagattgagtcagaatttcaatttgcagctagtgagaagtcctgtaatcgttattgcatattccataatatcttgtcatatgaacctatcataactttattcctttaatgaaaagaatattttctcaaattttctgctgtaaataactagtgctatagcatctctacagctttattcttgtgtatggaagctacgagtagcttagagcaaaagaaacatacaacttatgtcttattattgacaaattgccctaaaaaagataattgatctctctcgtgaatactaggttatctacttattattttctgttgtccgtttggatatactcaaaaagtgctacatcatcattgccttaatttcccttagcaccagggaattttactgttttctcacatgtttacatccttttctcagaatttcctattaatttatccattttgctcttggggttttttttttttttttcccataagccctttgtaatagtaactttaaatgcagtacacattgaaaatatattttctgtattttgtctgctgtttaactttttaaaatggcatataccatactttgtacagaaatgttaaacttcctggcttttgggtattaacatctagtgtcttgcttaagaaggcctcaccttaaattgcaaacatattctctttttatatctaatagtttaaaattaatgaaagaaagcattttgaatctaatcttgaattcatatgggattgattttgtatttggtaaggtagggacctaatttcttccccacactcctccaataggaaagccagttgtttcaacacagcatgtgaagttttttgttttctcttttattttaaaaatgccccatatgggccgaggtgggcggatcacaaggtcaggagatcgagaccatactggctaacacagtgaaaccccgtctctactaaaaatacaaaaaaatattagccgggcatggtggcgggcgcctgtaatcccagctactatggaggctgaagcaggagaatggcgtgaacccaggaggcggagcttgcagtgagctgagatcgcgccactgcactccagcctgggcgacagagcgagactctgtctcaaaaaaaaaaaaaaaaaaaaaaaaaaaaaaagggccccatatatttgttatatgtgtaatcttcaatgatgggaatttggcagattttccaagtgcagaagtgtatcactcacatgcctttttgtagtgctttgttgatataatgaatttactttttagtagttgagtaactgataaggcattatagtaaaagttttttaaaggatttttttgaacctgagaaataagttttaacattctaaataataaattaggagattaggaaacattaaaaccatatggttactttttacacttttttttctgaataagtgattgttatgtttggggttaattttgtcaatgggaaataagtataaaacagctttgttctttctatgactgcttatggtaaaaaaaaaaaaacagctttgattttactttcgcagaagcataatttactctcttcttttgtgaattggtgttagctttatattaggagttttgagaaagatggtttatattaattttgagtctgctttccagaacaaatacctgataaaaactctaaccatggcagggtgcggtggctcacgcccataatcccagcactttgggaggccaacaccagcggatcacctgaggtcaggagttcgagaccagcctggccaacatggggaaaccccacagatctcaaaccccgtctctactaaaaatataaaaattagctgggtttggtggcacacgcctgtaatctcagctgcttgggaggctgaggcaggagaattgcttgagcccgggaggaggagttcgtggtgagccgagatggtgccactgcactccagcctgggtgacagagtgagactcaatctcaaaagaaacaaaacaaaactctaatcatgtttgtcactagttgtttttttaagctgaataatttttctttttaatcacaacgtagaattatgtttgtattggaatcttggacagctgttagtgaataaaatttttatttaaattttgtcttaaagcatttttggaagagtgattgtaagggactttcaacacattctaatagtcactgtcaatgatactgggaaaattctacttccatttgtaatcaggaaatgactagttaatcttcacttggttagtcatgcttttgtggatggtgattaacggtgttaactttgaactttggtataaagtgtaagtagaggcaggcaaatatttcattgtagtagtgagacttttatgttttccattgatagaggtgagcttcttgtttccttgtcccagacccctttattttgatatcaccttgtttcctgtagagggcagaagagagagggagttcaaagagagggtgggaggtggggaagagacactagactggagtcttcatagaggagctcctccgtgggtccctcgtctgcctggtgcccgatggctgtccctcatgttgctatttgtagtggccttccagtatgttcctcacactgggtgtgagtattgctgagggaggtatgggtttgtgaggggtggttttccatttatttgaaggctcaactttcgtattgcaaaggcaaatattatggcgtaacgtaaattctatatgaattttaactcatttacctatttatcaccgattaatcaattactaattatttattattgattgattgattgtcttgctctgtcctccaggctggagtgcagtggtatgatcatagctcactgtagccccaaactcctgggttcaagcaaccctcccgcctcagcctcccaaacagctggaactacaggcacatgccactatgcccggctaattaaaagaaaattttttcgtagaaatggagccttgctgtgttgcccaggctgatctcaaactcctggtctcaagctgtcctcccaccttggcctcccaaagtgccattataagtgtcagtcattgcacctggcctgtatgtattttaaaaataaaatcaagatatctcacaaaatacttcaaagacaatttgtatgggtgggggtggacaaagggattagtgcagtttacttcaggcctcctaccctagagtgtctccattttactacttttgcatgtacttgagaagacctgcattgtgaggcttagctgtacttttgttaatgtgactgttttgtagtttaatgttttcagaagattgcgtttctttttttttcttacctttcaataagcgttctcaggttgaaagagtgcatatctcaatgatggtatgtaatgttttcatcgaatagccctttggcagccggccttttaaagttagagacagggaaaacaccctgctgtcatatatttttcaagaaaagattaatagctgtgattcattctgcaaatagctattctttttgagagttagtcttgcaaaatttcttcccttccttttattgttgtcctatcaattctgagaaactgagaaaaatgagccttgggattatttctcattatacttgtctcactgaatttagtgggcttatttcttcactcctctcttgtaaatatttgcagactcattacagcatttgcctttcctgtgatttaaattaaaaataaagattttggtaagctgtatgtggcatgatgaaaaaactaggagactgtggaagaaggaattaggagatgggaatgttggatattgctattcaactactatttgattgtgaaaaaaattacttcttgatttttgaacttcaacttttctcaattgttggtgacctctagagtctttgcaatccctttaagttctgtgattttaatggcaaataagtacttttattttacgacctcaaaagtgtggtcattttatgagaaactttataggacatgtagctataggtttttgtgttgctttcagacaaacttggaatgatagttcaggtaatgtgctaatcactacaaatttgtctagtcagcgctagagcagcaagtgtaacttttatagctgtccatgtcagtggattgtgtaaagactaataagacttgaaaagactaagaggtagtgaacagctctccaaatgagttgattgaagtctgtaggcaactgagggtctcatatcagaatacattttctttgcatacattttatgccatgcaagttgaaactcaggcctgctctgtagaagaattcctaaaagaagatgtcttaattttatattttgactttttttctgatttggaagatcattataaaggtgagagaaaacagcgtaaaaaaattgctcatagcgtattcaacagatgattataatgatgacttaatcaagtatgcacaaatatctttatcatatggaaaccctgcccgtagaagtttgtagctgtgaaattcttaagtttggggcacaatgttgtgtacttacactaatagagctatataaccgggtcaaattgtgggttggtttaagaatttcacaagagaaatgaatagttgtggttctttccttgtgtgtatgcgctcattaaggctgctggaatcctcacagcgtctactcgctttgcaggacctaatggagtacgtttttcaaatttaaatttttattaatttcaattttattttattttggagacagagtcaccttggctgagtgcagtgttgcagtcatagctcactgcagccttgtactcctgtgcccaagtgagcctcccacctcagcctatccagtacaggtaggactacaggcatgcatcatcacacatggctaatttttaaatttttttgtagagacgatggcttgccgtattggccaggctggtgtacaactcctgggctcaagccatcctccttcctgggcctcccaaagtgtagggattacaggcgtgagctcctagccatggagtatattttgaagactgcctttggcttcatcttgtttttttaaaaattgatttcccctgatttctatattattgttaaaaagtagtcctgcattatgtaaatttatagctgtacagtgcagtttaaagttggtgaaaacttttcaatctgcaaactcattaatttccaggtctggttaatttatcctttaggaaaaaaaaaattggattttggagagagagaggtgagatttgtagatgcgttgcttttgtataccatccacttctctttatatattgttggatttaatttggtgatatattgttgctgatttttgtaccttagttcatgagggagaagatgtatacatatttgtctgattttggtatcaggtttattttggcctttataaaatattttaggtgaggatatagccctgagacattattttattttattgagcattttaagaaacacactaaaattcttaatgaattgctctttaggtctggttcaggctataaaacctattaaaattctccaaagcacattgttgaaagcccctgatttctaggggagggaggtgatgttggatgtgtttttatcggaaggaaggatctttccttctctttccaatccgtttaaatttaatctctccctggggatgcatcacagatgcgtacacaacagccaggagtgaagtacaaggaactccttggaccatggtcagattacttttccggctcctccaggagactgctcgctgcataatgaagttaatttgtgtgtgtaatttccttagtggatttttaattaagtggaaacttttggggcacttgtcaggttcatttactgtaggagacccttctatattaaatcaagttctactatttatagatgtttagcttccattttacatgtagaatccttcaaattctcacaacaatccttttttatagcatcatatcttatcttatctttttttttttttttgagatggagtcttgccctgttgcccaggctggagtgcagtggtgtgatgttggctcactgcaacctccgcctgctgggttcaagtggttctcttgccttagcctcccgagtagctgggattacaggcacccaccaccacgcctggctaatttttgtatttttagtagagacggggtttcactgtgttggccaggctggttttgaactcctgacctcaagtgatccgcccacctcaacctcccaaagtgctaggattataggcatgagcctccacgcctggccaatagcatcatatctttaaaagcgtaggctgcattcagcattttaaggatttatattcatagtcacgcgccgcttaaggaggattcattctgtgaaatgagttgttaggcagtttcattgtgcgagcatcatagggtgaacttacacaaacctaggttgcagagcctactgcacacctcggctgtgtggtctaacctgttgctcctggactgcaaacctgtacagcctgttactgtcctgaatactgcaggcagttagaacagagtggtacatagttgtgtttctaaacatatcggaacctagaaaaggtacagtagaaatacggtattacaatcttatgggaccactgtctgtgtgcggtctgttgttgactgaaatgttatgcagtacatggctgcatgagattaacttgataattttgcctgatatgaaacctagaatattacattaaatatgagaaaccatttaaaaaactaatgtacctcctgaaaatttggactttttgactgctacatctaggtaatgagaaacaaaaggcaagtacagaaatggttgtattctgctgggcaataaaagccttttactgctgcttgggatgacttcatccaaattgggagcacttagaaatagacaacaatgtgacatatttactggaaactgattagcagcattaggacaaacacaagtgtgtcagtttaaagtggagagtactttgaggtgcatattttccatttttattattcatctgttagggcacatttcagggttgaagagaggtttggtgttttttttcctgaagtgcccctgcgtcattgcagttctgtgaaagtattcaagatgtgggactagctggctgctaatgtgactatttttctaaattacaaaaacgttcagaaatgacatttagcgtcagaatcctttagatactttatttgctatttaatgtacaggcttcctgaagaatatttgtatgtatttgaagcagtatataattttgtcaaatattcaagagcctaaatttgagtgttttctaaaaacagtattttattacatatggtaaatttggtaaattcttaactagatagaaaatagagaataaagggcttttactctgtgtttttcttgcctacagattcatcatacatactgtgaagcctcgaaatgcctagagtctaataaattagacttaatatacctacttgttgatccagaatgcattgcaaggatcttgtattgtctccgggttgacatgttgaatgttgcttgtcagatatcgggtgctgaaaaggcctgtgcccagtatgtggtaatggttgagtctggaggggttggatggaagtggtgtgtgtgtgtgtgtgtgtgtgtgtgtggcggagggagggggttgcatacttgtgtttcacctgcgtgcgtgcgtgtgtgtgtgtgtgtgtggtggagggagggggttgcatacttgtgtttcacctgcagtagggaaaccttttcattctccagcaggccggggtttcgtaacagggctggaggaatgttattctggcaacagtgtgtgtgattgggaatggagagatgagagaccgggagcagaaagaaaaccttaaaggcttcaaagtgcctataaatcattatgtatataaacttggactgttttttttgttgttgtcgttcaaaaaaaaaataaacatagcaatctctcattgctgtgctcagacttgcttcagttaaataaattttgactacagagtacaaggtggtagttctttgtgcttgcaggtgtcagcagtctggaaggactgatgtactttgggtcctatgaggcttgccctgcctgcagggagaaggctagaacacattgttttaatgatgtctgtcatggccagcctgagaaattgagaagatgctgcataaaacgtgggaacgtgcagtgcttcctgagacctggggagcctgggccagagcaagcttgtatgccgccagtggcagctgttccttagatagggttcatgctctcaggcttgcaggcacccactcatcctgtccctcatttacctgcctggctcccataggcttatgagcttgtgactcttgagccaaagtctttaaacatattggaaggatggaatcccccaccacacagggtgcagagggaatggatgctttgtgggctctaaggatagtgtaatggtaagagcagtggtgcctgtagatcttgtacttcccctttattttacaggttggggaataggcagagcttttatttgtctgagcttacccagctggttattggcaaagcaaagactggacttgattccctgtccacagaaaagggtagaaagttgctgacaatagagggctctgtggtcagaggagaagttcagaggtctgtgctcagaaaggagaaagtataaagatgtaatgctggcctttccttatacatatgagacagaaaagacccccgctcccgcctccccccacttttttttttggagatggagttcactcttgccgcccagactggagtgcagtggtgcattctcagttcactgtagcctccacctcctaggttcaagtgattctcctcagcctcagcctcctgagtagctgggactacaggtgcctgtcaccacgcccagctaattgtgtatgtgtttgtgtgtgtgtgttttgagacagggtctcactctgtcgcccaggctggagttcagtggcacaatcttggctcactgcaacctctgcctcctgggctcgagcgattctgcctcagcctcccgagtagctgggattatgggtgtgtgccaccacgcctggctaatttttgtatttttagtagagatggggtttcaccatgttggccaggctggtctcaaattcctgacctcaggtgatccaccctccttggccttccaaagtgttgggattacaggcgtgagccactgtgcccggctaattttttgtgtttttaatagagacacagtttcatcatgttgaccacgctggtcttgaactccttaacttaggtgattcacccacctcccaaagtgctggggttacaggcatgagccatcgtgcctggccaaagcttttgttttagtaaaacatgaactcgatttgttctaagtataaaagtagttatagccaagagctttaggaagttatatggcatctgttgatggttaaaagacatgttaggcagaaatccttgtggtgctaattgattacctttacactcccttaagtctggaaagaactttaaccaaatggcattctaaagacatgtatgcttagatactgcagttatctgttacatgactgagaacgtgggattaaaaaaacaacaacacacaaacgcattcactcaagacagtagaactagtccacagcaagcaaataatgttttaggtgtagtaaagtatctgcctttttgcaaagtaacttttgttgttcagttgcagtcctggtgttagctacccaagctggctggacattgtgtcatctgagtttctttctaattcacttgttcttggttggagtgttgtgtagttagtaaagctcgcaggtgtttctgatacagccaggattgagaaccaccatgtattccctcattcccttttgagatagattgacactagatattgtgcccccccaagggtagatttttacgatgaataacactactcctcacagttgaggaagtagggactgttgtgaaaatcctggcttatcagaatggcaacgaatacttagcagtgactgaatgccttgagctattcggagagcttgaaaagttttgactgggctgggcgtggtggctcacacctggaatcttagcactttgggaggccgagacaggtggatcacctagaggccaggagttcaagaccaccttggtccaacatggtgaaaccccatctctactaaaaatacaaaaattagccaggcgtagtggcaggcatctgtaaccccagctactcaggaggctgaggcaggagaatcgcttgaacctgggagttggagcatgcagtgagctgagatcacgccactgcactccagcctgggcgacagagtgagactccgtctctctctctctctctctctgtcacacacacacacacacacacacacacacacacacacacacacacaaagttttgactcattcaatccttttaacaattctatgagtaagggactcttgttactcacatttctcagatgagggaaacgggcagagagaggttaagtcatttgctccagctatgtccagtcttcactgttaattcctaggctccattgcttgtactgaatgagctgatgcttccttcatatttgtaactaatcagctcactgagcggattttagaagctctagcatttctactgctccagcatttgctccgcagttacgttgttgtcacttgggctacagcatccagtagactgatgttcagggctctcctgcagactgctgctgcccgtggtagcacagcccagctgacttgacctatccccagagctcttcttcacctctacacccctgcctttgtcctgagttaataatataacataacagtaaaaacaaaaatattttgtggtcagttttctagttactgggtttaatgacaactagccagtttagcttatatatattcactatagtatttcctttagttctatgtgctatgtttactgtgatcatagtaaaattattttaaatacttgattgggattagaacagggcagcctcttatatataacttaatttttttactagcaagtttagaaatttaccagcaagtttataattttttctagccaatgtatgagcttataaacaaaacaaaaaactctttagttatgtaagagaactgaagggaaattacagtgctatcttcaccactgcaagagggtaggtgcttgtataagcttttaaaaatgggcatgacttgcaaggctattttagttgcatggagaaagccatagatcacaatgcagtttccaaccatactgcattgacttaaaaaaaaataccctgagagataaataattaaacaatatgggatgcatttcatagaatcttcaggattacatgcttattttctcacgaacactgagtttatttgaattttggattatgtatatactgtccctgtgctccatacgaagtttccattaagaatgtgttcttgctttaatgatgtgcactcctgtttccctctgcagtgaacaggaattaccaagcttgtgctcgttgagtgctctctgctggtggctttgggttttaatatcagtaacagatccaccagtgaagtgtagacgagaactcaaactggaaagtgaaaggagcccagctcccagcctgcggcacccttccactgtgagcccagagtgcgattacagatgtcccctaaagaagtgcccccatccctggtcctgcatccctgcggtgtgctcaagcctgcagttcctccgctgcatcgccgtgatcaatacttgagcatattttaaaacacagtgtactagaatgatgccagatttatgaagtgattgagctttttccctaggcggggaacaagctgtggaaaatgggaagtttaaaagtcttctgacatcataaagctgagattaattactatgatctgattgatatctaatacattttggtttttcaaacagagtttgaaataattggtgatatgagctcaaagaagtttatgatcttatcagaggtgaccttaaaatttggggagtcagaaacagaagtcaaaggcactatgcttctttaaggaaaaaagcaatcagaaatgcataataaacatagtgactttgcttctgtgtgtctctctggctgtttcagccatcattggtggcctttttctcgtatgattttactggatacatgtaaatcaaaggcatcctctaacctttcaagtcaatatatgatttcttttttgtcccccagacagagcctcgctctgttgcccaggcctcctaggttctcctgccgcagcctcccaagtagctgggattacaggcatgtgccaccatgcttggctaatttttatatttttagtagagacagggttcttgccgtgttggccaggctggtcttgaactcctgagctcaggtgatctcccacctcagcctcccaaagtgctggaattataggtgtaagccaccgtgcctggccaatatatatatttttgtaaaaatatgctttcattagggaaaatttcaaatatactacaattgttaagagaataacatacctccatgtacctgtcacccaacttcagcaattcacatttttggccaatcttgtttcttctgtaccctcgcactatttccattccatcattttgaaataaatcttagatatcagatagttacactggtaaatatttcatcatgttcaatatatgtatttgtcaaaaaggaatattaaactaatatcctgccttctgcctcactttctaaagaagatactgtgttttgaaaggtggcttacaaaatgctttgtgatattctaaatgctgaggcaaaatatatgaagttaaatgtttttgagatgaaggctgtcaacagctttcggagcataggcaagaagattgtggggcaagtgtgcgcaggaagtgtgaggcccaaagtgtcctgccctggagagtgagacggaacatccccagggagtaccgtgctgaacatcaagcctgatcttaccctgctgtcacaggagattaagtggccaggctggttcttcagtcctcatttctcaaaacacatacatggatgttttctatgattatagtttatagtgaccttgtgcagaagcattgagccagtttattattaaaacttggactaggtaaactataatttgatttctgtacaggcgataaccactggagatagcaagagtgaatgacagtgtggtgacgggcaaatcttatttgttactgtttagacaatctatatatacatagataaacagtctatatatatacataaaacaacagtatatatataaaaatatataaatatatgtctcaaaaatatatattttgagacaggatctcactttatcacaaggctggagtgcagtggcaccatcatgtctcactgcagccttgaactccctgggctcaggtggtcctcctaccttagcctctggagtagctgggactacaggcacgtggcgccatgcctggctaatttttgtgttttttattattatatttttttagagatgggatctcaccatgttgcccaggctggtcttgaactcctggactcaagcgatctgcctggtttggcctcccaaagctctaggattacaggcgtgagccactgcacccagcctgtttagacaatattaaagccattgtttttctagtgttagagtttgtatgttataatttagtacatgcttaattgaaggtattggtgtaaccccaaaatatatatttttcacataactcagattagcagtggtatttagtgctttagttatatcttccagcagataactgaatggatctcactttatttttatcataattggtgagagctgggaatcttatgtctccaggagatggctgtacaggaactgtgtgtgattcgcaatgtggaagagcagggtcttgctcccttgggaaccctgcaagtagttgagccccctggtcactcagcttatcactgtggatgctgggcactcctgggggatgctctggagcccctctcagggtattgccttttcgctggctatggggttggaggagagggtcagactccttccctgccctcagcttgccggctgcccaggcacaccctgtgtgcagcttcagcattcctgtggcattggtctctgtggtttttcttcttttcacatagcttactttacgccctgttcgctccacaactcttttcaaagacaggatggaggtacaggaaggaaataacttaatttgaatattaaaattctgttaattttagaatgcagtctcttcagttctggaattgatttcttttggttgctgttggtctttgtaaggagcgtaacattgcttaagatttatatataaccgagtcattttctgtctctgtatcatattcctttaggtaagctttttcaaagttactttgaatagttgatatagatttagaacaaacgagtcaccattctcaggatacttctattgcctttctggaataatgcagctcattgttctgccaagtatcctctaatcagcctgaaaagtgttttcttttatttcatcatgacattgggccttttaattgagagtgaaaatcattaaaggcaaattattttgtgtaaattatggtagatttagccttactacataattttggaatgtttttatgattggttgtgtatgctctggcagatgtctttatcatgacttattttaggtgggttaagaattctttttttttttggagacagagtttcgctcttgttgcccaggctggagtgcaatggcgcgatcttggctcactgcaacctccgcctccctagttcaagtgattctcctgcctcagcctcccaagtagctgggattacaggcatgtgctaccacgcccggctaattttgtatttttagtagagacaagatttctccttgttggtcaggctggtcttgaactcctgacctcaggtgatccgcccgcttcagcctcccaaagtgctgagattataggcctgagccaatgcacctggctagaattcttggcatagtacacagtggcattatttccaaggcttttttttttttttttttttttttttgacagagccttgctctgttgcccaggctatagtgcagtggtatgatctcagctcactgcaacctctacctcctggtttcaagcaattcttctgcctcagagaatcaaacagttgtcctcccaagtagctgagattacaggcacccaccaccacacctggctaattttttgtatttttaatagagacagggtttcgccatgttggccaggctagtcttgaacgcctgacactcaggcgatccacctgcctgggcctcccaaactagtgggattacaggcatgagccgccgtgcccgtttgcaaatttttaaaagtaaaaaagcaaaacaaacccacatgtcagtgtttcagtatttacttcagggggaaattgtatcctaacataccctgcaccataagctgaaatttcagtgccaattccattgcttgtgtgtccatccaaaataaagacaagtttttgcaggaatgtcagatgactgtgggacaggcctagacaggaacaaaactggaggcttcgcatcaaaacaaacacccacctaaccacatgggttttgccctgtgagttgtttgtcatcctagattttcagcaagaatgggctttagtaccatatttcacatatgaggaggtgctaattttgttaatcatatcacattggtaatattcatcactacattgtaatatgaaagttgaaagtcttgaacttaaagttcataaattcattgcccaaatctctggttggctttaaatgtccttttggaggggagaaggaaagaggggcatggtttgagggttatactgaaataatctgcttgctgtatgatatcgagcaggtctaactaaaaaggtaggtggtggtttctcttgcatgcatacaaacatgtttctggccccagttgtcaaacgagttttgtgttttccttgtctagtcttgttgacctgctatttattttagtcttttgataaacaggaagtgttgctgcactgcactcaggaatgtattaagtaactattaatattaaacaagattggagggatgagaagggatttaacttaaagtagagggaggatataagaaaatgaaataatccttaaaattttagaattaaaatttatttggggccttttgaaatgctttttttcccttgaaacctcaaattctggatttacatttgatgtttctgttggtggtatattacattgctttaaggttgtttagaacaaacgtcacaattaatgatgacatgaaggttaggattcgagcactagcttttttcagacaggtctaaaaagggctctgccctagtctatccctagcagagatgttacatgtgcctggctcaattcaacgtatcagtatattgtggggagaaaggatgaataaggacaacaccacaagttgtgatggagtgtattgtttctaggctgtttccctggttgttccaatacaccatgcatttttttaaaatttattttttatttttatttttttttgagtctcgctcttgtcccccaggcttgagtgcagtggctcaatctcggctcactgcaacctgctccttccgggttcaaacaattctcctgcctctgcctcccaagtagctgggattaaggcacctgccaccacgcccggctaatttttgtattttttagtagagacagggtttcaccatgttggtcaggctggtctcgaactcctgacctcaggtgatccgcctacctcggcctcccgaagtgctgggattacaggcgtgagccaccgtgcccggccaatttatttttatttttgagatagagtagagtcttgtcgtgttgcccaggctggagtacagtggtgtgatcacagctcactgcatccttggtctcctaggctcaagcaatcctccagcctcagcctctcagtagctgcgactacaggcatgcaccaccatgcctggctgattatgttgccttttgtggagacgtggtctcactttgttgcccaagctggtcttgaactcctgggttcaagcaatcctctggcctcggcctcccacagtgctgggattacaggtgtgagccactgtgcccagcctcactgtgcatgttttgacctcctcacctttgtcctaagatttctcctgattgaaaataaatgaccatttcttcatgaagcgttctttgtctttagtgttttctgtattttctcaattcatgtactgcttggttggcagttacaatttccataactgagtattgttagtgaccttttcatatacctatggcttgcctcccaaaattgattttttttttttttttttttgagatggagtctctgttacccaggctggagtgcagtggcaccatcttggctcactgcagcctcctcctcccaggctcaagcaattcacctgcctcagcctcccaagtagctgggattacaggcatgcaccaccatgcccaactaattttttgtattttagtagagacagggctttaccatgttgcccagggtggtctcgaactcctgagctcagacagtccacccatctcggcctcccagagtgctgggattacaggcgtgagccaccacgcttggccccgaaattaatatttaagtgttgtagaacaggggttttattatagatttggctgtaccgctgttattgcataacacaattattttcagactgggtgtttggttcttaattcactggtggtgtgcaccatgccatcctgccatccccagctgctgtcagagtacatggtaaatatagaaatgtgtccagtcagtagtagccacgtggacgctcttctccatatttgacttttcttgctcttagaaggcttttccagtaatctgcgtgggaccgtgactttgcttgcttatggtgtttccagcacctccaccagactctcagggtttggaaagctgttctgggtgaatggtgtctacagaactttgaactctgcgattgcaggggaacatgcttataaatgcgtgtttaatacagaatgttgtagaggagattaggtacttttaattttgtattatgggttgttttcaagatctaattatgtgttggtaggaatggctgttttatttctacttgtgggaaaaaggctgcctggagtttgtttaatttttctgatatagcatcatagactggtagagcaatataggaaccccagagaccatccaactccctcatttctatacaaaaggacttgggtgcccacaaagaggaaatgacttgtgcagtttcaggccacttaaccacagagtcattttattgtcctttttgtggctactgatagataaggcttgcactcactagatgcccttgtcatcaaggcccaggtcaccagctgcacacaatttatctgtatgtctttaaagcaggggggtccaatcttttggtatccccgggccacactggaagaagtggtgttatcttggaccacacataaaatacactaacaatatctgatgaggtaaaacaaaaattgcaaaaaaaaatctgatattattttgagaaagtttatgaatatgtgttgggccacattcaaagccatcctgaggctgggtgcagtggctcacacctgtaatcccagcactttgggaggccgaggcaggtgcatcacctgaggttggcagtgcgagaccaacctgaccaacatggagaaaccctgtccctactaaaaatacaaaattagccgggggtggtggcgcatgcctgtaatcccagctactcgggaggctgaggcaggagaatcgcttgaacccaggaggcagaggttgcagtgagccaagattgcaccattgcactctagcctaggcaacaagagcaaaactctgtctcaaaaaaaaaaaaaaaaaaaaaaaagaaaagccatcctgggccacacgtagcccatggggctgcaggttggacaagcttgctttcaagcttcacaacctactctgctcttttgtcccctcctcccatctgataagtttatagttacaagttttattgttgtttgaggtagtccatttcacactttaattactagttgtgtaattatgttttgcctgagttcccatacagctaatttgtttccatgcttccatgcaggattttatcagaaactttaaagtatcctagggaatattaccagtgcagactagttgtatttgtgcttgatgtattctctgttttaatgcattgtgttaaacttcctttttctgagacaccatgtaccataatttcttaaataaactgaaggcacacgcattacatttcaaatgtctcataagggaatataggaacagagaactaaccatgtatgtaaggaattatgaattttatggaattaatgtataaaatctcttttatgtgtattttataaggtgtcttggagcccgtactttaaaattctcctattttaaatggatgtctgtatttgaaactgaccagatggcctagataaagtcttgagtcataatattagggcctttcagaaaaatctaagtgccagtagattttcaaacaaaataggttagcaagggaatagaaattgatctttggcttgaaataaccagtaacagacttcagtgaatgttttgtggtgtgagggctatgtttaagagggagctctagttgattcgtatgctagaccacagattctaggagggtgggacccattcattgcgatgaccctgcatcttgttccgtgcctgccacatggtagatgcttcgtgaatatttgtggaatgaatgcatactgtggcctatgggactcaccatggtgataaacggtaaaacatgcacatcttcaagacgtcattttaagtgctttggggggactgggcataagataaaagtaggattgaagatggttgtcttgcagagatacatttcagccaggaactgaaatgtgggtaagatttccgcaagggaaggggtagggatggctttccaggaggtatagacaagcagataacaagtttgagcaacaggaagatcctgtggacttcatggcttgtatcttgtcatatatgaaggtacatcccctgtgtgtatggctcagtccatgctcatattctttcctcaaagttgatgcacagggccgggtgcagtcctcagcactttgggaatccgaggcaggaggatcacttgagtccaggagttggagaccagcctgggcaacacagcgagaccttgtctctacaaaaaatttaaaaatgtgctgggcgtggtggtgtgtacctgtaatctcagctacttggaaggctgaggcaggtgggttgcttgaggccaggagttcaaggctgcagtgagctatgatagcaccactgtgctccagcctgggtgacagagcgagaccttgtctcttaaaaaaaaaaaaaaaaaggttaggctaggtgtggtggcttacgcctgtaatcccagcactttgggaggctgaggtgggtgtatcatgaggtcaagagatggaaagcatcctggccaacatggtgagacgccgtctctacaaaaaatacaaaattagctggctgtggtggtgcgtgcctatagtcccagctattcgggaggctgaggcaggagaatcacttgaactcgggaggcggaggttgcagtgaaccaagaatgcaccactgccctccagcctgggtgacagagtgagactccatctccaaaaaaaaaaaaaaaattttgatgtgtgttctttgcttacaaagatgtctgtggtaatgagactcaggagcaccctgtgatcttatggaaatcttttgaagataccatcatagatccctcccttggccaagagtaggagtatcctgcaaggagatgggaactccacctcagacatcagcaatcctgaggagacattgggaacaggcccctccgtccttagatcacaagtggctgtgatctaagctgtgccgtggtatggcatccaccccttaggggccacacttaggatgttggggtgctgtggcactttaacttggaccccacgcagtgtggggtgtgctggatttaagtacagatgccacgaggtgcagttggataactgtttgtccatagctccaaagaggaaatcagaggtaggtgcaaggccttcatcagggttcatttattcctaataatagtctactctgttatattcatgtaggagtatttcttctgatgcagttgggtttcatatagccaggtgtaaggaattaatctttatgttgaagtcatttgggagcctttctttgtgaaaaatcaggtcatttttggattaagtaatgtgacagggaagtggggagctacttcggggtcaagtttttgtttaggattcagagccatttggaatttatcatgtttcagtgaggcttttctttccaggtcagaaaaattccttttggtctgagtcaacatctcttgtttgctagggagaagtaaacaggagagggtagatctttcttctcttaggctggatgagtaaccttaaagttcttccaggttggttgttttggattatttcttttataaatagtagagaaatattcaacattttagttagtttttaaaataccacccaatattatagttaccaggcctcagaggaggtaacctctccagaggagaggcaggagatctctgcctggagatgtccgtgaccctattttatgtttatgggttgtttttgtttcctttttcttttccttttttgagacagggtctctctttgtcacccaggctggagtgcattgatgcgataatagcttactgcagccttgacctcctgggctcaagcgatcctcctacctcagcctcctgagcagctgggactacaggtgcagaacaccacgcctgactaattttatttttaatttttttggtgggattgagattttgctgtgttgcccaggctggttttgaactcctggcctcaagcaaccctcccgccttggcctcccaaagtgttctgggattacaggtgtgagccaccgcacctggcctggttgttctttctacagctttgaatctagcactgcctggagtatggaatggaatgcgtcttagattgtttatctgtgataggcaaagtggtgcaaagtgtgacttcttcatagtgaaattagtctagcatattacctggtggatgatacagctttcactattccatttttttttctgttctaagaagaaaaggtttttattttaaaatttattttatttttaaaaataatttccacttttaattaattaattaatttatttttgagatggagtctcactctgtcacctaggctggagtgcagtggtgcaatctcggctcaccacaacctccacctcttaggttcaagtgattctcctgcctcagcctcccaagtagttgggattacaggtgcctgccaccatgcccggctaatttatttttgtattttagtagagacggggtttcaccatgttggccaggctggtctcgagctcctgacttaaagcgatctgcctgccttggcctcccaaagtgctgtgattacaggcatgagccactgcgcccggcctcagcttttattttagattcagggatacttgtgcaggtttgttaatgggtatattgcatgatgctgaggtttggggtacgattgattccatcacccaggtagtgagcatagtacccaataccttttcaaccatctcctcaccctcccttctccatctagtagtccccagtgtttattgttgccatctttatgtccatgtgtacccccttaaaaaaggccttttatcttgggtgttgcgacagtgtctcccttcctaatgtgtcaccttggcaaacttcttggaagaatcagtgtgtcctaaagggaaaatgtggatttccaggttagcgtctgagcctaagctatgcttgactgtgacattatgtggtgttgatctcaggcaagtcaagtgtcctattccttagtctcttcttctacaaaatacagttgaaaacattgatcttgcaggattgtcacatggaaaagcaggtgtcatgtcagaagtgctctgtaatcagagtgagggtgaaggaatggaatggattaggaggtgggcgcagcaccaggtgcctgctttcatggtgctgatggttgtgaagcttgcagatacagatttgagttctggagcagaatatcctgtagctacgtccacactgtggtttagggacttaggcttggattattccatattcactaccttccctcagtaaagccttctgttttctgtctaccagttcatcaggtaacaatactacccactgttcgtacccttccacactcttagatccatcgggactagagtgaggagaactgggttggccaaggtgagttttggcttgccctcttttttctggggtatgagtaagatatttatcggggcttaagctcacttcttctgcctaagattcctggccagtcacactggggacccacctctgcaggtgaggacgaaggtattcatattgcaagttgggttcgttttcattgcaagggaagagtgtctggatgtcttctttccccacatctgaaatgtttcctggaatgtaaactagaataatcacacagcatttcttgagccagctctgagggacaggataaagggtgaatgggggcgttgatcctgacatggcctggcatgtccacgcatttcttttggcagctaggagagcataggcctgtgtttgttgattatattctcctagaaactcttgtgtaagttctttcctatacccaataggggtattatttttatttttttctgggacacactagttatgcaacacagtgctttgtttgttctatgctaaaaaaagctgaagatggcccctgcctttggagaccttatctagagtaaaaaaattaccatgcatatacaggaaataggctattaagtgacaaatgtgttctaggtaaatatttatttattttgagacagagtctcgccctgtgcccaggctggagtgcagtggcaccgtcttggctcactgcagccttcacctcctgggttcaagggattcttctgcctcagcctcccgagtagctgggattacagatgcccatcaccacgcccagctagctttttgtatttttagtagaggtggggtttcaccatgttggccaggctggtatcaaactcctgacctcaagtgatccacccgtcttggcctcccaaagtgctgggattataggtgtgagccactgcacctggcctaggtaaatacttcagagttggagcacatttcatggagggggagtttttgtttttacttttttttaggggtttgggtgtgttacccaggctggagtgtggcaatgcaatcttagttcatcagctgccttgaatttttgggctcaagtgatcctcctgcctcagtctccggaatacctgggactacaggtgtgcaccgtgacacctggctaatttttaattgctttatagagatggagtcttgctatgttgaccaggctggtcttgaattcctggcatcgagtgatgctcctgccctggcttcctggagtgctgaggttatgcgtgccagttactgtgtccggccaaggggatggtttataaactggatttgggaagatacatacaatttgggtagttggaactctgggggtgaaagctttgcagatatgtggaagagaataaacaaaaacataagggtctcttcacttgaccagtatttattgagcatcttctctgtctcagacactgttttgggtgcttggggtttatcagtgaacagaacaattgaacatcgaaatacggtgaggcaacgctgaggctggtcacaaaccggcttgggatgagctttgagtgcttggccaagaacactggattttgacttttagaaagtagtgagtcattggaaatgactcatattacaggacagtcacatgataaagggaatattttgtgaagataaatgtagcaagatgtggcacaggattgaagagatggggtctagaagtgaattggacagtcattttattgggaacaggagaggaagagatgggaaagaaagaaatgtattcactagttatttaagaggataaatatttaaaactgcacgtatatatttattatggaatgccaggaaatatagacaagcactgccagttgtgcatagcagttcttttgtctatggctgtagataatacattcttcaaactagggatgaaacaaagtcttatgtaacagtcggtgaacaacattgtgaattgctctgttgtgtttaattgattgaatgtgttcaacctgtttcctgtttttacgtgtatagctagttcccattctctattgttatatattaaaatatcccatttaatatatgcatcttggctatgtatcttcctccacattttaaatttctggatcaatgggtatatttcattttaagcattttgatgcgtggtaccaaattctagctccctgtccccccgcctctccaaaaatgtgtgcaaaatactcaggcgcagtgtgtgagaatgctggcttcctgtattctcatgaaccctgggtcattaaatttgtttaaaattaatttggtttcccaatttgttatgaaaaactcaaatagtagctgagagaatcatacaaagcacagctgtgtcagttgacctctggttgggtttggccagtgggaggtttggtgggagataggaggccccgggatgacatagccccaaagtagttcccttctccctctctgttttgggctgtgtctctgcagcaaacaagtctctccccaaattccagctcctgcccctgagtcctccatggctcccacttccgccaccctgggctctggtgctacctccccttatcccctcagcccaggggtagtcatagcttcctgctactgctaacctgtgtgtggcccccgcctccaccaccatcctggtttagagtcacgactcttcttacaaatctttgtaccagttccttgtattaacttccctctctttaaaatacttgagatgatttgcattttcctgttcgcactcctaataatacatatttattcctgcgtgtgtgtatacaggtggagcatctgttatctgaaaatatgaaatgctcccaaattggaactttttgagccctgacatgataccacaagtggaaaattccacacataagtacttaacacaaacttggacttaatacaaacttggtttcgtgtaaaaaattatttaaaatattgtataaaattaccttctggttatgtgtataaggcatatttgaaacataaatgactttttttgtttaaatttgggtcccatcttcgagaaatctcatgtgcatgtaaatattccaaaatctgaaaaaaatggaaatctgaaacacttttggtcccaagcattttgggttaggggttctcacctgtatgtttatatgtatatgtacatgtgcacatgtacatatatgtgtacgtgtgtatttttttgcactatttgcagacatggcactttaaatacttcagaacacaactccttagaataagggtgtttccttaaatatccacaaagctattatcacatggacaattaagaatcatttcctaatattatctcatattgagctcatattaaaatttccctcattgttcccaagatgtcttctacagtgacttcttttttaaacccagcaaggacccaaacaccactcacaccttgaatttggatattcctccttaatctttttgatctagaaaagtccccaggttatttttttaatgacatatttttaacgttttctcttgaaaaatttctaatgtacactttagtgaaatgcaccactgatactttagattcaccagttgtttacatttgctacgttgtttttctatctctataaacataaagatacacattagtaatagtatgcatttttttgtcctgaaccatttgagactaaagtacagatattataacacttctcacccttattacttaagcatacatttcctcaaaaaatgactgttcgttgtataactagtacaatgatcacattcagaaaacttaccaatgtatcattccattacctaacttaatttgacaaatttcttcagttgtcctttcctttttcatagtactttttctttccagatgcagtatccactccaggatcatacattgcacttagatatcagacgaagtggacttttttttttttttcctttaaagatcagtgcaattgcgttgtaaagacaagacaaaaaacaaagaaaaactcatattctggatttgtctgattgtttccttatggtattgtttaccttggttctctatcccctgtatttcctgtaaagaagaagtgaggctatgttttgattaggttcaatcaggaggatgctgctatcagtaggaatgaagaaggcaggaagttggtgttagagggaagataaggaatataagctttatctatttgaagtaaaataggactccataaaaacattgtccagtcataagtaattcccaaatgggtattcttttgtttgttgcataaaaatttcctggcaggcttttaaaacaagctccttggaggattcagactgctcccagggtgaggtgcagtgagaggtggatgtttgaagtgggagtgctgggagggttctggtctaaagatgtggcgttagcaatcccctgcacagagcctggagttgaaataacactgagaaaggactctgacagtgaacactgagattatctgtatgcttataggagacaaatatgtgtgtgtgtgttcatggtaaccattttaaagatgtaatagctaacatctgtttgatttccgaagtttggatagaagcactaaacccacgagttgttgggctaaaacgtagtgtatagaagaggcacaaggtgtttcagcttcctctctgatctcttctcgcccctcattctgaatcactggttctcaaacctcagtgtgcatcagaaacacctggagggctagtttaaatgtataaataggtggttggtccttcctccagagactttttttttggtggtgtatcccgcttgggattggaatttccagtgtattatcaggtgatgctggcctggactcccacttggagaaccaccactttaaatcatgatgtgattagaacatgtaatagaatttttcatggtgtggcttttcagacttggttttaacagccaacactttttttcttcttttctttttttttttttgagacagggtctcactctgtcacccagactggagtgcagtggcacgccactgcttactgcagccttgacctcctgggctgaagcgatcatcccacctcagcttcccaagtggctcggaccacaggtgcgcactaccacacctggctaatttttgtatttttagtatagatggggtttcaccatgttggccaggctggtctcaaactcctgacctcaagtgatctgaccacctcagcctcccaaagtgctaggattacaggtgtgagctaccgaacccagccctaatttttaaaattttttgtggagacaggatctcactgtgttgtccaggctggtctctaactcctgggctcaaatgatcctcctgccccaccctcccaaagtgctgggattagaggcgtgagccacaacacctggccctttttattaaaatactttatggatctcgtctttttattttaattaattaatttaattgatttttgggacaaggtttcactttgttaccccagctggagtgcagtggtacaatcgtggctcacagcagcctcaaccttccaggctcaagtgatcctcatgcctcagcctcctgagtagctgggactactggtacctgccaccacgtccagctaagtttttttgttttgttttgttttctgtattttatagagacagggtcttgccatattgcccaggctggtctaggccctctgaactcaagcaatctgccatggcctcccagagtgctgggattacaggtgtgggccaccacgcctggcctggatcttctctttatgtactgtattaacaaatgaagctgttgagaagaggctgggaggaggggctgtggaaagaagacaagcaaccctgacgcttcagattggaaactgccagtgttagtctgagaaaggacttgggaataaatcagcagacctgggctggagtcctggctgccagcatttatgaattgtgacctcttgccggctatttatgctctctgagtctcagttctctcctctgaaaataggaattataagccctctttccacatgagataatgcacatgaatgcattttttaaaattgtaaaatgcagtgcagatctaactggtggttactgctgtctcattcttgccttggctgtgtcctgtgccagcgctgtagtctgaggccattcccttcatttctgtagaatggtggaggagttgaaggacttccatgactttgtgttggcatgaaagtcatgtcagatcttggaggtcatcgatgggctgatttctcatattattgaataatgtgtgaccctgtgagagattatgtgctagttctaataagactaaatgccagaaacttatttccttgaggttggacttcacctggtttcatgcctccattttcacttttgattgatgagataaatgaagctatccacctgtcaagggaggcagcaggtttgtggtttgctctgtcttgtgttgtggtgctgaggttttggcattggtattgggtgtggtttggagtggagaatgggggccgagcagtgtacttagcatgagatattagtccctcccttgtggtgatacaggtcattattttgttgttgaacatcagctatgacatctgactgtctgtcttctccctgtattgagaaggcaacacaaacatttgtataatgtttagcagtgttcctgtaacaagattgaagatgggtcctatgtttcagtttattggaaaagattggctttttttttttttcctgagacagggtctgaacttgttgcccaggctggagtgcagtggtatgatcacagcttactgtattgtccacctcccgggctcaagtgatcctcctgctttagcctccccagtagctgggactataggcacacaccaccatgcccagctaattaaaaaaccaaaaataacaacaagaaaaaacttatttgtgagatggggtccccctacattggccaggctggtcttgaactcctgggctcaagcaatcctcctgcctccacctctcaaaagtgctgggattacaggcgtgagctactgcacctggccaatcagcatttttaaaaatgaagctgattaaatcaggaaaagtcagaattgcatgtgtgatatctatcttgaagtgctaatgattcattttttttttaagaacagaacttcagaatatattctaaaaatgtttgtttttggcttaaataaattggagagttacccagagaatctagagagaagcatagttcctgctgatcgtgctcttttgttgactttttaaaatgaagtgttttagaagtctgaggggcatttttaaaaacaaaacaaaaaaatgaaatgttttctatttgttatatcactaactaggactttatttgtcttgttaacttaactatcatgtggctaatctggttggtggatgctaaactgtaaactgtgtgccatggttattatttaaaggacttttcaaacttgtttctctttagtctttgtgtttctcaatgtgacatgtgcacatgatcagatagcactactaggattgttatgaaaaagagcagagccttctttgggagaggttgccttttccaactcttgctcctggttcttttgatatttactttaatatttttatgtaaattgcttatctcgtttgttttttcttgttgtttgtcatctattgagttaacatggaaggtttaaccctatttcactaccgtatgtgtgctatgcccccactcacaggtagccatttctaggatctctgtctctttgtgtgtgtttgtgtctgcctttctcctccctctgtcacacttactttttagaccactttgttacaaaatatggttacaaatttgattaaatattctaggttcacattatttttattattaaagctacttacagctgaaccatgtatgataccttgatcaccttttctttccttcacaacttttgtgtttttcctgaaatgaggaatgttttttcctttggttgatcttctgtacatttataactaattagccttagccttagtcagttgttaaaattgtgtcttgctgtgtttagttgcattgggtactctttcagtgccattttgaagaggtcacatttggggtgtctggactggtcactctgctccaggtttgcagctgacgtcctggaatatgggatccaccttcaccatcgtcccgggagctgtcttctgtgttatgtctcctgttttcatatgctgtgtcattctcattcatggtttattgccttattttgttggaacacatcttccacttacaaaggggtaatgtttttggaaacgttgcatttctaaaaaaggtcttttttctaccttcatactttaccggtatttgggcaagaaatggaattctaggatgggggactatttcttgtaggagttttgaagtcactggtagatgattgtctagattccagtattgctgtgactccttttccctcactgtggcctgtgctttattttctggatgttctccttcccttccccccaccaatcttctgtttttcttctgtgttctgatgtgccttggtgtatgtctgcttttatacattgtgttggggtctctatggaactttttaatgtggaaacatatgtcattttggggaattaagttgaaattgtttttggttatttctctgttttcccaattctctttttctagaactcctgttattcaagttgcttgacttacttgactggtctaattttattattagccttttttatcttctttgtcttttttttttttccaacttcctaggggagatattttcaacttctcttaattttcctattgagctcttagtattttgtttagttttttttggacagagtgtctgtcacacaggctagagtgcagtggcccagtcgtaactcaccatagccttgaactcctgggctcaagcagtctttctgcctcagcctcctgagtagctgggactgtgggtgcatgccaccacacctgacttatttttatggtttttttttttgtacagatgggatcttgctgtgttgcccaggctggccttaaactcctggcctcaagcagttcacctgccttggcctccaaagtgctgggattacaggaatgaaccactgtgcctggcctgtttttcatattttaattccaaaatactttttttaaaaaaattctctctcaccacgtttctttctttcttgctttcctcccttctcatattcctctgcaacctgaatgtaccaccatctgacctctctcaggataccagtgatggatttttagtagcatctttttatacagtctctggttctttcaagttgtgtttactatttgttttgttctctcttccatccttggggtgttcttaaaagtctgtctctccatggttggctctgacctaaggcactaatggtaacttgagagcactgagttcaggcacgggcgtacactgtgagcttcactgggtggtccctggactgggccagattcccccctgccttttctctttagatggatagaggcccagggaaagatcttcccacctctagccttggggggataagccctggctggcattctgagagcaagtggaagcagagggctggatttttctgtaatcagtacgtaaatattcacttggctcctctcattttcaacaaggcacctctacaattgttcctcctctagtttctcagtccagacctgctgtctgagcctgcagtgagccgccaggggctgggaggggcagtcactgtgctctctggaagcattgggaagctggggctttaattactacagactttcagacagtattgttatttttcctcccatcttttacatttattattattttaattttattattattattttttctgagacacggtcttactgtgcccaggctggaatgcagtgacgcagtcatggctcactgcagcctgaaattccccagggtcaggtgatcctcccacctcagcctcctaggtggctgggactacaggtatgcactatcatgcctggcttttttttttttaatattaaaattgttttattatcattattattttgagacggagtgttgctgttgcccaggctggagtgcagtggcgcaatctcagctcactgcaacctctgcctcccgggttcaagcgattctcctgcctcagcctcctgagtaggtgggattacaggtgcccgccactatgcccggctaattgttttgtatttttagtagagacttgctttcaccatgttggccaggctggtttcaaactcttgacctcaagtgatccacccaccttggcctcccaaagtgctaggattacaggcgtaagccaccacacccagccaaaattgttttattattatattttagagacaagctcactgtagcctcgaacccctgggctcaagagatcctccaccttagcctcccaagtagctggactatgggcacaggtgcacaccaccacacgttggtgatttttccagtttttttgtagagatggggcctcactacgttccccagactagtctggagctcctgggcttgagtgatcctcctgtccctgcctcccaaagcactgggagtataggcataaactaccgtgcctggccccttcccatccttgttccggtgttctgacattcttggttctccccattccagagcctcttaccggctctgttggggaagtcttgctgcttcttggctttccccacagttaccttggggttccctttcttggttctgcaaaatgtgtcgcctctgggccatctgcttctcagcttccaaaaactgtgtttccctcatttccctctgttctctttgtctttgtgcgattatgcttggaaacaacaacaacaacaacaacaacaacaacaacaacaacaacatccccgcgtgtattgtggtttcagtgggctttcagtaggaaataaaaataagtgtgtctttttgatatgatgtttttaccctttcatttttatctttgtgttcacagcgttctgaatcacctctgccattcttccctgctgctcacacccttccccctgctcagggtcctcctcttgtgccctgtccctctggtctgctcattctgctaaaacctccccatgaagacctttccaagtgagagtgatctttccttcctgaattcacaaaacattttttttttggtgtagttttctttgaacacgtggtctacctcttttttatgacttatattttgtcagataaattttattttatttttgagatggagtctcactctgttgctcaggctggagtgcagtggtgtgatctcagctcactgcaacctccgcctcccaggttcaagtgattctcctgggactacaggagaaagaggagctgggactacaggcgcacgccaccatgcctggctaatttttatgctttttgtagagacagggtttcatcatgtcggccaggctggtctctaactcctgacctcaggtgacccacctgcctcagcctcccaaagtactgggattataggtgtgagccactgcgcctggcctgtcagataaattttaatttctgatgttgggtgatgattgtttctttgccttcatgcaatgctttgcatgtagtaaatactcaaattttttttttatcaacatagatttttttcagtgatctttttctggtcttaagttagacaggatattgaccattgctgtatgccatggttaatgaaaaagtagggtgctatttctagttgcagatacttttcttgaaatttgcacatgtgggtaatatgcggagcctatgcattatacatgtcataactcacaaaagctcgccttaggactttgcactgttttctcttaccacatcctggagtagagtgggcctcagcattccttgcaacttgcatcttgtagagttacctctgcttccattcttagtcttaggaaatgttttgtctagcactaggcaaggtgaagttgatgttctttatctgaataagagcagtgattcttcatgtggttttgtctccaggtttcttcggtgggtttggacctatccttgggagccttgccccatgaggacattcactgcttgatcatctatttgatggatgaactctgcccctcgtttattgctgtgtgtgatggacttttggttgtcataatacacaattattgttagtgtttaactcttttgttattttaaatggacatatcctgaatgagaaacattcttcttcttttttagttgaatgttctgtcatgtttgtttattcacccaatgactgatacaattattgtagaattagaatttattggtagtataaaaagtggcttatcataacttttatcttccccctaagagacggggcctcactctgttgcccaggctggagtgcagtgatacaatcacagctcactgcagccttgaatttttgtgctcaagggatccccctgccttagtctcccaattagctgggactgcaggtgtgggtcactatgccttggccttctaaagttctgggattacagggatgagccatcatgccggaccttatcacaattttttgctcagctacatttctgagtgtctatggactggacagtagagattcctactgttattattttaaactttttaatgcaaactactacaaagtggaatcaataagtatgcgctaactttttctcactggatactggactcttcccttgaaaataaagcaagtcctctgttcattgaaagagaattatggtatgaaagctgccagttaaaatttcccaagagaccactgttctacggagttgtatttttcagtggcaaaaatatccttcctggtttttaaactcttgtgggaggaggtcatttttatatgtttattttttatgttttatttattatttttttatttttaatgcagcatgctctgttggggttactgttgatctcctgctcagttcttttcaaaacgtcatatccattcagcacatttttgtggagtggcatttaataagtggcagcctgatatttgccttggcatgatgttatcatgattgcttggcatagctgactgttgagtcaggacccctccggaggcaggagtcaaccattgactctcaaaattagaaaagccttgatcagttagttggaggattacaagccaagtttatagagtatttcaaagagagggtaacatattctgctgatagaccaaataagatgaggacagacaacagacttttgtgttaagcatcgtggaggctgctgtggatatgatggaagaggaagcctgattggaatggggttatgggaggaagacacacttgaagcaagtatagacaatttttaaaaaaaatttgctgtgaagatcatcaaagaattggtataataaccggaaggtaaagtagtgtcaacaaaaggttttgtgctgcatatgtaaaaataattcacagcctttaaaggctcacgcttgacacctgactctatcttccatacgattgtggtttttaggaacattaacagtgggacaggctgggctcagtggctcatgcctatcatcccagcactttgggaggctgaggtgggaggattgcttgagcccaggagttggaggctgcattgagctatgattgcaccattgtacttcagcttggatgacagagcgagactgtctctaaacaaaagaaaacagtgggctggagttagactgctgatctgctttgggggtgtgatggtcaggaaaagctcttggagaagaggatgcctgagaagtcttgatggacagacagggctggcctggagggtaaggtgtggtccaggcattggaggccttgggcacagagtggggggaaaatggtgcagggcctaacaggctgtgaaagggaaagtgctggggaaaaggtggaaatgtagcaagttctgaaggatgaagttatgaggttgagaaagtccataggtgcggatttatttccaaggggtggctacaaatattatataaaggctgcagataatgatctcatctggagggagtgaacaggattaggaggcttaaagaatggtttcataagccacattttggaggttggtgtgcttgtgtgtgtggaagtattttagaaacgaaagttgatatttaagttgattgggtcacccttgagcttgcttggtgggaagaggtgggcaggatgtggctattctaagtggccaggggacacctctttcttattcacccccaggacattatttccaattttccttgaagaggaaataccatttaccatcagtaaatggttttgggacttcattctttggggactcaacacatctggagatgccaaattctggagctgtctcagtggcaggtgtcccagggactcctggatgatgttgtaattgggattcatgtgcagtcagaataggccccacaaatgaagaggatgccaacgtgtgtgtgtgtgtgtgtgtgtgagtgtttgttttacaaacttactctctgtgttctagataaatgattcctttcatagaggtccagatagatgagggtgcagaggaactctgttacttgcaaaatggttttaacggtaatgtttaataactttgaggattaaggtctgagttacttgctgtgctggttaaaaagtgacaaggattggtcattctgcatttttaaaataagtgttccgtttcagtgatacttaggcatgctttgttagagatggacttggagagcttcttaataatatggattctccccgcacccctgctccagggtcttagtcagtagatctggaacagggtccaggaatctgtattttaactcttcattaatcattagcctccttcttccaatctttgcttcaggaaagaactgtatcaaacatcatctttaggtatgaagaatggaggattgaacttctggatagcaattgtgttgcagaatgaaagcagtagggaatggtgaaacatgcaatttagtatattttcatctgaatatgtacgtaagagtgatgtagaagttcagaaacacacaactatgtttcttcttcagatcatttgaaagcagagttttaaggattttaaaatatacgtacaccatatagaagtgtataaaatttaaaatgatgtccttttttttccttctcctcaatcccactgcaggataaccactgcaaattttgaggggggtgtgtgtgtgtgtgtgtgtttacgcattttaatatgtgtgtgtgtgtgtgtgtgtgtgtcattttgtctctgtaaaaagaggctcaagccacacaggatgtgctttgttcactacggtcttgtcagcatccttctgtgtccctatctttagacctatttgtaagaaacacttggagccaccagggtgtgcaaactactttttgcagataagcaaaaatacaaattcttcagacacataatatatgctgtttgcttattagaatatttctgtagattgcattgggggttaataagtataataagtatttcatatattgggcaataggaaatctagtatgctttagagaaatcagtattacttatgcagtacatattgcaggtttgtgcagttcctatcataatagagtatcagcatcagagccaaagggaagagtgtgtatgagtcactccatcataaaaggagcagtgactcaataccaaacttagggtgctgtctgaatttttaatcagttgcagtattgttgatatgaggttgattcctttttatgggcaggaagttatcacggtttaaaatgtctaattcccttttggtgatgctaacttgctatattcagtgtttctgttctttcgtataggatccaaactactggatacaggtgcatcgcttggaacatggagatggaggaatactagaccttgatgacattctttgtgatgtagcagacgataaagacagagtgagttcaggtcctggggaacctgttctgaatgcattttttttttttgaggactagggagcgggtgcgattcttttcctttctgttttagacacatactttaaattatgtgtgggccacccactctagtatattttcttttataataagtatcatgaatcttcactgtcctgaataccaaggtataatgattttcttgatacctgggacttaacactaggttttggggttttaaaactacacttttacaatggaaatatcacaaaaagatttctatgccatattctgccttaatttaaccaaacataacatctttcttcacaactcgggcctgtccttatcatctccgtgtatacaacatgcagccattctgcattctggtcccagcgttggccctgagaagatccatcccaaccgtggccttggcggtgcaccgtgctcctgtgcagtgggcgagtgtgtcccaggcagcctaccctgtgcagggcctggccctcaggaagctcagccttgctgtgcgatgggccatttgtgtcccgggcagcctctcctgtgcagggcctggatctcaggaagctcggccttttctccatcagtgctctgatgctctgtgtgtgcttccccagtctttactgtggtctgtgagtttggctcctggacctatccacctactgctcttcagtgttccctcccactaccccactttttttctgtactcttgagaggaatgaggaagaggaagaggagggggaggaggaacgttcagcgttttgagaatgcgtgacaggatgttcggctctggatgtagaagtcagcaaattcttttttttttttttttttgagatggagtcttgctctgttgcccagactggaatgcagtggcgtgatctcggctgctcactgcaacctctgcctcctgggttcaagcgattctcctgcctcagccttttgactagctgggattataggcgtgcaccaccacgcctggctaatttttgtatttttagtagagacatggtttcaccatgttggtcaggctggtcttgaactcctgacctcatgatccgcctgctttggcctctcaaagtgttggcattacagatgtgagccaccacacccggccctggccactccttttgtatttggcttataaggaattgcagaagggctcatagccacatacatagttacatcagcatggtagtatggaggcagcggcctggtcgactgtctcctaaaacctccctgcacagggtatttaaccagctaggttacatcgtgaggtcagaagatggtaagatcacccagatattcactctgcttcctactggggctccttctcattcctggccctctccccaccggcctgctcttctttccctcagctgtgagctgggtgcacacagctgttgtgtcttgttcacacctatattcctgacagttagcatcatgcctggctgagagttggtgcatatcttaaatgttttcttgaaatttcaagtaagacaaaaaatatcaaataccaaatagtgtataaatttggaagattagattcactgttgcacctgtcatggtggaatttgtcccatgtggctcctgtgggtcaggaatacattgtatcaaaaaatgcagatcctggctaacaaggtgaaaccccgtctctattaaaaatacaaaaaattagccggctgtggtggcgggtgcctgtagtcccagatactcaggaggctgaggcaggagaatggcgtgaacctgggaggtggagcttgcagtgagctgagatcacaccactgcactccaacctgggcaacagagctagtcttaaaaaaaaaaaaaaaaaaaaaaaagcagaagttttctgccgacttatgttctgatgctatttttcttggtgccgtttctccttcttgggcttttgagtgagccaggcttagggtaactctgaaatccttttctgcagtccacatgaagagtaccatctttcatttattgtgtggctcaattccaacactcaaggcaactacagagatttatgaagaatttaaacaggtgctctttttccaccagagtattagaaagcgatgaattaacgtatcaatctttcaatgtcttcctcttctcccttcttcttcgtccttcttttttttgtttctttttttttttcttctccctctctttctcagtctctctctcttgctgttacttcctatgtaaaaatagcacaactccttgtgaggaaaaattggaaaatgcagaaacatacaaaggaattaatcacctgacatcctgctattgctgagagcttatcactgttgtttgagattttcatcctgactcttccctttcttcagatagatagaaacacagtctttttcttttaaataaagagacttgaatagtagttttttgttttgaggttagcatatatatatttctgtgtccatgaaccatagctatgccaacatggctgtgtagtcttttgttttaatttaatttatttatttagagacccaggctggagtgcagtggtgtaattatagctcactgcagcctcaacctcccaggttcaagtgatcctcctgcctcagcctcttatttttaaaaaagttttattctagattcaggggtacatgtgcaggtttgttatataggtaaattgagtgtcataggggtttggcatacagattagtcaccccaggtgataaacatagtacccaataggctaattttttgatcctctccctcttcaagtaggccctgctgtctgttgttttcctctttatgtccacgtgagatcatgcattatttggttttctcttcccatgttagttcacttagcaataatagcctctagctccattcatgttgttgcaaaaaacatgaccttgttattttttatggctgcctagtgttccatggtatgtttgtaccacattttctttatccactctaccactgaaagatatttaggttgattccatgtctttgctattgtgaatagtgttgtgatgaacatatgtgtgcatgtgtctttatggcagaacagtttatatttctttggatatatacacagtaatgggattgctgggttgaatgataaccctgttttaaattcattgggaaattgccacactgctttccacaatggccaaactaatttacattcccaccagcagcgtataaacattcccttttctccacacccttgccagcatctgttattttttgacttttaatttttttcttcgaatttctcacgcgacacggatgtattgttttatttaataattgccactctgactggtgtgaggtggtgtctcattgtggttttgatttgcatttctctaatgatagtaatgttgaacattttttcataagcttattggccatgtgtatgtattcttttgaaaagcgtctgttcttgttctttgtccactttgttttgagatggagtctcgctcttttgtccaagctggagtgaagtggcacaatctcagctcactgcaacctccatcccctgggtttaagcgattctctggcctcagcctcccgagtagctgggattacaggtgcccgccaccatgcccggctaatttttgtatttttagtagatatgggttttgtcacgttggccagactggtctcaaactcctgacctcaggtgatccaccctccttggcctcccaaagtgctaggattacaggcgtaagccaccacgcctggcctctttgcccactttttaatggggttgttttatgcttgttagtttgcttaagttctttatagatgctggatattcaacctttgttggatgcataatttgcaaatattttctcccattctgtaggttgtctgtttactctgttgatagtttcttttgctgtgcagaaggtttttagtttaattaggtcccatttgtcaatttttgtttttgttgcaattgtttttgctgtcttcatcatgaagtctcgtccaggacctatggtcagaatggtatttcctaggttatcttccagggtttttatagttttagattttatatttaattctttaatccatcttgaattgattttttttttttttttgaaatgaagtctcgctcttatcacccaggctggagtgcaatggcgcgatctcagctcactgcaacctctgcctcccaggttcaagtgattttcctgcctcagcctcctgagtagctgggattacaggtgcacgtcaccatgcctggctaatttttgtatttttagtagagatgggatttcaccatgttggccatgctggtctcgaactcctgacctcaggcaatccacctgcctcggcctccaaagtactgggattacaggcgtgggccaccatgcccagccctttgaattgatttttatgtgtggtgtaaggaaggggtccagtgtcaatattcagcatatggctagcctgttatcccagcaccatttattgaatggggtgttctttccctgttgcttgtttttgtcagctttgtcaaagatcagatagatggttgtaggtgtgtggcattatttctgggctctctcttctgttccatgggtctgtgtgtccatttttgtaccagtaccatgctgttttggttactgtagccttgtactgtagtttatagttgggtaatgtgatgcctccagctttgttctttttgcttaggattgccttggctattcaggctctttttcagttctatgtgaattattctttttttccaattctgtgaagattgtcattggtatagtttgataggggtagcattgaatctgtaaattgctttggacagtgtggccattttaacaatatttgttgtttcaatccaagagcatggaacatttttccatttgtttatatcatatctggtttctttgagcagtgtttttaaattctcattgtagagatctttcgtttctttggttagctgtattcctaggcatgttattctttttgtggctattgggaatgggattgtgtttctgatttggctcttagtttggatgttgttggtgtgtaggaatgctactgatttttatacattggttttgcatcctgaaactttgctgaagttgtttatcagatcaaggagcttttgggcagagactgtggggttttctaggtatagaaccatatcatctgcaaacagggagagtttgacttcctctcttcctatttgggtgccacctcacctcttgagtagttgggactataggcatactgcacgatgcctggctaatttatgtaaacatttttgtagagacagggtctcattgtgttgccaaggcttgtctcaaactcgtgggctcaagtgctcctcctgcctcgacctcccaaagtgctgggactacaggcatgagccactgcgctcggctgtgttttgatgtatggattcatgtacagtctcgttgtacttgctgtggacacttagatgactatggagacagctgctgtgctcacctgtacgcttttccctttggcactctctgtactctgagcagctgagatgagcacgcctgtttctccaccacgtttcctttttacttttacagacgcaggttttccctcggggttctgccatccttctttacaccttgactttgtgcctttccatagagctagcgaggcgtggcttataacatgttttctgggatatgcctggccctggtgcatggcttggaataacctgttgtggaagtttggttgttgcacaagtaggatttatggggctgtacgatctcaatgcttctgagaatgctgaactcaatggactcatttatgctcagcataatgtagtaaggcctgaagggttatgcagtaccaattactgtttccatttgtccccttgcactccagctgacattagatgccctcagagtttatgtttggagccagtagaacatcatgatgtagatgttcagcacaatgatttttgcagtcttttgaaatgtatggagacatattttttggtctagcatatggcctttttggtggacattttatgggtacttgaaaataatgtattctgcagtcattgggctattataaaaatcagtgaggccatccgggcatgctggctcgtacctgtaatctcagccctttgggaggctgaggtgggcagatcacttgaggtcaggaaatcaggatgagcctggccagcatggcgaaatcccatctctactaaaaatacaaaaattagctgggtgtggtggcatgtgcctgtaatcccagctacttgggaggctgaggcaggagaactgcttgaacccaggggacggaggttgcagtgagctgagatcgcccactgtactccagcctgggcgacatagcaagactctgtctcataaataaataaataaataaataaataacatgtaaaaatcagtgagggtaaggtggatgatgttgttttggatctttactgaataatgtgttattcagcaactgaaagtcatgcactcttgttttgacacaattaactgttagattatacacaaaaccaagcaaaaggcaaactatgcttgatctttttaaatagtggcatattaaaattatacaattcttagtaaacgacgttttagattttgtatccttctgcgaatttgataataaaaaatatattttctagaatcttttatcatatttcctatacaaattaaaatgtcctttaacctgagaaaaatattttaaacattaataggtgaaataacactttagacaattttatatcatgttgattgaaatcagtttccaaatagaaaaatgctagagcaccttataccatagactgaagtagcttttaaagccgttttttatttgttcagaaatactttaaaatatatgcataattgatttaaatattgttgagtgacattcctagattaaagtgcccattataagttgaaactgtaagaaatatgattagtagcttagactcacaacacctagtttttcataattcacacagattcacagtcatggctggacgcattattcagactgagggatcgtgtgatgcagtcggtcgcacggctcttttccgtggctctgacattcgatcctgatttaatcattctggagtgttttcaactatttttggcagctgctccaagtaaggattttgacacttgttttgctttttggtttaaggaaaaaagaacaagcattatacctctcttaaataataacatgtatctaaaataatgtcctgttttgtgaatatcccctggatgcatgttgaaaacgtagatacctggcctgggaaataggatctctgtgaagggtcctgggcatctgcattttacagtccccctcctgctgctatttaggctcactaagttacaaaaccacagctttaatggctctgcctctgtagcagggaagatgctcttgaagatgcaaattttatacttggtcgttgtgaatttgtaacattattaaaaacttattttttatggaggggaagaggcagtattttaaatgatagcaaaagaaaattaaagtcaagtactaaattacccctaattttcctcattatcctttaattattaacgttcagggcacagcactgaggaagttttctgttagtgcctatacagttctcacttccaggatttacccaaatttgttcaaatggtactattatattaccctggccccttggagtaggtttgattttctaaggtgtagaatactctagatctctttgagtgtaaaaaggtactttgttttgtttgtcctttctctgtgtttctggaacagtgatgtcgtgtttactcttagcatctcagtctcagttttctcaattgacattttgccaaattaggaaaaactgaaacagtttaatgttatcttcaccaccatttagagcagctgtcatgcgtttgtgtacgtgaactttcctgatggacaagctgtattttgtgtgaatctctgtctggtttggtctttgtcatttattatttgaggaccttcccttcgttctcaacagtgggcctaggccactcctgtttattccctgtgggtagtacagcaaatttagaaatgtggataatttttccaaatttatcacagaataaaaatacttgggattcagttcctgcgcaggccagtcacctgagactgattgtaaggggcgtaaacaaagatttcagagccaggcgccatggctcaggcctgtaatcccagcactttgggaggccaaagcgggtggatcacttgagcccagaagtttgagagcagcctgggcaacctaacgagactgtttctacaaaaaatactacaattagctgagtgtggtggtgctggcctgtagtctgagctactcaaaggctgaggtgggaggatcgcattgagcctgtgaggttgaggctgcagtgagccatgatcacgctgctctactcaagcttgggcaacagagtgagaccctgtctcaaaaaaaaaaaaaaaaaaaaaaaaaagatttcaggtgtaactgaccgggcatgtggagtcagtaggtggcggggaagtacacttttgtgtggatgatcaacagggagaaagtcttcctcttccccatgttgtcatcttttactatctttggtgctgaaggtgattcagagatgtaatatcaagcacttcctttgtcgttcttggatgtaattttgctttgagcaggaatgatgtcatgtatgttctgttttggtggtgaccctgtgagatgccttgcactatctgtttcttgccctttgtggaggaagtcttggatggaatggctgtgtaaactcagtttgaagagtttgcacgtttatgctgaagccaggcatggggaaggattgtggtggagattgctggctgctaagcctgttgatgtttatcagagaatttgggattttctagggggtgatttggccagttccgttagaaaaatgttgggaagaaaaagaaactttaaaaaacttattggggatcacaggcaggcaacaactccacgtgctgaggaaaagctaacaggggcacatttccatccttccccagcccccttgccctgggtatagtctctaacttacatactgatgttgttttggtgcctcttatggtaataaaattactgccccattaggcattttatattgatatttttgaaatgtgctataataatttttgcttttgaaatacaagtatggcagaattttcaggttaggaacatgctttaatgtaaaaagttcataattttttatttttctaatttattattttatttgtttattttttttgagacagagtcttgctctgtcgcccggactggagtgcagtggcgctgtctcggctcactgaaacctctgcctcttgggttcaagcgattcttctgcctcagcctcccgagtagctgggattacaggcgctcaccaccactcccagctaatttttgtatttttagtagagacagggtttcaccatgttggccaagctggtctcgaactcttgacctcaactgatccaccctcctcagcctcccaaagtgctaggattacaggtgtgagccaccatgtccggcctggcttttttttttcttttctttttgagatggagttttgctcttgtttcccaggctggagtgcaatggtacgatcacagttcactgcaacctccttcccccaggttcagataattctcctgcctcagcctcctgagtagctgaaattacaggtgcccaccaccatgcctggctaattttttttttgtatttttagtagagatggggttttaccatgttgaccaggctgatctcgaactcctgatctcagttcatccacccgcctcggcctcccaaagtgctgggattataggcgtgagctactgcgcctggccctattttttttttttttaagggagttcttattaatacatactgaagtttcctaaggaagtgcctttggtggatagaattttcaactatggccagtttcctttaacattaaaatatacaaaatattaaaagcaacttgagtatgtagtgaaaagacagaaaagagccataggaaaattatcgcacaaggaccgaggttgtaagttattatccagattctaatttgttaacatttcacagagctacaagctgtaaaaataagacatattaaatgagggagggcttcacatactacatttgtaacaattgtagttcacacttaaggaattcaagtaaattatgtgttagtgaaaagcagtgatacctgaaataactaaggtgttcttatttcaagtaagtagtattttagttattactaaacatgtgaaattaatttgagttcagtgttttacatgcaaaaatgggatgagttgcagggtggggatcccagaaatgtgtttaatttccattaggatgtggcatcatatgattactacctcgaattttaaaatgattgcagaaaggccgggcatggtggctcacctctgtaatcccagcagtttgggaggctgaggcaggtggatcatttgaggtcaggaggtcaagaccagcctggccaacatggtgaaaccctgcttctactaaaaatacaaaaattagccaggtttggtcatgcgcgcctgtcgtcccagttacttgagaggctgaggcatgagaatcgtgtagggccaggaggcggaggttgtagtgagccgagattgccccactgcactccagcctgggcgacaaagtgagactccgtctccaaaaaaaaaaaaaagattgcgggaatcacgtgcattaagttgttaactcccttagaatgtttaagccaccggtttactctgagttttttcctttgtgcacatgtggcttaatttccgtaagtaaacatgaattatgatatctgcctagggtgttacatggtgaccagcgtactgttttttgctgatcaggtaggtgagttgttgaattccttgccttccttcaggtgaagtggatgtagcccaggagaacatgcttttaatgcaggcatcttaatctttccatcttggggaaatatacattttaaagaagcagtgttttctgaaggcataccttatcataaatcctacttacagaaaacagtataatgaaaaacttatgaaatgtgttttctgttgtcttaatcaaaaggaataatttagttattcataaatacataccctactgtcttctgatgaatacttgagattaagattaaatggaataaattaaaacctagtttcaatattgaatcaaagctaagtggcctccctctccctctcaaaggttaataagtttttcaaaccagagtgcgtgaataatttaaaagatagcatatggaataatttcctttgcaagaaaatcagactaatatttttaggtaattcagtttactaagcacctagtttgtaccaggcattgggcttagtgctactatactctgtgtgtgtgtgtgtgtgtgtgtgtgtgtgtgtatgtgtgtgtatatatatacatgtatatatatgtgtgtgtgtatatatgtgtgtgtgtgtgtgtgtgtgtgtgtgtgtgtgtgtgtgtgtgtgtgtgtgtatgtatcatcaagccaaagtcttatagacatgtaactgaaagaccagcaggtgttaagtgatcaggtttacatttgagaaatatccccctggtggctgtgtgaagaatgaatgaggaggcagcatggaaggcagaggccagtcagcaggttttctggaaccaggattcgaatgcaggcagtgtgtggctcctgccagttttgtggaaggaggttgaaattgatggcgattgggctgggtggagatggtggggcattcaccaaggtagggactgctgcgaggttgccagactagggatgggagattacattcagtgttgtcttctgtgagtttgagtgtcttggagctgttagttcggcagctggatatttgggactaaccgtagataaatctgtgaatccaatataaatctgtgaaaagtcagtttaaaacaatgtaccaaatataatctaactttagtgcaataattatatacattagaaaaagtttgaggggtagaccaaaaagtgtcagtactggtcatctctgaggacagtgtgtgtggttcactgttttgttttcgttttcactgtccactccatattctacttctgcttaattccagtaggaaagaagcattaggtttagttataaatatagcttagaatagaaacatctttttttggactttagtatgaattggcataggaactgaatgatttaaagattttgataacctggaaatgaaataacttgtataaattgacttcattaactagatgactttattcatttcctcctaagtgagcttattttagagtgtaaagaagcaaatatttaaatttgctgccaagcagagcagcaaatggctaattaattcagaaagatgacttcccaacatttaagtgttttgtgggtactggtttggccacagttcatcaatttgtgggagcacagggcccagatatggtacaggtagagcagtgaggtgttagtgaaagggagttcggagggggccaggcctcctgcatgaaaagtgagggtcctcacgagcagtaggagctttggggtcagcctgcacaggatgggctgggcctcagtccttctagcgaaagccctcaagactttgcttatctggggccacccagtgagtcaggggacagaggttctcactctttctgttacaccaatcccaggctggggcttaataacttggtgtgccgcgctgtgcttttctgttgctttggaagtgcctggcatctcgtatggtgggctgtggagccacactgcctgcatttgaatcccggcttcacgctgtctttacttgacttctcttacctcatttttcccatctgtaaatggggtataatcatagtaactatcttacgagttttttgtttgtttgttttaaatttcagattcaggagatacatgtgtagttatattacataggtatattgggtgatgatgggatttgagcctcggtgaactcatcacctaaactgtgagtgtagtacccggtaaatagttttgcaagccttgcttctctccccgcctcccacttttggagtcgccagtgtccatcgtttccatctttatgaccatgtgtgcccattgtttagcttccacttatgaatgagaatacgtggtgttcacctttctgtgtcagttatttcacttagggtgttggcttccagttccatctatgtggctgcaaaggacatgatttcattatgaggttaagtttaagattaagccttagaattcacattaaggttttgtgctcggcaagaataaggtcccaggaaatgttaattgtggttgccgttgtcggccaccatcaccaccaccaccaccattgtcaaattaggctcttcattcttttaataactgcttctgaggttttattttgttttgttttgtttttcttcgagacaggcccttgctctgtcaccgaggctggagtgcagtgatgcaatctctgcaacctctgtctcctgggctcccacctcagccgcctgagtagcttggactgcagatgtgcatcaccatgcctggctttttgtttgtttgcttatttaagatgggtcttggtctgtcacccaggctggagtgcagtgacgtgatcctagctcagtgcagcctccaacacccgggctcaaatgagcctcctgcctcagcctcccaaaagtgcttagattacaggtgtgagtcactgcacctggcctgaggatttaaaaacaagcgagcaaacaaaccaggctatcctagatatttgtgttatgaaatgagtttctgtaggtaatcagtttcacttatttttttatttctatgaatttatagagagcatggtatatacttggcacccagagatagttgtaagaaatacattgtttattttctgtgtgttagaatttgaggattctcaatacattattaaggcaacctccacctcccgggttcaagcagttcttctgccccagcctcctgagtagctgggattacaggcgtgcactaccacgcaagaattctgaagttccttgcgtctgaatgtgtgctatactgcttgacttaatttcttacaaaagattgtcaagagatacttcttttcaagggcacagtcgaatgatgaccgtccactatcaggcattttgttatcagcacttgtgggtagtgtcaacagggatctcttggctgctgggaacttgaggttgagatgacactgcagttgcatttctgtaacagcatccttttctttcatctagccctcacatatttattgagcatctgttccattctaggcaggacttgagagattgaagtaaatagagaacacttgtccttagggatctgttgtaaaatggggagatgaaaatgttggcggggtgctggtagctcatgcctataatctcagcactttgggaggccaaagtgggaggtctgcttgagcccaggagtttgagggcagcctgggcaacatagtgagaccttgtcttacttaaaaaaaaaaaaaaaaaaaaaaaaaaaaaaaatatatatatatatatatatatatatatatatatatataaaatacatacgtaaaatacatatataaaatataaaaatctaattatatacatgtatattatatataacatgtataatactatatatttgatatatattatatataataaaggaaaatgctagcaaaatgtttgcagctacaacagtggtgttccatgttctataaggtatgtaaagttttgtatcctttttttcttagtgtagctgcattccacatacttttaaagcaagaaaagtcccatatgtaggtgggaatattcaggctggataaattaggaggtgtgttcaggtcagcctccagatgggctagttctaactttctctccctccccaaagaggcagtcttgaatattctttctacctttagttaacacaactaattacttctcaaactgtcgctgtgaaggactagatttgctttttttttccctccaacctgtggcagaacaatacttttaaaatacaatgcaaataaattactgggataaagtggcttgtgttttatgggcctttattttagctattattagagttaacagatataaaattactcagtcaagttgctgtgttctcaaaagcttactctatttctgtacttcatggagactgggaccacactttgagtaatattgcatcgtataacactgttaaatacagctgtccttaaattttctgtgtttatattattcaccagctgtatatttctggtgtaggctgtttggttatgtagcttctttttttttttttattatactttaagttttagggtacatgtgcacattgtgcaggttagttacatatgtatacatgtgccatgctggtgtgctgcacccactaactcgtgatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgctcttgcgatagtttactgagaatgatgatttccaattggttatgtagcttctttaatgattggtatgtgttttaaaaaataattccatgcctcttgttaccttgaacgttttctttctttatctttccccctcccgcttctcattccccttcccctcccctcatttttttttttttagacggagtcttactccatcactcaggctgcagtgcagtggtgtgatattggttcactgcaacctccacctcctgggttcaagtgatctcctgcctcatcctccagagtagctaggattacaggctcccaccaccatacctggctaatttttttattttttagtagagatggggtttcaccatgtgttccaggctggtctcgaactcctgacctcaagtgatcagcccgcctcggcctcccaaagtgctgggattacaggcatgagctgccacactggcctgaatgtactgtatctttcaatccttgggttaggcttgtaggtgtcctaaagcattgggttttgtggggctctagtgttaatagtattataagtataattgtattgcaggtattcatagtattcagtactttctctagagacctatttctccattttctcatgttttattttctttaaaatttttatttttatttttatatatttagatagtacaagtgcaggttcttacatgctcatattgggtagtggtggagtctgggcttttagtgcatccatcacctaaatagtgaacattgtacacagaaggtaattttctgtcctcacaccttgcaccctcccacctcttggagtctccagtgtctgttattctgctctgtgtgtctgtatgtacccactgtttggcttccacttgtaagtgaaacatgcggtgtctgatttggtgatttcacataggataatggcctccagttccatccctgttcctgcacagacgacttgtcttattttcgtgacctgttctcgagctcaacttcagttcagtgagacctgagataaaatgaaggaaagatgttcctgttgccttttgaaagggtataaaaacaccctccctcctctttctgtgacatgggaggtggcgttccagactcctaattcgtaatgcttgtgactattttgttttgtgtttctctgagtaaaatatgtgtatttgagcatccgatcactccatttctcattcactggaagaagagagttttcaaagagcttaacaaaatagtcacactccgagggctcctggtttgaagtaggagtggtgatttgatcctatcctatagccctctgtctattttggcaaggaatgcgttgagagacttctttgaacctgatgtgtgctctcacaccctgctgactccagggtgttttgctacaccctgttttactcttgacaaactacctccggcctgtttgactggtgcagttttaatttggtgcagttgaggcgtagctggtttccctggtgaacctggagtccacactgccggatgccgtctgtgccgtccattgaggggttacttaggtggtggaatgtgttcccctattttccacctgctttccattttttaccctttacttgaggttttgccctttccttgaggactgagcaaaacaggttgtttatttacattttgggtggactgtttatttggggatcattttattctgttgttagtcttgaagtctgtgctgttgaggattttgtcttcctaatgggttgagatggcagacagagcgaaggggaaacctgcaaagaggtattactctttttctgggacctctcggaaggattcggtgaaggcgttaaggttttcaaggtcattgaacctcaagagagccacttcagaagtcagcaaaaggcaggttggtacagaaacttccttaaaacacccctttaatttttattttcttggtgggcggggggaattgaaagtcatgcttactctttgtgtttactccttaatattattttgaaaaagtttcctgattaatttttgaacatttttgttttcaaaatcatactgatattttctgtgctatcaattcatttgtgaatgcttattatttattagtgtttatgtttattcacttattgcaagggtttaaattactgtatgctgcaatactaacaagttgtgatattagcagatccttattactcgtatggaatctcttactaaaacatgtttttaatggagaccctgatgttacccaaacatctcactaaaaaggattagttgatttttatgtataacaaaataatggaataaaagcaaattagtgtttctccaatttcacagttctgtacattgttcagaattaaaaatatttttttctgaaaaatactttgggccaggcacagtggtatatgcttgtaatcccagcactttgaatggccaaaggaggtggatcacttgaacctagaagtttgagaccagcctgggcaacatggtgaaaccccgtctctacaaaaaatacaaaaatagccaggcatggtggtgcacacctataggcccagccactctggaggccgaggtgggagaatcacctgagcctggggaggttgaggctgcagtgagccgagattgcaccactgcattccagccttggtgactgagtgagaccctgtctcaataaataaataaattaaataaataaataaataaattaaaaaaacattttttaaaaagaattctttgaagctactggatatatgactgtaagtttaggctatacaatcaatatatagtggatcttttaacagtgttataaagattccttttcttaatgttgatatttttggagctagtttgtaattaccaaacagcaataacagataaaaagtaaagattaccctgcacataaaatgtgctttttttatttttacttttggatgagtgccatgggttatgtgtgccctccggtggtctttcattagaacggtgattttcgagctgtgaaaccattgagagttagtcatggtatctgtgtccccctgcccggagaagagtggtgccttgcagcattacagataggtgcttcagaactgtttccctcttcatacaaattcagctcaaatgtgtgatactgattctggccagtttatgaatgatgtgtgttttgggaatatctcttaatggtttatagaatggacacttaatatgtcatcaattctacacttattttggtcctcatatgtctgctaaatcttgcagttttagtttcttttcttttttttttttttgagacagagtctagatctgttgcccaggctggagtgcagtggcatgatcacagctcttggtagtctcaatctcctgggctgaagcagtcctcccacctcagcctctcaagtagctgagaccacaggcatgtgctactacaccctgttaattttatttttttgtagatgtgggggtctcactatgttgcccaggctggttgcaaactcatggcctcaagcagtcctcctgcctcagcctcccaaagttctgggattataggtgtgagtcactgtgcctggccagtttaatcatctttcttatattttccttattggacaacactgaaatactgaaaataaatcaagtccaagacattccaaatctctattttatatgtaacatacttccttccgcagaaactgccaccatattggatgtttgttggtaaagaattttcagcaaacctgattttcttcgatgtgatattttcttcaaattaatgtaatttgagtaaagacacagaataaaacctgtttttaagacattaaactttctgtgtagactatgcagaaagtaataccagaaatgaatgaggaaattcagagactgcctaaaagtattgttgctgattctgttggcagaatcttttctcttccctttcgaaaaatcatagtttaaaactgcttgaacctgagggtggtggcctaagtgttggtatttgccagttgagaatttaagaatgagtgccttgtattgtcattaagaattccataatattgtttatagaagtagggtgttgacctagagatctctgccaaaacctaatttgtctaattaaattccgccgagcatttctaacttccttccctaaacgacttctaattgcgtgtcgttccagtggtagtgatgataatgatgatgttctgcccttgtaaacatgcctttaaattattaagttctaagctggcaggtaaaatggaattacttttcatcttaaagatgagatgtggccttttgggggatgtgtgtggatggggacattgcgggtagacgaagaatcaggtagacttcttgtacaaaattcctggatcatttgtttattgtgggaaggagcactgctaagaaagacagactttttccccctcaagcaggaaccatcctctcttcagagcgttttgtttccctgctaggagccaggatgtgacatttaagcagccatataaatttcagttttgtgcatcactttgaggtaaggtttccgtagaaaacataagttttaaaattgttttgtgtgcgcttctttggggagggagatgtagttggaataagagtataatacctctgagatttgtcaagagaattgagaccatgctttttccctgctgctgttgagttatggaggcggaggcttgggtgcgttcaagatggggcatcactcgttacctgtggcctgccttggtggctgaggagggcattgctgctggcggtgtgatggttgttaacactgctttacaagcggtgctgaagaccactctcgtccatgatggcccagcacatgagattcgcggagccgccagagccttagacaagtaccaagcccatctttgtgtgcctgtatccaactgtgatgagcgcgtgtgtgtgtgtgtgaagttggtggaggcccatgtgctgaacaccagattagcctaattaaggttgatgaaaacaagaaactagggaatgggtgggcctctgtaatactgacagagggaagaccctgtagaaaggttggttgaagttgtgtaatagttaaggactatggaagttataaggaatctcaggccaaggatgtcattgaagagcactttaaatgcaagaaatgaactaataaaactttggttcacattcctcaaaaaaaaaaaaaaagttggggtattgtattaaatggaataaaaaagagaagctgaaatatcatattggggagttttctgagctcactgggtgagaggttcagtttatagcatagatgattgaaatttctgcctcagcaaaagcagaacatggtttttgaagtaaatggttgaaattcatgcatccagatgtctgtatgactgggttcatggacttcaatcatcttctttgacacctaggttattattatctatatatctgaatctgtatactgacttctaggttttgattatggagaaaataacaaccaagatgtagaagtccatcagaatgatacaatctgacaaagttgcttaacagcagaaaaacaatgatgctaactcagaaagttagatgattttacaaaattcaacaaaaaagctttaaaagctgtaaattagagatataaattataggttacctgttaaaaaagacttccttttcaaggaagtattaatagaagacacaactcaaaataatactgccttgatcttgtaaggccttgaggtaattgtgaatccccttgatagaaaaggtaagaagcaaagcaaattgggtggattttatatttaagcaatctagagatttataatatctattacgtgcatatacatgtgtgaagacaacatagtaaggtgtgttgttttatagttttctgtgtcctacttaaattggcttgcagtagaattatagttaaattgatgcagggcaggtaagccccaaaattgggcttagaccgggaaggttcttggctttgctcaggaaagaattcaagagtgagggctgggcacggtggctcacgcctgtaatcccagcactttgggaggccgagacaggtggatcaccttaggtcaggagttcgagaccagcctggccaacgtggtgaaaccctgtctctactaaaaatacgaaaattagctgggcatggtggcaggcgtctgtaatcccagctacttgggagcctgaggcaggagaatcgcttgaacccgggagacggaggttgcagtgagccgagattgtgccactgcactccagcctgggcaacagagagaaactttgcctcaaaaaaaaaaaaaaaaaaaaaaaaaatcaagagcgtgcaggtggtagaagaaaacagctgtattgaggctgtagtgttacagctctgtggctgctcccgcagagcagggctacccgctaggcagtgagcgcagggtggcagctcaggggcagttctacagtcatgtttatacccacttttaattaatgcaaattaaggggcaggttattctgatctttctagaaaaaggtggtaactttcaggtgttgctgtggcagtgttaaactgtcgagctggtggggatgtcttgtggagaggtgctttttatacagtcgttctttgtacaatagacagtgctacttcttgttaacgaagaaatacagatataaccaggataattttgagtacagaactgttcatcaaaaaatattaaaacatacctatgttctggctaagtgctgtgttagaaaactacttgctaagaatatgtaacaagttgggaattagaactctcctcctgtttgtttgtttttttttttttgatgcagactctcgctctgtcttccatgctggagtgcagtggcacgatcttggctcactgcagcctctccctcccgggttcaagtgagtcttcagcctcccacatagctgggatcacaggcatgcttcactatgcctggctaatttttgtatttttagtagagatggggtttcaccatgttgcccagactggtctcaatttcctgtctgtctgtctgtctcgatatcttttcttctctgtctcttgtttgtagtagagagaataactttgattcctaaatagaaaacagaatatatatgtgtggatacttgtattgtgttgattgtcttcattactagtttcctaatcgtagcagaaaaggtggtgttggctactaatgtcaccccagccctaaaggagtaatgtgttcttgataagtttgtgacattgctttcctgtgtaaatatgaaaatattctggaacttgatttcttgttactcttgtgttgtgcaaattgtgtgttctggcttcctttaccaaccacaagtaatgagaggttccaaaacttaaatacaattcatattttcgaggatagcttataatttttgaaataattaagtttagctttatgtaactaggtaaaaatgtgcatatcacagtactcaagatattagtttaaaatgaaaaacaaaaaacaccttaagtttttgctatctttagtttaatctgtggcaaataagctttctcccaaaatcatgctctccctagatagagagattcctgatttggattgaagcaggttctccttagttatttttaaggaaatatcatgcagtgtgttgagcattaattcttccggtgcttcccggatctccatgaagattttttttttccagaaatggaagccaagtttaaactatgctgagataaggttggatttaagaatagaatcgtttagatcactgaagccctagatgttcaagagaaatgaagtacatataggtcagagagaggatggaatttatcatcctagaggtattaacaacaaaaaagactgctgaatacagttcaatcaagaaagaatcaagcaagacaaggtctttaagttttacccgtattccacatcccttactccagatagaatttttgccacttcatactactaagtaaagcaggcaacagatgtcaaagtacaggaggatcaacatggaaccattgcttattttgaagaaaaaaatgtagatcatatagttagaggattaatacatatttcctgaaaggcaacagttcttctacaaggagcatactggttatgtgtttttagaaatagggcctcgctctgttgcccaggccagagctcagtagtgtgatcatagctcactggaacctcgaactcctgacctcgagcagtcctcctgccttggcctctcaaagtgctgggattacaggcatgagccaatgcactgggccgttcatgtgtttattaatacaaagtggatataatgcagttaaagttaggaaacacggtacatattgagaactgttagttacatgattacatgatcacagcgaggagctgtttctgtaagatcagaatgaatggagcatgctgcctgggaacctgtagctgcttggttagaatgagtgggtgctcagctggtggtaaattttttgtttacctttttgggttgtgaaccagctgcactgtaatttatgttaatttgtgctttaaaagttttcagggttgtactcgatcttaattgtgggtgagaaagatgaaaattatgcataaatactaatggcagtcgtgaaagggagagaggttattcttttttgaaaaaacagaatcctcctctgtcacccaggctggagtgtagtagcgtcatcatggctcactgcagcctcgaactcctgggctcgggtgatccttctgcctcagtctcccagtagctgacaggcatgcaccatcatacctggctaatttttcactttttgtacagatggggtctccctatgttgcccaggctgatcttgaatgcctgtcctccagcaatcctcacaccttggcctccaaggttatccttttgaataaaaatcatatgtaactaaacccagttttttgtgatatgtaaatctagagttatatctttaaaactgtaaagcatgtttttgtaattcatgacctacttcttttttaccttaggagtgctacttctgaattcttgcagaagtacagattgtacagttaatgctgatctttgcgatagatagaacaacttacattaactgtgaaaagaattctccctgatgtggaaatacatataatcttattttggcaagcattttacccctttcagtttctgcttttcttgatgtttaaatttatcttgtagccttgtatggtgatagcaactccttggtatttttcttgattttaattttcttctgcagtttgaaagattgtattcattgctgtgatgcatataagatttcttagtttttttaccactatgttttaatatgaaatgccaaagaattttaaagtttttttaaaattaagatttcaacgttgtggcctagatgaatgtgttacttgaggaaggaggttttaaatgcatcctatttaatgggaaagtttgacttgcgtgcatcactttatttttccctaccaaaatcaacattttatatcgttagaatatctatcgatatatttgggttacctgactcaaacctgtttcttaaaagcagaaagcagttaactatttctttataatgcttctccacttccattggaaccatgacattgcaacagaaattatattcacaggcaaagtcccacagcaactgtcttatgctgtgtgttgcagcctaaacgcttatttcttttgatttgaaggctgtaattcttactgcgagtctcagtaacttttgcaagagcagccattgacaggtgcccgccatctctctagccagatgctacctcatctgcctctgtccgatgactctggagttggtctggtctcaatttagtaaaacttgatggccgccgatgtgttgctgaagtaatcagttgtaaaatgaggaggtagaaatgtattcttgtcttttctgggaggttcaggtacacacaacttcaggttgatgatgatccaagttccttccctgtttgtgtcttaaaaacaagattgaaagcataaacaaaaccaacaacaaagttctttgatcaagggaagggattgcaactgttcacggatggaattggattggaccctgaattcttacagcttgatttgactttgtcatttagtgtaggatttcttaaccatggtttcactaggtgcttatagatactctaaaacatgcacacactcatacatcccaccccatagatgcccagaaaccactcaggactcgctgaatcagaatctccagtggtagtgggatggggttggggctagtcaggtaccctcacttcctcccgcaaaggtcccaaagtgaatccagcctaaacattgccaggtgaagaaactgaagtctagagcaccaggcgatatgaagataatagaactgtttagtgacagatttgagaaagaagccagtggcatttgagcatatgccctgtgctcaccccagtaagaaatcagaagcatagtggtgcagatcacctgcctgagagccagcggcggcctggcgagccggtgtgcacgcgctggctggtattggtgtcagctttcgtgaaggcgtcccttgtgttttgaggcttctcaagttctgaggaagcacctgcagctgcacagaggtgcgtgtgcatggagttgggaggctagccgccaaatgctgctcagattcccaggccagagagatggtctttatacgtgataagagcacggataagccacctgctttggggtcaaaattaaaaagtcaatatacaagtctttaacctggttactaataaagaatctctcagccctgctaacataacctgtgactttgttcgtgttagccattttctggttatctaactttgaatgaccttttcactataaatcttttagacacataggtgtagctttgtcaaagagtactatatttttattcttcctagtagaattttacttttatcataggattgaaagccaaattttaaatacatccttttggaatatgtttttgtacctatgttagaggaccatgtgaggtgtcagataccttaaatttttttttaaatcacattttaatgcagatactcagaacatcaagtcattaaattatgtgaaaatcagtattttgtgagaagggtccagttccttttcatttgttgcaagcaaattatcacctgcttctctcttacggtgcataattttgttagtaggtaaggtaattttttctgtttttttttaatgtttttaaaattgtgtaaacgtaaggaatacaagtgcagtttcgttacatggatatattgtgtggtggtgaattcttggcttttaaccatcattcaatatgttgctgtacccattaagtactttcccatccttcaccccctcccatcctcctgagtctccaccgtctatcattccacactctgtgtccgtgtgtatacattatttagctcccatttataagtgagaacgtgtggtatttgactttctgagttgtttcactttggataatggcctccagttccatcaatattgctgcaagacatgatttcattcttttttatggctgaatagtattctattgtgtctgtataccacattttcttttatctagtcatctgttgttggacacttaggttgattccctatctttgctattgtgactagtgctgagatacatatatgagtgcaggtatctttttgatataatgacttcttttcctttgggtagatacctagtagtgggattgctggatcaaatggtagttgtaattttagttctttgggaaatctccatgctgtttttcatagagtttgtactaatttacattcccacctgttttaatctgttctgttcactgctgtatccccatgtcctagaacaatgctcataagcattcagtaaacatttgttgaatgaatgaatgaatggaatggaaatgaattaatacccaatctatctttgctttgagaaggtcctattatgcaaataagtttctcttaaaaaaaaaaatcaaacttttaaaaatttttagtagagacggggttttgctatgttgcccagcctggtcttgaactcctgggctcaagcgatcttcccactgcagcatccaaaagtactgtgattataggcatgagccactgtgcctggccaagtttttcttcttttgcttatcaatgaaaattaaatatgtaccataagatatatctttgaagataaaaggctttggagtgttttcttcttcctgtgtttgaatatatatattgtgggagtcagaataatgctatagagccaggtttggaggaggagagacgtctgtttttcatcttcctctctctgctcttcctggattttgaactctcttgaagctactcacatggatgtgaactgtgatagatgactgactcctagttcaaaactttgatatgatgcagtgactatgattcagttgcactgagcaggttatatcaggtagagagcacccacaaaatctcatgatagacaatactataatgaaaagagaagggttctccagaggaaggtatttttatgctagtaaccacagaacttttttgataaggccaagaaatttactgagcttttttgataaggtcaagacatttgccagaaaagaggcttgtctcggcacatagtcctggagtcttgatggttttcatttgtagttgttgcagatgaggaattatttgttgcttagctgtttttttcttgcatttacgaacccgtggtagttactgtcttgcttatttttccaccttgaccatttcaggccgcttgaggacaatccgtatccatcctcactccatgcaggaagttaaaggctgagcaggagacatgcaccattagtgtactgcacctcctcttcccctagtttaagaacatcccttcttctcattcccctttatgtaactttggaacattaaagcagcagatggtttctccttcaggctgcacggaggagaatggagcttagcatgatgtgttatccttaataatgtcatcacaatattatttgtttcttgtggaatttaaaaataaacattagcctcagtggctgatatttatattctgcttaatttgccatgcctattcaagctggctgtcaattttggggctggtcttactggcctggactagaaagatgagtttgtccgatatcacccctatgtgaatgccttaatgcttagaatcatctagcaaatacttttccaatatggctagaaacaaaatcatcttaaatcattaggcatttttcagtgccaaaggctatcaaatatcttttttccccattgtgtttttatggttcagtgatgaataggtgacaattttgtagccttaaattcctgcactatcagtaacaccgtggtaaatgccactgcagagaaaggcaccattgatctccccaccactgcctctgggatgctttagacattgacagatgtgctttgtgaaaccttgtggaatgacacttggggtttggtctgttctttctttagaaatgaaacttttatttttgacctattggcatttctttagcagaaagatcactcctactagctatctagatttgctgcagatgatttgttcattttaatgtttggattttgttcttggattttctaacctatttctcaacttatgtatcaataatcttgttatacactacctgttctatgttggccaggctggagtgcagtggtgtcatctcagctcactgcaacctccgcctcccgtgttcaagcgattctcctgtctcagcctactgagtagctgggattataggcatgcgccaccacgtcggctaatttttgtatttctagtagagacagggtttcaccacgttggccaggctgataccaaacttctggcctcaggtgatccacccgccctggtctcccaaagtgctgggattacaaggcatgactcactgtgcccagccaagtttagaatatatctgaaatattctaaaaggtctgaaatgtatgtttgtgtgtgtgtgtgtgtgtgtatatatatatatatatatattttttttttttttttttttagggggaggggtaggtgaggtggaaggttctgtatgcaaatcaaggtctggtttccaaattaggtcctccaaacaaggtcagattgaaaactgaaggcttcaggttttggaactgtcaatcccatgttaggtgtgcctgccctgtccctctcttcctgcctggagggctgagggtgaggcgaaggagtccagaagcagaagtacaacacatgaggaatccttttgtggactcctggacgttagtaagggtggacctaagtatctggcaatgtgctcggggttttcttgagcaattcctcgagtgccacctagagtctagtggtaatactgaattaacttctaagctttgtcaaggagcatggagaacttgagattctcagacatttttattctgtatcatgaagaaactcaatagtaattggaatcaggatcagtttctggctgcttgatcagccatgtaattagtcagcatggtatgaatatgtacatgccggagttcagtaatataccttctatacttaaatggggatttttctttgagaattggcttttttttttttgataagatcttgctctgtcatccaggctagagtgcactggtgtaatcctggcttactgcagcttcctgggctcagccatcctcccgcatcagccttcagccttccaagtagctgggactacaggcatatgccaccatgcctggctaatttaatttaattttttttttggtagagtcagggtctcacttggttgtcaagctgatctcaaactcctggcttcaagtaagccccttgccttggcctcccgtggtgctagaattataggtgtgaacgcctggcctagaatctaatcttttcttttcttttctttttgttctgttctgttctgttctgttctgttctgttctgttctgttctgttctgttctgttctgttctttaattgagacgaagtctcaaaaagcccaggctggagtgcagtggcgccgtcttggctcactgcaacctccgcctcctgggttcaagtgattcttctgcttcagcctcctgagtagctggaactataggcacgtgccaccatgccaggctaatttctgtatttttagtagaggtggggtttcaccatattggccaggctggtctggaacccctgacctcgtgatccgcctgcctcgccatcccaaagtgttgggattacaggtgtgagcaccgtgccaggcccagaatttcttttttttaaaaatttttaaaatttttttgtgatgtagttttgctcttgttgcccaggctggagtgcaacggcacaatctcagctcactgcaacctctacctcccaggttcaagtgattctcctacctcagcctcctgaggagctgggattacaggcatgtgccaccacgcctggctatttttttttgtttgtttttttcagcagatacagggcttctccatgttggtcaggctggtctcgaactcccgacctcaggtgatccacctgcctcggcctcccaaagtgctgggattacaggcatgaggtgcgcccagccttagaatttcttttttagtatgattatcccctagcttatttgaattactattttaataaacacgttctggaaatcttaattattaataactttgattgtattaggcatgaaaagttaggcagattttttttattttaaaaaaaactttgtaattgtggttttacttatattgcctctattcagtaggatccccctccctctccccctctctttccctccctgtctctgtctctccctctctcttcacacacaccacacacatgcacaccaggaagcagttctgtactgtctacaaattctctgtaagccatcatagaagagaagtgaatcagagaaggggattcaacattctacatgctaagacctgtccggcacacacctcttcacagccttgtctgaagtgacagactgtagcaattgctaatttgactaagaaaaaggtttctgggccaggcatggtggctcaggtctgtaatctcagcactttgggaggccaaagtgggcagattacctaaggtcaggagttcgagaccagcctggccaacatggtgaaaccctgtctctactaaaaatacaaaaattagctgggtgtggtggcacatgcctgtaatcccagctacccaggaggctgaggcaggagaatctctggaacccgggaggcagaggctgctgtgagctgagataccaccgcactccagcccgggcaacacagggagacaccttctcaaaaaaggccaggtgcagtggcttacgcctataatcccagcactttgggaggctgaggtgggcggatcacaaggtcaggattttgagaccagcctgaccaacatggtgaaaccccacctctactaaaaatacaaaaatgagccgggcctgggggtgcacacctgtaatcccagctacttggtaggctgaggcaggagaatcgcttgaacctgggaggtggaggttgcagtgagccgagatcacgctactgcactccagcctgggcaacagttcgagactctgtctcaaaagaaaaaagaaaaaggttttcgattgcctttgctattgattcagacagtgacataaccaaatatattaaaaagaactcccacctctggtctctttggtctcggcggcagaagcgagatgaggaagggagtgtcatccttagggaaacatcgcagctggacacactccctgtgctgctgcggccctgaggccccaacctgctaagccaagagaaggcagaactggagtgccaaggcgaaaagacgaagcaacaccagggctggttgaatgaggcgcctaaacattgtacactacagattcaggcctgggctccgtgaaggacagcacccagacccaagggccagctactgcacctcatcttcagaatttcagtgattggtcatggaatacatgttctgtttttttttttcttttaaagaattctttgggaataacaaaaactgagggggaaatgaaaagttttgtggatgaatagaagaatgacacagcttctttaaaatgtttgacacttctggaacctctgaagcataaacagggtgccaccccactgtgttcagtgggcctgtcagctccatcttcgtctaaaatcagatgcttggaagtagagaaggaactttttttaaaaattttttatttttgtggatacgtattaggtgtgtatatttatggggcataagaaatatttcggtacaggcatgtgatgactaataaccacatgagattaagtgggatatctaccccaagcatttatccttcgtgttacaaagctctgttgcccaggctggagtgcaatggtgcgatctcctctcactgcaatctccgcctcccgagttcaagcaattctcctgcctcagcctcccgagtagctaagattacaggcatgcactactacgcctggctattttttttgtatttttagtagagatggggctttgccatgttgcccgggctggtcttgaactcctgagctcaggcaatctacccgccctggccctcccaaagtgctaggattacaggcatgagcctctgcacctggcctcttttagttattttaaatgtacaatgaaattattgttgcctatagtcaccctgctctgctaggaaatattagttcttattcattctttctaactgtatttttgtactcattaactccactcccctgctcccagccccacacccttcccagcctctggtaaccatcatctactctctatttccatgatttcagttgttttaatttttagctcccacaaatgagtgagaacatgcaatgtttgtctttctgtgcctggcttgtttcacttaagatgatgatcttcagtttgattctttttttttttttttctgagacagtttctcactgtcacccaggctggagtgcagtggcactatctcacctcactgcaacattggtctcccaggttcaagggattctcttgccccagcctcccgagtagctggaattacaggcatctaataccacgctgggctaatttttgtatttttagtagagatggggtttcaccatgttggccaggctggtctcaaactcctggttcaagtgatcctctcacctctgcctcccaaagtgctgggattacaggtgcgagccatcgcacctggctgatctcattcttttttatggctgaatagtactccattgtgtgtatgtaccagattttctttattcattcatctgttgatggaaacttagtttgcttccaaatcttggctattgtgaatagtgctgcaatgaacataggagtgcagatacctctttgatgtactgatttcctttctttaggttatatacccagcagtgtgattgctggatcatgtgatagctctatttttagtttttaaggaacctccaaatggttttctattgtggttgtactaatttacattcctaccaacagtgtatgaggttttctttttctccacatccttgccagcctttgttattacctgtcttttgggtaaaagccattttaactgtggtgagatgatatctcattgtagttttgatttgcatttttctgatgatgggtgatgttggggaaagggaacattttgagaatgaggaatactgatgaaagggccagaagttcattttaggcactccgagatgtcagccgagcagttgtcttaagtagctccctgcccagtagtagccttcacggttaggcctgcaggtcaaaggagcagaatttaaccatctccccagggtgcttacatgcaggatctggctgcaggaccttctttccagtggggctttcaaggtagaaatctgcctctttcttggactgctgcactactccatgattgggaacctttatctaacattgattggataaaatgccccaccttccacactgaagggcttgtctcaaagtcagagcctcttatctcatttactgtctgggcggtccctcctttgacagctgttttgcccaacatttgataacaattctgatctttgtgattctttaattatagaccattgaatctggatgaaggccagatgatggatggaccatagccaggcccaatttttgctgcagatgaataaataggtcatgttcattcttgcttcttccccctttattctatgcaataaaacatccggctctactaatagctctaacttgctttttctaacctccgtagaaaatagatttgcccgtttttcccctcccaggttgctttgtattgattaacccatcaggccatcagagtggtggttagccaattcatgttctttcatcaaatttggggaaaaggaccctaatcaggcatgatcaatacaaaagtttgacatttgcactgtataaatgtcccgaggtactttatttgtacatttcttttagcatttttgaaactctgtattgtttcataataaactgttcctttattaattatagatgagttagctttgtcagcacattgggtacaagaaatgcatcgttttgttccttgtttctcaagtagagtgattatagcttcaattaaaaatgacttttttaaaaaactgagattcccatgatgctctgaagggctatgttatgtcaaaagctgaaaaccgctctgttacacagaatcctcaaactatctccaccagtcccattagtcataatctgagtgtttctgccccatgtaaaaagtgaatttaatgtgcaaaagaaaagaatgttgtcaattctatttttaaaaaagtaacatttatttacattactatttcattatgtcagtagattcagcttctcagtggtagtattgagtattagggataaattggcacacaaccaaaaaaaatttaaaaaattataatgaaacacaatatttctgtgtgatgttttaaaataattttccagtctggaaacagccaagcatagcttctgttttgtgccttagttccttgcattcttgctgtgcaggaattgctatcctatttggtactgatggaatctggtgttggcaacttcagccaaaaggatgcctagtggttgctgaacttacactttctaaccctgagaattgtccattcacacatgcgttggtgtgcattcaggtcagtgagcggatgacagatacactttattctgaaatgcatggctatttgcccggttttgctgtgcatttcagcatccgtgtgatgagggctgctgtgtacatggccatgccctccgaggctcccttaaacccaggtgtgtagtgcagccccgtgcacagtgacatacatctgtgtaagctcctttgaaaatacccctgtgttaaagatgttctttatgtactaaaattttattctaacttttaaattgcccctttttagagaaaaataagcatagataatgtaagtatttatctagatattatttgttgttacctaaacttctgtcctgagataagctttaattaaaatcaaggaaatgtttagaaattgtagtttcaaattataaaattatcttctcccaataattggagttgggagagaaatacacacaatggagggagaggcaggggaaaaattgcatgtaatatgtagctatgtttggctagtattttaggttacagtttacattgtgttttcttagagttattgatgttatgggttatttcaacaatagaggggaagatttggggaaaacatatgcattttaaattaatatgttttctgccttccacaaagttaaataaattctgagagatttctgagtactttttggtaaattcattttatgaaaatgaagatgctaattctagtttgtggctaatgtaaataacctttgaatggattatttctagggaagaaaatgcatgcgcggaagcaaaaagtacctaccattgaaggcccttgggtttgtgttttataacctagatggcctggcttagtaaaacaggttctaactaggtacctaacttgcactacaggaagaagagaagtaaggctttactgagtcaggtggtatgaattagaaattaatagtattatcctgagtggagcttggtggctttttcagtggagtcattttcaccatccttttacattaaaaatgtaaattgattcacagtggggggaaaataaaaagtgatctagatgtgtaccttaaggaaaagaattcatacacctttattcatgtatgctattatgtcttcatttacatgttattatgtatcatctagcattatcctatgaaccattaagaaatggcctctgggtgctacaatgtgagtggcacttcctttaaaataccccagccaaaaataaaaaaagtgaagcaatgaaacagttttggcgaagattaataattactacagctgagtgagtgatacataggagttcaataaattatcctctctacttttttgcaagtgtggcaaattagatcattaaaaaaactaaaaagtttttgtaattaacatttttaaatgttgggaacaaaacccttagaaataattttattcttgctctgttatttagtggaggaaactcagggcagatgacatgtgttggtttgtcctgtgtgtcaaggctccttggaggcagagcctcttgggaggtgcaggtttcctggttcctcactttgtgctgggtgtgcctttcaggatctgattcctgagggtgtgtaccaagccagtactgtgtgtgcgcttgcattgccttactcttcactaagaacatggaatttgtaggtaaattctaagcagtgaaattgtagaaactaaaacactttgaaaataatatatataaatttagcatgtcttctgtgacatgcacaattataaatgctgtacttattttaacacacgtggtgaactctgtgaatgggctctggtgttttgtccattttataggtgaggaaattgaggctcagaatgcaccaggattaagttgttatttctcagctgcagttcagccatttgtgctctgcttttcgaggagacgtctcctttgctagctgctccctggagctttagagggagctggagcctggcaggcaggaggggggacatggcccttgtttgcttcctgttcctgtctgcattgcccagcaatagtcattaattggcagttccttctcgtttttagattttttccccctgtccacatctttaggcccccttaacagaatcagcaccgaggtccttctgctaagctcctcatgcctcagcctcagcctcagccccagcccccagcatcttctcctcggagggtgggtaccgtctgcccctggtgccgccttcaagcttcaggttctcataaccgaatttcctcagttccgcgggtggtaggtgtgctgcagttacctgtttaccctcttccttatattaaggatttgttttgtgatttgttttccttactcgatcctgaccttatttttggcatttattaaatgatattcagaattcagcaaattgaatttattctaaggaatattgtaatttaaaatagtatctagttattagtactagtacttatttttacatctttaccaaaaggtataaaacacatttttaaaaaaacatttgaataaatccacttatgttgtggattcttttttttttttttgagacggagtcttgatctgtcgcccaggctggagtgcagtggcgcaatctcggctcactggaagctccgcctcccaggttcaggccattctcctgcctcagcctcccaagtagctgggactacaggtgcctgcaaccacgcccggctaattttttgtattttcagtagagacagggtttcactgtgttagctaggacagtctcgatctcctgacctcgtgatccgcccacctcggcctcccaaagtgctgggattataggcgtgagccaccgcgcctggctgttgatctcttaaaaagctgagaagtggctaggtgtggtggctcgtgcctgtaatcccagcactttgggaggcccaggcaggcggatcacctgaggtcaggaatttgagaccagcttggccaacatggcgaaaccacgtctctactaaaaatacaaaaattagccaggcgtggtggcgtgtgcctgtaatcccagctactcgggaggctgagacaggagaatcacttgaacccaggaggcggaggttgcagtgagccaagatcgtgccactgtactccagtctgggcaacagaacaagactccgtctcaaaacaaacaaacaaacaaacaaacaaaacaaaactgagaagcagaaaggtgacagtgatgtgttaattactaaaatcatgtggctttggggaaggacacagatccaatgagaataaatggttatcaggtgattgtcaaatagatcgaagtagactttttttttggacaataattatttcatcaccagatgaatttcaggccaatacaaacatcattgtctcagttcctacctttctctcccatttcaccctgaaatttaaggaactatgaaatgtttgaaagtgtgcatgttctcgatctggcttttctgacttttttttttttggtagaggtgggatctcctctgttgcccaggctgatctcaaacttatggcctcaatcagccctcccagaggtgctggaattacggacatgagccatcgtgcccagctgtgatctggcttttcttatttatgcaattgccaaggctagaacagacctgggccttatttgataagtttagggtcaaagtttgcatcagatcgtaattctacacagagtaaaaagtagaaaatgtgacagcttgtctcttctctcccttaggcacagtgttgaatgtttattagaaggctgtttcctcacaacatgtttacatcaagatgcatgcatgccttagcttgatgcttttgcaatttttatgtagcatctgttcccaaatacaagagcgctaacaaggccttaatacagatagcagtgaggacagcagggagttgcccctgtcggtttctgacttctcctgcggccctgagttattattcataatgtaaattctctctcagttcccagcatgtacataattaatggaaaagactatccaaggaagttcagcagccacaagtaggtcaccattaccagatgtttaattattgtcattaggaagcttttggaaatacctgatgagctttctaaaagcataacaataagcaaatccttttggattttgatggattggttcttttgtattgaatgatgattaaggttattacaggcacagcactctcgccttcttccgaacatctttatcaaaagtaataattatgctaccctcgatatgaaatgcacgtcactctcctttcatatgttctctgatttcaactgtgccaagttttaattaatgtacttcaatagtacgaaaacttgagcatctataattacatctttagtagcaatatttaaaacctttactgacaatatatttatcatagaacacttcctggaattaaggtcagtttatgtggaactgacatgcatttcagataggtttttttttatcttgaaggttaaaagtagaatacaatataggagaagctaagagaagcccattaacattacaatttttgtggtttatggggggcagtggtgttaagtaagtttaacaaaggcagggaattttaaaaattactctttacttttttcttcaacatcaaatttgtataccataaaaaattttgacattttgctagtatgtgagtgagccattcccaagtcatccttttcaaatgttgtttgtttttgagttcacgttgaagaacacgattaaaaaaattcttttggttttttaattcagttcagaactgaatttaaaaatcagaaatctcagtgtctcctgctctttgctgctttccttcatggcatctgttgttactcttagacttcattcattcccattttgtggcttgtttgtggaatttaaagttcttaaaagcccaatttcctggtctccagttacttttaagatggacccattggctcccccttgtgtctactctttgtattgtcatcctccaggctcttggttaaacagcttgtaaggtaactttattactgctcttgaggaagggacaatggctatattcgtcagcgttctcatccccttatttactctcctctgcattctgccctcttctgcggggttggtagagaatagcttgggaagagccataaaatggaaggtcttgaaagccagacatcagagtggagttttggagtatgaatcgtgtgctggtaatttatgctcctccccattctgcacttttctccagggttggttgtgatgtcatgaacttctctccatctcacacacacccacagtcatgtatgatcaggagtaacacaggctagggcagtgcttattgtgtgttatacataaaacacacaaatcaatgtgaactaatattctagaacaatttatagacaaacaggtgcattgtgaaaaaagctaaatgggggccttagaagagaaactcatatatacctttatgttgcatacaattcgaactccactttgtaatgatttgatagggtgttaagtttatttttcctttgaacaaacctcgtcttcaaattgtaactataacacaggtaggattgcagagcaagtgtgttaaggcacataaaagtcacttgatactagataaagggagtagctgtttccttaacaggttcaaattgcaactattactgtaaaagttgttgacgtgctcagcaaatggtgggtggaaatgttggactcagaaaaaggatttgtcctgggcacgtccgttttcgtaacaagaatataaggtaatttttaagtgctaatttaatggttcttactgtaaggcaacgggagtgtagatggggaaagctggtaacaggtgtgtgcagtcacggagcgatggcaatgtcagaaaaggtgggggtcaaaattgttttggacattgatcggaattaaggaaagcatagatgtggaaaggtgcagtgtgtgtccatatcacggcagagtgtctgcgggagagtgacttgggaggagctgtaggatggaagatcttgaaagctccacattagaggtgaacttggagcatcttgtgattgcagggcaaatgggttgtgggaaatggagaagtaagaagtagattgtgattggtttttgtgttcaatgtgatataacttagcaatgcaggagtttttgtggaacctggaactctatttttgtttttcatctgttgaacttgtgccattctgtagagagttatagatatttttccatagaaaggcaggcagtgcagcttggattctagagcagagagtttggattctgttggcttgagttcgaagttcagccctgctgtttattggctgtgtgaccttgggcaagttacttaaccttttagcacgtctgtaaaatcatgataacaattgtaccgattgcatgggatgttgtgatggtgaaaacattgttatatgatatcaccttatacatgttagctattattcttgccatttttttgtatttgcaaattctttcccaggagccagtagtggaataatgtttacagtagttctttgaacttttttttttttttttacagttttactggcaccaaatgtgtttatctacacctagtccccattagaaccatgcaattacattcatgtttgtataaaggttgtcagtttaatattcaagcaattaataaagacaaggtgtgagtttttctgttaatgcacctctgtcttaatgtgaagcaacgtataagcatgcatcttaccataattggtgtgcatgtctgtgtacatgggcacaaacatttctctttcagccctgtaatcacatctccaagtaatctaagtcaaaaagagcaaaatctaagccagtggacatgctgaggctatctcagggtcttctggaatgatcaaggccagaaatcccatcttcatatacattttttttttttttttttggagtcgaggtcttgctatgttgcccaggctagagtgcggtggctattcacaggtgcgaacatagctcactgcatccttgagctcctgggctcaagtgatcctcctgcctcagcctcttgtgtagctgggaccacaggtgcaccaccacacctggcagtttcaaatgcatttttatataaaagtgtgatgttggtctgagtcttttcctctttaccttgcaaacctggattcatcatcatggttcatgtggtatctcgtgctatacatgctggttttgtgttccttgtgggagcatttttttcttttttcttcagagaagagaaagtttgtcaaaacaagggcaaaggtgaagatgtatggcttttcaagtgcttaaacgtgatgaacctgtttttgttgagggactgaggaaagagtattattggatgtgagggaagaagccagtgggattcttccttgctgtctaagagagcatgatgtgagtcaggggctctagaaggacatcacatgttgcacattttagtatcagaaacaggctgttttcctcaatgggttctactctcagatattatctttttttaatgttcgaacgtaatttgcttcccccctaaagaatacagtccttgtaacagcccaaaataccatttttctgattactatcacttatataagaccctccaaacctttctcatccttgaaagtgatccatgctaacacataacacactttgttctcttaagcatgtgtgtttttttgttgttgttgttgttttttgcgagtctgtgccccctcccttcctttagagctctaaggtttgtcattaaaatgagcacttccgtttaaatgtcctccgggctcatccatttgccttagctactcattgtttatttgaaatgcaaatttttatataacagccaaaatctaacccacttacgcactgttaactttatatgtaagctccttcttataactaaagaattcacatggtggttagttatggttgcagtctgccttgcactaacgtattttcattttctagaatgtatatgcatgcctgtcttttcctcatggagtcttctagggaaatcctcagcacactgcgagagggcagtcatttccttgttaggtgtgagtgagatgtgatccattccccaaacagcgtgcatttcagtaagggcattgtttttatgtgaggccgatccatccgtatctatgctattgtctgttacttgaagaatattgactgtcttggagtcgtatttctatcacatctctaccctgctggcttcaccatctaagtggtccttcagcaaacttctcaaactagacgcattccctgttttctgggttctggtggttagcttgggaagaaagtgaaatgtgacttgcctaagaaagtaagacccctctccccatcacacccatatgtgaaagcttcttgggccattattcttttcatctcagccaatagcctctgtccttgctccttgacatacttcttgatgactggtagtggaccagcaaagtagttaacctgtcccaaaatcacacacgaagagaggctagtgtttacagaatttcagccagcgagcctggtgcagtggcgtatgcttcttgtcccagctgcttagaaggctgaggtgggagaatcacttgagcccaggagttcagatgtagcacgggaagcatagtgagaccctgtctctaacaacagcaaattccagccagcttgcttgggagctcagtgagaacccggaggaaaaaatgctggccgtgtgggtcagatgctgcgactgacagtggggattgcttgttaagcaagaacagatactgtgcctgcttcttggaacttcttaggggccagtcattaagcaatgaagtgactgcactctgaagtataaaatttgccaggagggtgattgtatggtacaactggaataagggaatttcacttacagctttcttaggaaaaaataattgtgtcgaaatccaaagcatgagcagaagataagtggccaaattgtccactttgttctaccaaaaacagaaaattccttgttatccatgatgaaatgggtctaagtaactaatatgatacagtttttgcaaagctcgggtctcttaccagcatactgtattaacgtcgcttacaaaaaaacaaccagcatggcctggcctttgttgatctgtcagcagtgcttatggtttttgtcttcactgcaagcccctcttcagggactgcggttggctgtagaaaatgcagtccttggcttcattgtccacacttcctgcccagagcagtagtctctgtctaggggacacccacgtctggctggtgggcagggaaggggcttcaccaattcctggtgtaaatccgtttcccactttctcttctttatgtgcaggcttcttcctctgcacagagaaagcctgtgacatgccctttagtggggagtatcaaagggttgtgagtgctcagtatgtgagagaaagactagtcttaagaggacgtgtgtgtcattcttagaacaacaaaaagaagacatggaaagtatttgactaattgatttttgccatttggagcaaaaatctaatttttgtcaaagtgatgctgggaccatgtaattttgtgaaagtgaagctggaacacataattcctcacacactcagccttgtgcgggcggctgtgattccttcgccaccatgaagtgaagtgcatccaaagtgtgagccagtgtactgccttttttttttttttttttttttttttttttttttttttgagacagagtttcgttcttgttgcccagtctggagtgcaatggcacaatctcggctcaccacaacctctgcctcctgggttcaagcgattttcctgcctcagcctcccgagtagctgggattacaggcatatgccaccatgccaggctaattttgtatttttagtagggacgagatttctccatgttggtcaggctggtcttgaactcctgacctcaggtgatccggccacctcggcctcccaaagtgctgggattacaggcgtgagccgctgtgcccggctggactgtgtttctttttgcactttttggtttttcattttagtgttcttttgtgctttctgacctaagtgctggcaatgtgtaccttcatgtgtgaattgattatgaagacaatttctaagagcaatcctcaagactcagtttttgtctggctttctgtaatcattgaagcaacttaaaaaaaaatgtccacttcatctttagagttctccccctgcccaggcacacaggtctcactgcacaccctattcgtcaccccacaagatgcatgtgctgtctttggcttagcagttcacatgcaaatacaaatacagtcacgtgcagcataaaagcatttcagtcagtgatggaccacataaaccacaatggtcccgtcagattataatggaactgagaagttcctattgtctagtgacgtcgtagtgtcgacctgcagtgcagtccttaggtgtctttggtgatgctgctgtgaagaaacctactgtgctgtggttgtataaacgtctagcacatacagttgtgcacggtgcatggtgcttgatcatgacaatctttgactctgttactggcttatgtatttactgtactttttattgttattttagagagtcatccttctttaaaaaaaagcccgttgtaaaacagcttcaggcagggccttcaggaggtttccagaagatggcagctccatgtgtgctgtcacctctgaagcccttccagtgggacagaggtgctggtggaagacagtgatgttgatgatcctgaccctgtgtaggtctaggctaatgtgtgtgtgtgtgtgtcttagtttttcccaacaatgtttacaaagtaaaaaaccataatttaaaaatggaaaaaagtttataggataaggatagaaaggaaatatttttgtacagttgtccaatgtgtgtgtgtttaagccaagtgttattatgagtcaaaaagttgaaaaaattaaaagtatataaagtaaaaaagttacagtaatctaagtttaatttattgtggaagaaagaatctttagaaaatgtagtgtagcctaagcatgcagtgtttctaaagtttacagtggtgtacactcatgcctttggcctcgacactcactcaccactcactcactcacccagggcaacttccagtcccgcaagctccattcatggtgagtgccctgcatgggcataccatcattcaccctttataccatatgtttgactgtaccttgtctatgtttggatgcacaaatacttaccattgtgttccagttgcctacagtattcaagacaataacacgttgtacaggtttgtagcctaggagcaagaggctatgccatgtagcctaggtgtgtaggaggctctaccctctaggtctgtgtaagtgcactctagcctgatggcacaactatgaaatccctgaatcacacatttctgttttaccttaattaattatggagataaggccttgctgtgtttcccaggccgatctcaaactcctgagctcaaataatcctccttccttggctcccgaagtgctgagattacaggtgtgagtcctgtgcccaagccatgcgtctctcagaatgagtgtgcccctgttaagcgatgcatgtctctgtatgctcatgtcatgcctggcctttactggctacttgtacagtcatctgtcagctgtgacttttggggctataaatccatcaaagttcaggaatctcccaaacttggttcatttaatgcttagcagacgtagctccacagccatatttaaaactgatgatgatggtgtcccttgtttggaggattcatttgtaagtgaccataatgagtttatcctggccattccccagagaacagcaggactcctggttcatctaggatgtgtgaagtgactggccctctgagattgctgggcttccttaaaaatgtcacatacaaggacatagattttcacattgtgtagtattgtttatatcaggggtccccaacccgcagaccactgtgtggtactggtccatggcccattaggagccaggctgcacagcaggaggtgagcagcaggggagggagcattactgactgagctccgccgcctgtcaggtcagcatcggtgttagcggaactgtgtgtgagggatctaggttgcacgccccttttgagaatctaactaatgcctgatgatctgaggcggaggccagatggtttcatcctgaaaccatcctcccaagcccccatttgtggaaaaattgtcttacatgaaactggtccttgttgccaaaaaaaagttgggggccactggtttagatcttgcagtattgtgaagtaatttttggtcttctgagagactccaagcagcacaccagcatgaaaagatgagccattcacggcagctcttggcattggttttaagatgaaatacatcaatattaaaaataactataaaacattcatgaaagtttttggagtttctttgaagaatgtctttgaagctgacttaacattattgcatttattacagttgctctgcagttcaactgggctttataggtttgcatctggggttcacatatgcattttaagacgaggtttgagtctgtttgtataaatcaaatgcagtcctcagactcatgtgcaggccgcatggcgatcccgggatgaagtagatatttctatttataaacagattcctgagtacttcagatattatttgtatgttggactcctgtctagaattggcacatatctacatgtacagagaagaataatgaaatgtcaggggtctcactgcaccctcctctttgatcccattctctgaggttttaatttgggcccaggaagcagcacttaaatatccctactccagctgctagcttcaaacaatacaaagctaggcttccaaatatatttatcatttcttggttgaatatttgcaaaaactgacctaccctacgatttctctcaaataggccttagcaactacaaatatggatgagaagatagaaagggaagctttatgtttgcttgcattttagctaaaagataattagaagtgcaatttaagttatgataatggaaaaaaagagctacacgttaagtgtggtgcattgactgcatcgagaaaaggtgcagtctaaagcccagcaaagcttaaaagagaaaaactagaaaaaaagaactttttggaatataaactgtgacagattttttgtattttctgtgggcttgaaaagtccttaacgttttcgttgttactgccctggtactatttatgtgttagaatacagaacaactttaaatttgtggagtcttatcagtaggactgctggctttgcgaaacccgtgcaaaacggacactttgaagtgaccttccctgtttaactcatccgctcctcccttcagtgagtacatactactgtgtgcggtgtgctcttccagatgctgggatgcagtagtgaatggagacaaagcccctgtcctcatgggcttagactccagcttatgacttgttgtttataataaataatgaacattgtgaggttattcacaggaagggatgaataatggatggatcttcaaaacgtgattctggttaactacagacatcctgaagttccaggtataaaaagccttctttaaagcatactatagcagtcagaatgaatgagtagttaataaagctctttgctgaaataaaagcaaatatgttcacacttccaaaaaataaatacccaagtgggagttgtatggttctgatgtcaaacatgttatgagaccatcagaggtatatggaaatttggggaggaagacagtaattatataaaagtgcatgcaagcctgggcaatatagggagaccctgtcagcctgcaaaaaaataatgataataaaaaatcgtagctgaaggtggtggcatatacctgtgggtcccagctgcttgggaggctaaggtagaatcactaaggagaatcacttggggcagggaagtggtggctgcagtgagctatgattgtgctattgcactccagcctgggcgacagaacgagaccttgtctcacgcacacgaaaagcaattactgaattagagatgtgatgtgggaaacgctcccatctaagtaatgaccaagaatattccgtgatagagatgaagtcttagcaggacttccctctcaggttattagtggtgatgatcctgctttgttttattaccttattactattatgctctctgaggtatgaagtgatattaatctgtttgcagtgagaaataacactttatagcattgctatcatttaaacatattaaaatatgttgtaatgcagaaaaacaccctggggagagaggtgaaaacttaggagtttaatttgaaatgcagttgggaaattatttggacagcagagaaagctttagggcaaaatttcagtaataaagtatattattttctaaattattcatcagggagttgagtttgtttttcatgtacctggacttaatcacgattacaaaaaaatgcttagctaattgtagtcattcatctatactaatccaaaaacaaaaatgaggagttattgatggtttttatttaggtaaaacaatttatttgactgtgagtggttacatatgataaccatatattcagttatttctaacttgcctgttttgtgaagaatgctattttgtgactgttcctgcgtctcgctatgttttgggggttctggcctagttcctacaacatatactcttatcccggttctgtgttgtcctggtgattctcccaagagctaatcagttaaagagattttcttttccattttggattttagcttggagttttactcttagtagtaaaatggtatctaaaaataaaacggggaagaattagaacatgtcagatatagtaacacgttttaataatttgctctaaaaatctgctcatcagctgataacctttcgtttgtccacatgtctgctttttaaaacgcttggtttcttaatatcccagtgagaacaggcacctgcagagatacttagttgctcccagccgcagctgcagagcgacttctagattctgcgtatcttggtttatttcatgctgttttctttaagccatactgtctgctggtcagatggtaagagatacctgttttggaaaatttggtaaataatccagggttacaagtaaatttagcataatgtagaggctttattttgctcatttaaaatatgtagtcttggccaggcacagtggatcacacctgtaatcccagcactttgggaggctgaggcaggtggatcacttgacgtcaggagttcgagaccagcctggtcaacacgatgaaaccccgtctctactaataatacaaaaattagttgggcgtggtggtatgcgcctgtaattccagctactggggaggctgaggcatgagaatctcttgaacctgggaggtagaggttacagtgagccgagatcatatcactgcactccagtctgggtgacagagtgaaactgtgtctccaaaaaataaaataaaataaatcaaaataaaataaaaataaaataaaataaaataaaataaaaatagtgttggctgggtgtgatggctcatgcctgtaattccagcactttggaaggccaaggcgagaggatcatttgaggccaggagtttgagaccagcctgggcaacatagtgagaccccatcactacaaaatataaaaaattagctgggtgtggtggcactcgcctgtagtcccagctattcaggaggctgatgcagaaggattgcttgagcccaggagttcaaggctgaagtgggccaggatctcatcattgcactccagcctgggcgacagagtaagaccctatttctaaaataaataaataaaacatgtagttttacctctattcagcaattagattccttacaactcataaactgtatgagaaattgaattccactgtttttgtcactgagaatgctcttgtcctagcagacctgtgtgtgctaaattaaggtctgatctccatcagtcactaagatgtggccaaacataaaggcttttcatagttgttataccccgtaagtgatgaccctgagaaatgagagtgagactgtcaaggtacatcttttgtccttattccctagattagttcttgaaataagccaccagttaagaattttgggatttcctgtgcactggcagtggttgaagggtttaacatgcctgaaaccttgagcacaaatccctcctgcagctgccctgggccatgtcagccggcaccagccatgctgtggcaccagagaataagcctgcacttaatgtcatagcatttcagagaactgtcggagcgtggggctggcccttgggatttagctgctgcttgtatgaagcagttttaaaatattaagcttagaaaagtcccactgagctgggtaaagactttgtgtcctttgggtccctctctatgttttatcagttttcagctgcagggcagatgtctcccctgggctgcagtcttaggcactaagatgtgttgctggcagatttgactctagaagccccaaagggcaggcagggataaatagttttgaattttgtttctagtctcttctgtgttgtattggtttcagagttcagtatccagtcacagtggacagttttgtagtattttgcagcctaaaaaatttatgcaagcagtaaattaaaaatctgaaaaacacacgcatacacatgtgtgcacacgaaggcacatacacatccctccatggagtcttccactcttgtgtgttttgtaattctctttatttttatttgtttacttggagacagggtctcgctctgttgcccagggtagagtgcagtggtgcaatcatagctcagtgcagcctccacctgctgggctcaagcaagcctcccacctcagcctcccaagtagctgggactacaggtgcgcaccaccatgcccagttaattttctaattttttggtagagatggagtctcactatgttgcccaggccaacctttaactcctggtctcaggtgatcctccccagttgtacctctcagactgattataggtgtgagccgccacacctgacctataattttattttagatttacatgagaagtgatgctgttttaaagtgtaatgctctgaattaaaggaattctctatggtaatatatttatacataacaaagcactaacaattacagaaggccttgatgcctgttctattattcgttttatgtttctgtgagtaattgatgctttgatgtattttggccatagaggcactattgtaatgcatgtagactgactttcactggacagaggtttgctgagctggttctgttcatgtgctatggctggagacatgaggcagaggacacagaggccctgccctgatggcactcacactgtaaacttgaggcaatgaggacgcacagttaggagctgaagttgtaccacagaacacataaagggagagttagacacaagacgagggggctccaggtgagccagtgagagccgtggggccttctgtccctccagccagcagacgctgagtgactgcaggacccagccgattccaggttcccgagcaagctgccttctgtgcttgtgatttttatgttgtggggggattgatggtgccgcctcaggtggagatcagtgtgacggagtccacagggcaggatagaacactggatgtgtgcagtagggtcttaggccaagtccactttctctgatgggggagcatttcagcaaaggcccttctgggcatatgaaggtttcccagtcagttatcagggcaatgggaagccacagagctgggggtctgctggagagtgatcaggcttgagcgttaataaggtcatctggctgcactgtaggtgatggagccaggtaagaggccctgtagtctaggcaggaggtgtgggtagctctgaccagcagtggaaagagggcaaagtggccagatttgagagatgctatttagggaggtggattggaagggctctcgtgggggtcatggggagggggccgtctaggtagctgtcctcagggtttatcatgggtaccacagagaagggaagacatttgggcagtcacttagcaaatttggggcatgccgagtgggggtgccatgtggcattcaaattgcagtttgtgcaggtaatcaaactaggggcttaggagaggcctggggaggagaaatggacctggaagttctccgccaggtggagtgactcagggtctcaggaagagcaggctggtgaggcagagccagggtgtggggcagagtgagtggaaggccgtgagaggcagggccagatggggctgggtggatcaaggaagaggagggtcaagggcgggctttcatttgagagggtgtagaaagcaaaagaatgtttttagaaagattcatgacagctgggccctttgacgtggtagttggaaggattgagtggagagagggaggtggagagtacagaagcagcaagggatgacagagggtgcgaggcagggcaggaggctcaggaaggcagggactgtgtgcatgggggccatgagccttgggtgggcggggatcccatgtacccaggtatgggcccagggtggacaggggccgtgcttacagggcgaggggccccaggtgagtggatactgcccgcaggggtgatgtgcccccggtgggctctgggcagtgtcccagtgctacccctcggccctgggaccttaggtgttcattaccatttagtcttgtttacagcctgggagtttctagtcaagcacagctggtggggaggctccgtgcctcttctcctctgccacctccacccttgtgccctcctccacgctcccttctggatgcctcatgcacctgtatttcacgtgcaggacagggttccatggtctgtcagccaccacctactgagctgttcccacgaggcgcatgcctcccagccagtgggtcatcagcccatttcacgaatgggggcaggctcaggactgatgaactgcggcacagctcacccagccatgcgtggtgctccgccatgtggagaactatgttgcctcccctgcggaggccatcggtgagggggtgctgggccatgaggacttgggtgggctggggctgtgtgcagaatggcctcctgtttcttacacgccaaggcttcctccaggccctgagatttttcatgcagtgccttttactagtatgtaatcttccagtaaagaccactgttcagtcaaagaccagaatgcagggctcaaatactttcaggttccgccattgcagacgttagcccaggtaggactgtgcctttctgctgaagaagcaaagataggccaagccccagtccctcctccaggcttccccggcagctcagggtgcgggcaggtgccgggagggagaacctggttaattttaattggcttacatttttggcctctgtgatttccttgttggcctccttgggtgtgtgtttaattcaagtaagagttcattatcggagttcttttaattataaaataaagtgtgttcgtggtaaggaggtcacatcatagaaagctgtagggaagaaactggaagtgcctttcatctcctcccccacctaactccccagaattaatcacaaatacttttgtgtgtatattgttctggaaattgtaaatgtttaaacaaatctactaaggtatactcttctgaaattttcctttgaaaatttagtttataatttggatttatttcttgatgagcacatgctaaactcattccacccttttttgatgaaaattattacatgtttattaatatatcacattccctccctccctgtcccttttttcccccataaaacacaatactgcagtgaatttgtttgaatacatcccacagaatatatagctggcaatggcattgctgggtaaaagggagtgtgcatttaaagtttggataggtgttgtcaaattgtgttccctaaaagtgcttttttttttttttttttttttttttttgagatggagtctcactctgttgtccaagctggagtacagtggcgctttcttggctcaccacagcctccacctcccggtttcaagcaaactcgtgcttcagccccctgagtagctgggactataggcgcatgccaccatgcccagctaatttttgtatttttagtatagagagggtttcaccatgttagacaggccccctgagtagctgggactataggtgcatgccaccacgcccagctaatttttgtatttttagtagagacagggtttcaccatgttagacaggctgatttcaaactcctgacctcaggtgatctgcctgccttggcctcccaaagtactggtattacaggtgtgagccacggtgcccagccaaaaatgccttttaaaaggtgcatatgattttcagttccagcttcactgagtattagaatcttttaaagaacgtttcagggtgcccagaccctttgctcttgtaggattcacgcctgcagcctccaggcccagggatggggcaggtgtgctgtgcagttgctgtgggcctcactgtgtcatggtgcactccaccctcattgctgtagcctcgcttgttctttcttcagttgtacaagaggaagactgagactgctagtcagagggattggtattttcttctgttctgaatatagaatcttgggaggttttatggagagaaattaagggcatgtctgtcttttatctatgtttgtatgtaacatggtgtttaatgaatataacccatgtgctaggtgcttcacataaatggattctcataacactctgcgaggtatctgctcttttactgtgtgtgtgtggtgtgtgtgtgtgtgtgtgtcttactctgttaccgaggctggagtgcagtgttgcaattatagctcactgcagccttgatctcctggcctcaagcagttctcccacctcagcctcccaagtagctgggactacaggtacaagcatgtaccaccagctaattttttattctttaaatgttttgtagaaatggggtattgctctgttgcccgggctggtcttgagctcctggcctctagcagtcctcctgctttggcctcgcaaagtggtggcattagaggtgtgaggtacagtgcccagtctgttttccgtgttttgtaatttaataagatgtgagcctcaagaccattagtgagtggtaaagctgagatttgattctcatcctccaccacactaacggggatgtgccctagggcatgaaatgcttcattcctgtttgtttaaaaacgtgttttttttccttgtgttttcctatgtattttattttttttttacttttatttttatttttttgagacagagtcttgctcttttgctcacagcaacctttgcctcctgtgttcaagggattctcctacctcagcctcccgagtagctgggattacagtcacgtgccaccatgcctggctaatttttgtatttttagtagagatggggtttcaccatgttggtcaggctggtcttgaactcctgacctcaggtgatccatctgcctaggcctcccaaagtgctgggattacaggtgtgagccactgcacccaggtgtaatttggtatcatctttatacatcttcatgcctactcatatcttctttcatagattagaatgaatttgagaacagaggaaattttagacattatgctaatggcatgaggatcctaggcctagttagaagtcatctttgaaataacttcatagagccgtatttcatatttctcttctaagaattgtgaaagaacttaattttatttccccagagagagaactataaatcatacgtatatagtaacaaagacaaagaatgtttgtggaggattgaactcaatttagaactgatttacacatcagagcaagcctgctgaaagcataagatttttacgtggttttgccagacaggttgaagggactatattaaggataaatagttgagctgttttgtggtatttttatttcaaaatacccagaaatggaaagcagtacttttcttgtttgggtgtgattcatggactgtccagcagagggcactgccagtttgtgagtgagcatccttgctggcagctgagtgagcctgcgcctgcacttcccagaggaaatgggtctgagtgtgatgtggaaatagttacattttattttagaatgttgtcatgaaagttatcataggtgtcataatagcatttgtaaggtgtcacagaagatattgctgtttcctgctacctagatgtactgaacattttgcagttagctacttagcatggtttagctaattggggactgttactgacacatggctggatccctactttgcctctcctccttgaatttgagttatataaaggaaatctcagtacttaggaatttaggggaaaatgtttaatttttgatgtgtaaccaagaagaaagcatggcagtttcttattggtggcttcatgacttactgtgaatttttaatttttctgaaatctcaggtatttctttccttgctgtgaatcctgggaaatgattgcatttgaagtggagaatcacacagcctcctttagtccactctccacaatgtccaaattatcttttggttattcttttgtctaccagactatcacagccattatattctgtggactgaattgtcagttttctccactgtaagaatggcgggtgcacagtccgtgtgtcttgtttatgtgtacacttgcagatacagagttgtttttgcctcagcttttcctatgtaaaagttttaagtactgtgtaaacatgcttgtatacctggcttttgaatatatttcacgcctgcaaacttaattatttgatgtgcatggaagttgtagaagagatcacttggtttttctcttaggttcacttctgtttttgtttctcttgctccttcaactcactgatgacaggtgctttccaaactgccggcctgatgcagaggtgctgattccccatttgctctgcccttctttagggctgctgtaccggcagtgcccactggggggcagcgtgattgcacaccagcctgcaagggtctccttggctttcttttcagttggcaggtgtggggggcatttttgagaacaaagcacattattactgaacgctgaaacccccagtgacaaagcattgtagtgaattcaaatgcacgatccgggaaattctcggagcctctgcgactggtctctccagcagggcctgatacacaggatcacttgtaattaaaactaacacttgtggatgggggtgagctctcacgttaatggacgtttctcattgtacaacattcaaaatatgtggcaggcctttgataaggagtcttttttctttcatcccttgaatagttatgaggtgtggaaataagaggagttagttgggaaaaagcttgcatgctggctttgtcgttgtttttgaaaagaatggaaaatacttgcaaataaaggcacatggattattttatccatcttgcacaaaactgggctcatagcacctgatggagtcctggctaacaggtttattttacttattgatttctggaaataaagcaggcactaaaccggaccacttaactatttaaatccttgcaatagggtataattgtactttcagatttgtttttatatcagttgtgcaacatgtctcaggcagtcatcttgattttaagttcctttcttttaagttcatgccttattctcaactttcttgctccgtaacagagctgtgaatggataagactcggtaggcatttgcctaaaaggttttgatgctaggaggaactgcacaattcctttgcccttcttggttttcctgtttcgtgcttattttttataagccgtgcattgctgtcgtgtgcagctgtgcaccctcctgctgcccgtcacggcatcgggtctttcctgtgggcctcctcgccctgccccaccttttctccaggcatgaatcctcccctagagcgcatgcagtcaaattaacgtggagacagagcccattatgaaggaaatcaatttattctaattgggtgacaacattaggcttgacgggaactagcacaccatcgtaagcatcatggttactttgactcttcgtgaggtgacttaggtgcagtgtgattttcgttttccatgcctccaccccgcagaagcacctgtgcggtaactgtctgggttcatgtgtcctgtgcttccaaagcctctcgccagcggcctttgtggtggggtggagggactggacagggggcacccagtgaattaacgccagagagtgtctggcctcagaagggccagcgagcaaaggggtgttagccccgagcccggatggaggaggcagcagtgtgggtttggatgacagagggaaagtagagatttgggaagaagagggtggaaacagggtgggtctccgtggattgcaggggagggtttgtctgcaggtgtacagggagtgctggccctggtttggtttaaactgatgagggccctgggcacatgcaaatgcgtaaatctatccttcaggcaagggatgaaaaaccgttgaagagttttggcttcttcttcttccttcttccttccgtcttccttccttcttccttcttccttccttccttcttccttcctttcttctttctttctttcttcttcttcttttttttttaatagaagaaaagttacttaagaaaagttatccttgcgtaaaaaaaaattctgtggagggaatatggggtgggaggtgtccaggctctgttctcattgacctgggattaaagacccagtctgcccacacactgtcagctttacaaccttaagtagttccagaaccttcccagactttgtctattaatctgggtaatatcaactcacacagcaaatgtgaggagaaagttctactgtatttatagaagtccagctcagttctgggacataccggtaggtgctcacttgttcttttctcttcctacatcatcctttaagattgaatgaatagcaaagaagaaaaactaaaacaagtatctcatcgagtgttttctacataccagttgaccaacctcaaggaatggaccatttagcagacttggttggtgtgttcagagtcataggcatataaatttgagtcgtactgggtgctgttctgagtgctttactatctcccttagttctgtagcaaccctgtcacattgagaccccttaccactaccgtcattgtcgtacccctgtggtccctcaggataggcaggaaagttaagaaactttcccatgtggggaaaaggagctgagccccaaatgcacactctctggctctagggcccaagccctcagccttatgcctggcatctctcgctcagacaggtaaccacaagctgacttattgcccaatactttctggctacccctatttgaaatcctatgcctttagcatttatctgcaaatagaatcagaagaccggcaacatggtgggctgagagcacccatggggagaagccttgaattcatccatggagcttgaacacgtcgctgcatttctccagttctcctcctcctttgaaaatgtcttaaatatgtatttttctataacctcatgttagaagtgaatctccggttttgagcagtgttttcagtggagccatcgtgatgccatctgggtgtgctctgaaacacagtgactatttggggacccagtgtaggccgccattcttcaggtggacgctagacatgaagcaccactgtgccctggactcctgcttcgcctgtggtgatgccatcatggctgtcccctcacctcattcatgttcagattccccctgtttgctttttgatgccttttgttcccagcactccagcttcaatcttaactagaaatcacccaacaaactgaaaaagctcccagttctggaaatggtactttgcagctttcattctgcccgtaatacatttgaaagcaccaagtttagggtctcagcaaaaagccaaagctgtctccatgtttcatttgaaggtacttttgttttcagttgtttctttgtgcatgtaagagcattttttgccctgtttttgtttctttccttcttattgaatggaacaattctttaaaaccttgtacctatcctgctttcagtttcttctgtttatttaaagcctgagtatttcttgtttagttataacagcagtagtacatgctaatgggaaagaaaatggagaagtgtgtaaactggaaaataaataaaaatgtcctgaataccacattccttccctcccctggagggaaaacattatcttttttttcccgcatccttccagaaattttctgcacatatatgagcattttaagcacacccacacgcacaaatggtttcccgctatacgtactgttctgccagtatatcttggataagtttccgcatcagcaaatgtagattgacttcatctgttaacagctccttagtaattaggggataatttctcacaactcccctattttttctgggtttccaaacaagccgccttggatctattcccagggttctccccaaatagtgctcttccagttctgcttcctttaggaaggagtttcatcttctagtgtcatctattcctgccattgtgtagcttcctgggtctgttactgattaccttttgaataagaaagggacaggtcagaggactcaggctggaactagacaggtcaatgtagttgagtatggaataggggttaaaatggacgctaatggccttctacttaaaactctcaaaactagagaaaggaaaagtgaagccacagtgaaatgtcacctccctcttgttagaatagctgttatccagaagaccccacaaaatgaccagtattgtgaggatgtggagaaaaaggaaccctcatacactgttggtgggaatgtaaattaatacagacattatggaaaacagcatggaagttcttcaaaaacctaaaaatagaacttaccatatggtccagcaatcctacttctgggtgtttacctgaaagatttgaaatcaatatgtcgaagagatgtctccacacccgtgtttgttgcagcgccgttcactgtagctaagatacggcaccagcctacgttggacggatggataaatggtctgtatacacagtgcagtactagtcagtcataaaacaggaagaacttctgtcatctgtgacaacgtgtatggaactagagaacattgtgttaggtgaaataagccaaacacagaaagacaaatactgcctgttttcacggatacgcagaatctgaaaccattaaactcacagaagcaaagaggaatgggggttagaggttgggaggttagcggttgggaggggggttggggagatcgtaaccaaagggcacaaagcctgggttacataggaggcataggtttgatttatttcttattcttttttttggagctctgttacatggtgtagtgaatgtagctaataattgagttccgtacattttaatactgctgagagtaaatttcatatgttctcatcataaaaaatgttgaatatttgaggggatggaaatgttagttaacttgatttattcattccacattgtattaaacaataacatcacttttgtacctcaatgataacttgtcaatatacaagagaaatttaagaaatctcaaatcttgagcctccaagtcaggcgagcccctgggggtgaaagccccgctctgttgtttggcctgcaggttggcctcccttcttagcctctgcgcagcctcctcggttcctccccgagccacctgtggccactggagctctgttaagccaacgggaagtaaagacactccaaccatgcattagaaaaatcacaatcggaatgataattgattccttctgtttgaatctattggagtgttacagatgctttgatgaaggtaagacttgctgggtttatcctctagagctgtacgctactaatgctttgtatttatgtataatcagtataataagcttttgactgcataagattcttattttcaaaatatacatttttagctaccccatttctaatttctctcaaaagcagcatttctgatttgtatctacctggtacagatgccagaggagctggtgttggcagtattatctgtgtttacctacatcgaactgttcataccttcttctgagatactgttcttctctggtctgtcttttgccagccccttaaaaccaaagttaattcctttgtcctacatgggactgatttgcttaggagaaaagtgatgccccactgtcccctggctaatggcgtgtgaaggttgtggtggcctccttagcgcagaggatggggctggattctgggagtacttcttaggattagggatgggggtgatctagggaatggaattgctgaagtcagcagggagtccactgctgaggtcctctttttgagacacggtcttgctttgtagcccaggctggagtgtagtggcgcaatctcggctcactgcaatctccgcctcttgggtccaagcaattctggtgcctcagcctctcaagtagctgggattacaggtgcctgccaccacacctggctaatttttgtatttttagtagagatggaatttcgccatgttggccaggctgatctcaaaagcctcccccttccaaagtgctgggattacaggcgtgagccactctgcctggcctcaggctaatatttctaattaaacatcaatacgagagacctaaaaatggacaactttgtcacttaaaaaacccaaaacatccacctattaagacctcagcggcggctggacatggtgctcacacctgtaatcccagtactttgggaggccaaggcaggtggatcacttgaggcgaggagtttgagaccagcttgggcaacatggtaagacctcgtttttacagaaaataaaaaatttaaccagatatagtggcatgtgcatatagtctcagctactcaggaggttggaggattgcttgagtgcaggaggttgaggctgtagtaagccaagattgtgccactgcacttcagcctgggtgacagaacattatatatttgcctgattatttcaagccaaaaaccagcctttgtgttatgaaattagagcaatttaggatttgttttctgcattttggcaattcctgtgatgctgtaggcatcagttacctgggcaggcagtaggtaaggaagtggggtcaggtcctttaccagcacttatagaaatgagaaacgaggctctcataccacctcttaatcactgccccctcctaagggtaagggctgatgacttggccttgagaatgtttttgctacacccaccccttctctctcatgttacttcaatcaatgtacttgccttgacgtcacggaccttttcgggccgtatgtgattgtgtttttgtaccacatttcgaggggaaaatgttggattgatggttgaagggcaggagaggaggggctgagtgggtacaccccgaaaggtaatcacatgggcattttgcctcagtgatcacttctgctaattatgatgacttgtggatttgggatactggaaaagaaaaatctaggctgggcacagtagctcatgcctgtaatcccaccactttgggagactgatgtaggcggatcacttggggcctggagtttgagagcagcctgggcaacatagcaagacccatctctacaaaaaaattaaacagttatccaggcgtggtggcatgcacctgtagccccagccacttgggaagctgaagtggcagggttgcatgagcccaggagtttgaggctgtagtgaaatatgattgcgccactgcactccagcctggagaccccttgtttcaataaataaataaataaataaataaataaataaataaatctgtttacagaaatcactatgtgtgtttgctcctcctagcacagccttggaggataagatgccaggtgcagtggctcatgcctgtaatcccagcactttgggaggccaaggtgggaggatcgcttgagctcaggagtttgagacaccaacatggtgaaacgctgactccacaaaaaatacaaaaattagccaggcatggtggcttgtgcatgtagtccccagttactccaggaggttgaggtgggaggatcacttgagcccaggaagcggaggttgcagtgagctgagattgtgccactgcactccagcctgtgtaatagaggaagaccctgtctccggaagaaaaaaaaaaaaaaaaagagagagagggaggataagggtggactaggatgctctggtcgggacttgtggccatagttggtcatgggtgtttggaggttgggaacctggatgtgaaaagctgcattcctgcaggaggagtctctgccacatctgggcagggtgttttgaccattgtttaaacttccttgaaatcaggcaaggcctggtcgtggatgcagaagggaatctgtttttccagttttggtgatcaagggtccagctccatgccgagtaagtgcaggcccacaaggagttgaaatgctttacgtttctaaactccaggagtaccattgctatgtcggtgattttagatcactttctccatttcctctctccctccctcttctagtttgataggccctaagtttaggcagcctgtgtaggggctacacgttttcatcagtaatacaggccgtgtttcgctgaccacagttggggacagctgcatgtattctttgtgtgttttgttttgttatacattagatacttagataaatatctacatatatgaaatatacttaatatctatgcatattctatctgtaatatttgcttattgaataaattaacactgtagaccactgacctacagaaaatgacagattatcccaaaaacagtcttaaaatctcctaataaaagctgcgggtcttgaatattttagtgtttattgttttaaataagtcactaaacaaagggttatgacaaccagatgaagtgttttatctcaaacattttagccactgggtggtctctttttaatgggtctcaaataatgcagtgcaatattaattttgatcagtctgtgtacatacatatgaaacttgcaactgaggccctctttgtaggttttcgtctagcagattggaagtgatctttcttgagttttcatttagccacactctgagcagcaaaacctattcccaaatctggattcattgaccttaacgtgtgtatgtgtgtgtgtgtgcacatgcacacacatacacgtgtagattgaggaaatacccccctttgtgcctttggatcactacttttgtacatgcagagcgaaagacttccttttgtttcttgtcaagggctataaagagagatcacattagtataacctttgcctcctaaggtgtagatgagtgagttgtggttggaatttaattttaacaggttttattgaactgctaaaagatattgaaaatgtttaatatgagagtccggggcagtaaatcacacacaggcttgttaaaatagatgtccacagtgtatgggcagatggagcctgtgtttctgcccagggacctttcattaccgcaccaattgggtacattattctcacctcataactctgcaatattagatggctgatagagatcgtggtgaaggaagaatttaacacccctctttccccattttgggggagggcttaaagacctattcttttacccatttataggccatttggcttttcacagggattttaaaaaatcatatttgaaggatgtagggaattttcatgtcacctgcaacattggctggtgtcgtgaaccactcctctctgtaatgcgtggaatttttgtttgtttcttgttcgtcatttttctctccactttcttttttcatttttaaatttttggttgttttccagtttttcactgcctcactctctaaaattatattgctccaaacacaggtgtatctgcctctctgtccatcctggtcaggcccatcagtgctgcgcagtgtggctgtcaaagctttttgctttctggcctctgtctctcaggcgtgatgaagccactcactccagggcagggctgccttatctccccaacggctaaggccaagtgcagctctgttattggagcacagccacacccactcgtttctgtaccgactgcagctgcttctcactgggacagcattgagcattggcgattcttgggacagaggatatattgcctgcaaagcctaaaatccatactctgtggccctttacagaagcatgtgctgagccttcacctaaattgtagcaggaattcaataaatgttgactgaatggacgtattagagatttcccaatcaggttttacttaatatgtacacagagtcactggtccctggcatttgactacttgaatactctgtagtaaagacacagcagagtatgtgcttgagcttatttcttgtggatggatcatcccatcccgttattactaaatgaaaatcttgtctaagctcctgtgcagtatctctcaacaggaaaagggaataatttggggagagaagttgccagagtttggaaagtattcccacgtagcatgggtgaacatcctgcatttattgtgaattggttccttcatcatggctgtgcaaatcccaggagagtggggcagattagggcacaacgtgtaaactcagcacctcttctgcctgggctttagagcagaaagcagactctgtccaccaagagggcttgcagcaactttggactcttcatgaagctgatgaggcaacctgtgtgtacccacctctgcccatcatttcttcctggaatcagtaatcttcccacataacactttaaactatttcagtcagagggcttatgtatggtctgttagttttgaagggacgtcataacaaagtaccaagaactggatggcttgacacacagaaactcattgtctcacagttctggaggctggaattctggcatcaaggctttggcagggtcacacccccctccccaaaggctctagagaagaacctgctccatgcctgttcctggcttcggaagcccaggtgttcctggccttgcaggtgcatcagtccagccctgcaccttcacctggccttctccctgtgtgtctgcacagcatcttccctttgcgtcttgtctgcctctgtgttcacacttcccctttttataaggacgttagtcatctcggattagggctcaccctaatgacctcattttaacttaattaatccaataaagatccgatctccaagtaaggtcacattctgacatactggagtttaggacttcacatatttttttgtcgggagaggggaacacaattcagttcataatagatgggcagctgggcacggtggctcatgcctgtaatcccagcacttcgggaggtcatggcaggagaattgcttgagctcaggagttcaagcctgagcaacaaagtgagatcccatctctgtttaaaacaaaaattgaaaattatcttgttgtggtggcacatgcctgtggtcccagctacttgggaggctaaggcaggaggatcccctgagccaaggaggtcaaggctgcagggctgcagtgagctgtgtttgtgccactgcactctaacctcagtgatagaataagaccccatctccaaaaaaaaaaaaaagatgggtatctcagatcaatataattcaaaagaatatttggctttgaaagtggagtcttataaaaatatagccaggcgaagatgacgtgtcatcctctgagcctagaaagtctggaacacgatcgcctgggcttatgcatgtgcctaggtgtgggtcgtggtggttatgacatttcactttggatgtgcacattccatcactcatatctttggctgcagttagaaggaagggagtgttttttgaaagcttgccctgaaattatagtatgtgcaactgtgttagatttgagtgtcataaccatgttcttcttgtgtgttttgtcagttccttggctaattttcagatgtttgcatccaaatatgagttagggctctcaaagcagtcagcattttcttctttattttacattttagtcataacagatataatatatgccctgtgagtggtttcagagattatgtaatgccaaaatgtagagttatgagttaatcacagaataatgtccaattacattgtttgttctctttgtcttcctttccatcccttggcctccccaaaaagaaagtgaaaaagaacaagctgtattcccacacagagaggggatgagagtcagaaagaaagaaagagagagagagaaacagataagacacttcacacacagagaggaggggggagagagaaagtgtacacacacagggacagtgagtgacttgaaaagggctgctagtgtaccttccattccactccatgaacgcgtgagagaatgagcattaaatggaggtgtgagtctgctcttctcttggtcccaactcctggctgtccagggtcagcatcttgctgcattgaatgtaattccaatgtttacaggtcctcctttctttttggggaagagggagtggtcttttatgacccttgaacacaagccagctacttcatctttgaggggaccaaaacaatagcaatctgtttactactgggcagtttgaagatattttgagatagaatattgattaggcaaggtctcggcatctcttttgagttagacttaagaacctgtccccacattaagatggggctctggtgaagttgacttgtttttgtttttgttttgaggtggagtttcgctcttattgctcagtctggagtgcaatggtgtgatctcggctcacctcaatctccgcttccccagttcaagctattctcctgcctcagcctcccaagtagctgggattacaggcatgcgccatcacgcctggctaatttttatttttagtagagacagggtttctccatgttagtcaggctggtctcaaactcccgacctcaggtgatccacctgcctcagcctcccaaagtgctgggattacaggcgtgagccaccgcgcctggccttgaagttgacttttcatcttactttgaatcccttcaattcctttgttttcaagtcgaaaaccctccactcaggcctcattaacaggaaatgaccgagcttgtacttttctagctacgttgtgtcaacttgagtgcatggactaaaaccacctgtgtgtggagtccccaagcccaccaccagcgcaggcacctgctgtgcttctgcacctggagatgggctttccctgagttgggtctcaccagcagcccagatttacaccaagaaatttgccaggttcatagttggtgctcagtaagtgtattgtttaagctcctttctgatttcacaaagtaattgctgccgactgtactcataggagttccaggagcctccatgagaactgtaaagtcttaacttgcttagaaagcacattttaaagcttttcctgctgcagtcagaacctgaaagaataggctgtggcctcagaatctacaggcacactcagtttttgactctgtcttatagatccttgacaacattggggactgttaacatggtttttatgcccccaaatcagttatatggaagaaggtccctgtggaagctgagcagttgagcttgtccagggctgagggctccgtgagaggtcacctttcttagctcttgtatgtctttgcagcccagggctcagagctgttgacatgtgcttgttgaggtctggtgacccatacccctggcctgagccctgagaagccggttccccagcagtgtgacctgggttgcatgggaggctttctcagagcttgtctggggccttgtcttgctgcagtgggacgtgggccctggaggacgcagccccgacagccctcacctggttgacatcagagcgggctgagcagctggcactgtggggtttcttggggatctgcgttgcagaggggcctgtgcagggcacagtgtcagcctcctgtcctctccaccatcatcctcctgtctgtagggaggcccagaggagccagttgaatgaaggcctgtcctcctcctggtggcttctgggctcagtgcctgacattgggtcttactggctacatcagccgctgagtgcaccaaggatctgtgacatctcagaggcctcacccgaccctgaagtgacacggctcactgtttctgctctgggtacatgaacagggactgtttattctgattctgtggctttgagcagaaatcgatttgtctgaaaagactgcccttagtcacaacagatccttttcgttgtggttttttttacctagttttctttcaataagttctttcctcacagctgtgggatgagggtcaaaacatcatgcttgataggtcaaagctgctgcttctattccaactgctaccttcccagcagaaagggccgtttaacttgttacacaccttttcctgcttagaacaaggtcacagatattagcgtgggagacgcatgcagtcatgaaacgcagttcttcactgaaggattctagagtctccttggcagataatgggaaacatcaacaaaaaaccatgtggaataggagccgtgtgcacacaatcacgtgttgttcctagagaccaggcagctggtgcctgggaccagcagagcaaggacagctgcatgcgcgctgacttttttttttttttttgagacggagtcttgctctgtggcccaggctggagtgcagtggtagatctcagctcactgcaacctctgcctcccagattcaagtgattctcctgcctcagcctcccaagtaggtgggactacaggtgcgcgccaccatgcttggctaattttttgtatttttagtagagtcagggtttcaccgtgttagccaggatggtttcgatctcctgacctcgtgatccgccccacttcgtcctcccaaagtgctgggattacaggcatgagcccctgcacctggccctgcactgacattgttaaacaggtctgtctggagtgggtggagctggggtttagggggttcaagagtggattggtttgttacttttgctgagatgtacctagttaaagctttttcaactcttcttggttaactataggaagtctctcttagtcttcctttcagtcacttgttttattaagacagtaaaacactctgatccagaggttttaaatagagatgctttgttttcaattaaagttgaagatttaagttatttaaaactgaacgtaattattgaagggaaggagagtttgagggcctattcaaagattcgtagaaaattcccattttggtgtagtagtaccattaaataatgcatatctaatgtgcataaatacttgtctgcagaaatcatgtctgctataaataggtgtcagacatggagaaatgcaggtccttcatgggtgggaacagccttcggtggtgttcctgggcttctcttgtatgtgttaatgacacagccgtgaaagtatcatttttcactttcgactgtcgaagcccagcttatattcccatatgcttttgtgtgtctttgtagagcactcttagggtggatttttgcaatttcatcacttttcttactctgccttcaggggccagaaacactgaagtttcacatgtgacctgtacactcttacagctcttatacatggctgaggggccaggagaggaaaacaccacagtccatttgtcaggaaaaaaagacacacatggggaaaaaggtcctgaaaagacccactttacactcttcatagtgattacttcaggaggattataagaaataatattaatatggaatatggcctgtgtactaaaaaaaaaaaaaaaaaagaaaaaaagaaaaccaactcaggcaatgtaagtcattgaacagtttgattcctgtagacacctctattactgttcggccttagattttctcctaacaaaattatcttgttttcccaaaagcttcttgtttttgtgaagaaactgaaaatgactggctgaagtttgtccaagaaattcattcaaccgtaatttattcagtgtttccatgtagcctgatggggcctaactggaattgataatcttgcttacaaatacaaactcatttttatcactgaaatgactttctcccccaaccatcaaggagggaataacttctcttgtgacaaatatttttgaacctgtgcttttctaacaattgaaatggccagctttttagatgaaagttctaatgtattatttttagaaatttcagagaaggaaacaaataatttgcttatctgatgtccctttgtatgttaatttatggtatcttgaggctttgagttttaatttaaaccagcttcagtctgaaaattcagaattaatatttatatcaaatacatgcaaaatgtataaatctgaacaaattcgtttcttcagaataaatgatgatcttggacttatgttcctggaatgttttccaaattgagttttataattatctttttttctgcatatttctaatagatgtgtaatattgccctgtttaaggaattctattctttaacaaggaatgttgtcagatgtaatataagcttgatttaagtaaaataatgtaatcgatggcaggtataggaatggccacctttatgagtgctggttcttctactgaattttaagatatgtgaaaactaaataatgattaaataaatgattgatagtcacgtattgattgataactctttttcttcaacttacatggactgttacaacctctgagcaccatggtttgggaatttactttatcaaaatacattttatgtgaaataatgtttggatacacaatcttttttcagttttggtactatgaagttggtttaataagaaaagaatctgacatttaaaaaattgtaaaatctgcacatgatgtaattgcatttgtgtttattgaagtagtttgttataaaaacttgtagagaacaataacaatatccatgctcctttagaaagtgtagtgtgtaaataatcagtgtagtgatttttttaaaaggtgtcaaggtagcagtgctctttctttcagtttgtgcagtaaactgtggggtttgggttctgtcttaggggtttccaggcgtgttcttgaaatgctaggaatgtacaaatacgtcatgttccagtgttaaaagttggaaactaggccgggcgcggtggcttgcctgtacaaccggcaccttgggaggccgagcgtgggtggatcacttgaggtcaggagtttgagaccagcctggccaatgtggcaaaaccctgtctctactaaaaatacaaaaattagccgggcgtggtggcacatacctgtaatcccagctaatcagaaggctgaaacacgagagccacttaaacctgggaggtggagtttcagtgagcctgggtgacagagactcttccctcccctcaaagaaacccccaaaacaacaacaaaaaaaacccccaaaaaaacaaaaacaaaaaacaaacaacaaaaaaagtggaaactactgattctttcatgtgtcctgccagatgaaatctttttctgcgcaaaccttagactagagctggcatctcctgccatctctgttcaaaggtttctccaatgtactgttactggggaaggttgggttttcaccctggcccactctggtaaatgtgtaccatttttgtatgtggcaattgcacttgtacaccaggcttagttaagtgccagggaagttgtagatgcttcacttgtgtaataatgaaagaacacatgtagcaaaatgtggcaagatgtatttttttgtgcatatgtggtttttcttttttctttattggcctattctaaggaatgggtgcttgtttctcctgcagttttcataaaaaatgagagctggttcattgttagtgattcaactttttgactaagaaatttcccacttctttttcaagcttttgaatccgtttaattaaagagcatcctgaaattgcaaggtgagctttttatctatttatctgtgagaggtttaagctgatgctttgtaagtagaacagaaatgcagaaacaaattggatttcaaggttgatgtaatgctccatcccaatttccagttactgttttgttcatcaaacagcctcgtcgtttcctttgattgtctttttaataagaaatgggcatgcattccaaattaaaagataaatttatgctaatgttgacttcagctcttttatgtattaaggttttgtgaaatgttttgtttgcaaaatgggtcctcctgtttcagatgggggaatgaggaagagagacacttcctacatcacaaaaaacctcttggtttccaggaatggtgaatttggaccttataaatgggatctgggatcacaaatgggcgtgggtttcactgctttggctaccagtggaggagtaggagtcatatcttggttgtcagggaggtgggtgatgtcttctgaataaattggtggcatttgggagcaagaacacagaataaccaaggggaggtgagattataccacatgccagtggttgatgatctgggcatatatggcatgggtgattatttgaacaatatctatattttatgcttatttttaactccatgagagtggggtctctgaggaggaggtggtggtggtgtgtgtgttctttatatcccaggtgcctggcctcaaggtatttgttgagtgaatgcatgaagggatgaaccttcataagggttcattctgctattatattatgcagaaacagagagaggtaagcttattttatacaatatcagggagaaggctggagagccagtgtcaggaacagtttcctgaagtcagagctctcaaacattgaggttggctgcctgtggaggaagggagttcaggtaaagggtgagcagtagaaatattgtagaggacattcaaagatttttaactggtagttaaaccagatgatcctaaaatgctatttatattctgagactccattaaatatttgagcacctactgtttccataacaatgtgagcatcacagcagacagattcagcagtgtgagaaacgagatgactacccatgctggagtattccaatctcatggtggtggtggtaaaataaaaattaaaaaagaaaaaagttggcaaataacattataattctatacaataaaatgcaggatatttaagctatttattcattcaataaatatttgaatgccaataaacttcataagtgtcagcatcaccattgtagttgaagagagaacaacacaattttttaggagaaggtggagttgagctacaccgtaaagactttatgggactgtgggccgggcatgatggctcacatctgtaatcccagcactttgggaggctgaggcggacagatcacttgaggtcagcagttcgagaccagcctggccaacacgtgaaaccccgtctctaccaaaaatacaaaatttagccaggcgtggtggtgcatgcctgtaatttcagctacttgggaaggtgaggcacaagaattgcttgaacccaggaggtggaagttgcagtgagccaagatcatgccactgtactccagcctgggtgacagactgagactctgtctcaaaaaaaaaaagaaaaaaaaaaaaggctttatgggactatattggtgaactctagagcatccagtgaggggctgtgggatgagtgaaagctaatttctaagaatcacgaggtgtgctctgaggacaaagaggaaaccttagggaagtggcaccaagtgaaaccagaaaggagactgggatcatattgtggttgaccttaaatattaccttagtgttgaggagtcacctgtgtaactgaggagagaggaggaggtgtgcatgactccagcaggttggaaaaagccagtgcctctgccagacaggaatgtggaacgggtggaaagtggtgtgatcttagatgtgtagagtgtgatattttggaaatcctattggaaacagtcagtcaggaaggatgtcctagctaagaagacatttgaagttttgaaagtggctcatctatttcctgattgatacataccattagttcagtttgggtctattattttttgggtccagttttttttttaaaatgaattgataggcatgtttaccagagtgctattactttgtttttggagatgtcactttctcatttttacctgaattgtgacttactttgccactgttgtggaagcgttcttacattctgacttcacagtacaagatgtcacttgatgtcaccaagagttaagaaaagctattttaagtatgctggaaaaggaatctatttcagtgtttgcgggagtcactattttgaagcaaactaagaatttctaaggagcttggagacttgcacatcttctgatattgggaggtcttaggttaaaagacttttttatttggattcattaattgagtgtaggtcattgttaatggaaaatcgttgaacacttaataaatacagctatgtttaaagttcttaaaaatttaaatacagattaggaagcccaaatttcagaggaactggtagaggatttgtgctttgtttttaatgttttaaacagccctgtggttatagtttagaaaggtcatagttttgacggtcctctattaaaagaaagtgatttttccatcagaatacagttgagtgccacagtgtatagagaagccatagctaatactttaaaatgttttacttttaaaatttcaaaacaaactgtaggttttaaaagttttctctctcacagttttaacccaatctgagaaataaaaaagtaaaaaaaaataaatgtataattttgatctctctaggctgagcccctagagtgtagccctttattccttgaaggaggcatccctttagtgagtttaaatttatgaagccagtcccatgaaggctgcctactcatgtctcccttgccttcagtctgtgtgtgctttgcttttaatttgagaaataatcacttggttgtggtcttgtggaccaaatactgtgttatctatagacaaattgaaatgtactttaaacattattttattatttttgacaaaaattatacatatttatggcatacggtgtgatatttaagtgatgtgtaatggtcaaattagggtaagtagtatatcagtcacttcaaacatttttcatttctttgtattgggaacattaaaaattttctcttccagccatttgaaaatacacaatacattagtatttgttttcaccctacagggccttagaccactagaacttaattcttcctatctagctgtaattttgtgtctgttaaccaatctcttcctaccttccccttcccagtctctggtaagcactggcttactctctacttctatgagatcaactttttatttttatttatttatttattttttgagacagagtcttgctctgtcgcccaggctggagtgtaatggtgcgtgatctcggctcactgcagcctccacctcccgtgttcaagtgattctcctccctcagcctcctgagtagctgggattacaggtgtctgccaccatgcctggctaatttttttgtatttttagtaaagatggggttcaccttgttggccaggctggttttgaactcctgacctcaagagatccccgccttggcctcctaaagtgctacgattacatgtgtgagccaccgcccccggccaagatcaactttttaatttagttatttttttttttttttttttgagacaggtgctctgttgcccaagctggagtgcagtggtgtgatcttggttcattgcagcctccacctcccatgctcatatgtttcttccacctcagtgtcctgagtagctgagaccatagacccatgccaccatacctggcttttgtttttttggtagagatggttctccctgtgttgcccaggttggtcccaaactcctgggctgaagcagtcctccttccttggtctcccaaaaagtgctgggattacaggcatgagccaccacagccagccagatcaacttttttagcttccatgtacaagtgagaacatgctgtatttatctttctgtacctaacttatttcacttcacataacgtcctccagggtcattcatgttgcctgaatagtattcaattgtgtgtatagaccacgttttctttacctgttcatcagttgctggacacttagattgattccaatattttgtctattgtgaataaggccgcagtgaacatgggaacgcagatatttcgttgatgtgctgatttcttttccattgggtgtatatgcagcagtggggttgctggatgtatgattgttctgctttttttaatttttttttaattttttttgagagagtctcaccctgtcacccaggctggagtgcagtagcacgatcttagctcactgcaaagtccacctcctgggttcaaacaattcttgtgcctcagcctcccaagtagctgggagtacaggtatgtgctaccatacctggctaatttttgtatttttagtagagacaggtttaccatgttggccaggctggtctcgaactcctggcctcaggtgatccacccgcctctgcctcctaaagtgctagaattacaggctttttattttttgaagaaacttcattctgttttctataattgctgtactaatttgcattcccaccaggggtgcacaagaagagttctcctttctccacatcctcaccagcatctgttattttttgtctttttggtaacagctattctaactggggtgagatgacatcacagtgtggttttgatttgcgtttttcttatgaataatgatgttgaacatattttcatatgtttcttggccatttgtatgtcttcttttgagaactctctatttagatcattttctcatttttaaattggattatttggtttttgtctgttgcgtttcttatatatcgtatattttactcccttggtggatgaatagtttgcacatattttctcccattctgtagttgtcgcttcacttttttcattgcttctgttgctgtgcagaagcttttagtctgatataattttatttgtctatttttgcttttgttgcatgagttctcagccataaaatctttgcccagaccaatgtcgggaagcctttttcctgtgtttgtttgtagtagtttcagagttttggccttacatttaagtctttaatccattagagatgatttttatatatggagagacataggggtctacttccactctgctgcccatggttacactgtttcctcagtggtgtttgttgaagagactgtatgtatgttctttttgcctttgttgaaaatcagttggctacatgtatgtggatttatttctgttcttttggtccatgtgtctgtttttatgtcactcccatgctgatgctgttttggttactgtagctttgttttttgtttctgtttttgtttttttgtttgtttttgtttttagtagacggagcctcactctgccacccaggctgcccaggctggagtgaagtggcgccatctcggctcactgcaatttccgcctcccaggttcaggccattctcctgcctcagcctcccaagtagctgggactacaggcacccgccacaacgcctggctaagttttttttgtatttttagtagagacgtggtttcactgtgttagccaggatggtcttgatctcctgaccttgtgatccacccgtcttggcctcccgaagtgctgggattacaggcatgagccaccgtgcccggcctgctttgcgttttttaaagtcaggtagtgggatgcctctagcttcgtttattttgtttagtgtcactttggctatttgaggtcttttgtggtttcatataaattttaggattttttttccatttctgtgaagaatgtccttggtgtctagataaggatgcattcgatctgtagatcactttgggcaataggaaatgtacttaatttttatttagaaagttaagcaaaaatatcaaccagtattaaaaatgttttaaatatgtgttagacatttagacatctttaaaatcttttaaatatatgtagacatttatatttaaaacatttaaaaatacatgtctatgtttagttatgtttatgcctgcatgatttaaagaaagaaatgatctgggtccaatgagataacttgttaataaactgtttatcattcataatcagccttgttaccctagaataggacacttattttaatgtctgacttggtttcttttaaatttatggcttttatttctttttttcccttaatcttctgactactcattgttagagaacttcttgatattttcaattagtttccagagcttctgctctggttagctgtttttttagcgccaactctgaaataatttcccaggttcctggtccttcctctgagagatttagtccttcatcccatgtagcggagcaaaaggagagaggtcattggcctcacattacttttctatgttggttgacttaatattattacttttcccaagaaggaatacatttttacagtaggaaaactttttttttcttttcttgaatttagctgtttgcctttgaaagctagatcaagcatacaaacacatgtatgtatgagtatacatgttctcatgtttccctgtttataaacttttcctataaggatagcctaggtagtacattcttaatgtttgctatagttttatatcttgaataagttagttcaggaaaagatttgctgacaatagatgataaattcgtagcttgtgatgcaacatcattttaaaaagcaagtttaaaaattaaagttattagaaaaagatgcaaaatggtttctccacattcaccctagttggtttctcccataaactgagaatcttggaagctgatctccggagaatgtggacgagaaaactatgttttaaaccttttttttattctacaggaaatgaatttgtttgccctttttcctgtggtgccattgtgtctgaattttctttctgttcttataataggcagaatgaataagaaagccacacatttgcgaatcctctggatgctgtgtggggctatgctgtgaggttgaataattatgattaattgtaagctggaccatgtgcatttcagagagtgggtagtaattaagtaagagttaatgattttaccattgggctactggtatgtatttatgatacatagctctattattcctacaagatatacttcgtaattgcacagatgttgttgaactccaatttcaagccataaaagtgttttggggctgctttctttttatatatctttgtaattcactagcaagccctaagaaaggtgatactaaaagctgaatcaaaaagaaagcaggtggtcagtgtgtgtgtatgtgcacacaggttaatcaggaggggaatttgcttttttgatttgttgttcactttgctatgttttaaatgtatttttataaaagtgcaaagatacacttattttaatgctttaaaataacttgaaatgattgagcaatcgtaggctagttctgagcatgcctttaaattcaggaaaaaagggttactttgtatgttggactttaggtagaaatatttattaatatttgtactgtttgtagctttggttgatttatggtcacctatgtaggtttaggttttgtacactgtggataattatatatgttaactttttaaaagattaatttttattgaagatacagagaaacagtaactagcattatttatttgattggctgttcaacttactttatcacctcttcagctgttttccagtccacaattgctcaattatttcacaggcaagtaagttataccttcatattttcccaaaatgagaataatgatatccatcttgcagcattgctatgatgactagcaacagtggtttttattcattgtgtctggtactatataccagcattaagaagctttctgcagccattagctcataaaacctcactatagccctctagggtaagaattgttgccccagttttccagataaggaaattaatcatcaaggttcacatggctttgccaaagttgggtgaaattcctaaggagctgagctaggactgtgcatgtagagcaccagacattgtgcctctcacacgattgtcatcttacacgtccatatcgatcctttggaaaaagtaggtaaagagctactttttattttttctttttcctaagtgttttttaaccttccgttgtattaggctttaaaaacaaaatggttgtcctcttcctaaagaataatttctctctgatagggaaaatgtgtgtatatttcaatattttggtggtatatttggaataggatttgttaaaattgtttttaattattattatttttcatattaaacacagctttcaaacacttaggcataaacatacaattaaatacacacatttctagcctatggttatgtttctgtataggttatatactgcatgaacagatgcatactacatttcagtgtctttattagaaatgtatcacagctgggcacggtggctcacgcctgtaatccgagcactttgggaggccgaggcgggcggatcacgaggtgaggggatcgagaccatcctggctaacacggtgaaaccccgtctctactaaaaatacaaaaaatcagctgggcgtggtggcgggtgcctgtagtcccagctactcggggcgggggggtagggggggcgctgaggcaggggaatggtgtgaacctgggaggcggagcttgcagtgaaccgagattgcgccactgcactccagcctgggcgacagagcaagactccgcctcaaaaaaaaaaaaaaaaaaaagaaagaaatgtatcacatttatttcccatcttcatgtacgtggatgaaaataaattcagcagtttttagctctctcccgtccccatttcattatggaaaattgcgtacggggccttaggagtcaacaggatttttgtggttggttcaagatccagattttttcctagacagcctataattgtattccgatttgccttatgagaagtctagaaggaagggattctaaaatagtattaatcttgtgatttgtcaagttaatttttctggtcatatttgaaattaaatttaaaaggcatcagaaaatcccgaaattactcctgcatgtgtcttttccttgccttccttggtgtatgctctgcgttccttttgatggtttggttttgatctgttctgccttccagttcggatagtacatggttaggtaatgcctaaccaagggttagtaaactaagtcagctaaaatgtttctaaaatgtcatactaaaggtacaaagttgtgatggaaaacatttatttatatgtatgttaccttatgttgtagaagtagctagtaaacagagaatacctttgaaagctataattaattttaccagccatcacagttttcctttatccgagcactgaagcattaatacatgtaagaataaactggcccttattctgcctcactcaaggtgcatgattttcatctatttttgggactgagtttggaatgcatcgttaacatagaccggtttcaactctgctaaactgttcaaagactagaatattttcagcaactaggtattttttaaaaaggaaaagaaagcaacttactttttctgtcattgcatgaatgtatttccctgggagctgcttactttctaaaatcattaagagctgaaaatttcaaactcccccccacctctccccatcaccacacaccaccctttacagacataaataggtcttgtatattttcagtaatcaaaagctgtgggtacttctaattgttctattgcatatcaaactttataaaacttagagtatacctactagttaatcatacatacacaatgtttagcagtttaattttgctcagaaacaataaagattataaactgaaataaaacaaaatgctgtcagcaaccacattatatatatatttcaaaaaaggaaactcctaatctgtctagcgtattctaggaactccatatttcacccacgatcatactggctcctgagaattttcctcacactgattcttggttacaggcatgcttatttttccttctttgattaactcaggtccacacgtaaccctttttgggttactgggtcatcttcctaactgctctaagcctagatttctgtttaatattagagtattctgttcccataatgtccgaccaattcttgatgagtactggcatttttaaattttttaaacagtgacagaatgtagtgacagtttttctttgtatgtatcagagcatttcttatgataatagctgtatcggtggcctcctaatcaagagcattcagcaactttcacgttccctggatggtttgctaggtacctggattattgattggaacttcaggagagtttaatgactctcatccttcttgccacatgccctagccgatatatttaatattacttccagtcgttgccaatagaatgcactttaaatagtgtaggaatatactaccagagattagagtagatgtggatgaatctatcatgaataaccagagcttcaataaaaggcccctttggtataaaattctgaactttgaaacagttggcctccgcctaagttttggtatatttccactagctagaaatttcactactcttaataaaaataattctgcagaaggtttcccagcctttctgacggtaatgtcaaatgatttttctcgtctcatagtttattgcctagcactttgtaacattctgctaatttctgctggttttaaaaacacgatcaagagagtgaagtaagaggctgggcgcactttgggaggttgaagtgggagaattgcttgaggccaggagtttgagaccagcctgcacaacaggttttttgttttgtctcgacaaaacaaaagataaaaataacaggacatggtggctagatagccctagctactatggaggctgagacgggaggatcactggagtccaggagttcaggaatacagcgagctatgattgtgcccctgcactccagtctgggtgacaaagggagaccttgtctctaaacaaacaaaaagagggaagtaagtactcaagacctcgatctcttcttacgctccttaaccaactggctctgtatctcaggagtgtggtatacttctaagagcaggtttcagtatccacacagtcttgacagtattgagattggtggtgtttgccttgcattgtttgaaatttccatttttacaaaacctgccctacagactttctcatgctaaattattggagcttatatttatctactggtgataattttggcctgcttttgacagaggaatcttattttaatgttgtgtgaatattaattaattttagactcataattaattgacaaaaataactgagttgaaaatgtacctggggattctaaattttaaatagaattgttagttttaaagatgtctatgccattgctttagaggaaatactgacttgagtccaaaattagtcgaattatgaatgacttattcattcctggaatcttaggattgtaaagattttttaaatgttctgggccttttgatgcatctgttaacaggggttatctagtcagttgagagaaaatctgaagatgcccaaggtcctcatattggttggtgcagtatttgcgtatcacctatttctactctcctgtagactgtagatgatctctagattacttgtaatacctaatacaatataaatgctatgtaaattgttgctataccctgttagttttaaaaatttgtaggctgggtgcggtggctcatgcctgtaatcctagcactttgggaggccaaggcgggtggatcacctgaggtcaggagttcgagaccagcttggccaacatggagaaagcccatctctactaaaaatacaaaattaggcgagcgtggtggcaggcacctgtaatcccagctactcgggaggctgaagcaggagaactgcttgaacctgggaggtggaggttgcagtgagccaagatcgggccattgcactccagcctgggtgacagagtgagattccgtctcaaaaaaaaaaaaaaaaaagtattcttttttactgtattcttttgttctgaatattttcaatctgagattggttgaattcatagatgcagaatgcatggatacagagagctgattgtggtggtgcctaagaactagatggctctaggaaggttttttgtcctttttaaatatatgtaatggagaatacaatgatttccatctttcccaacgtttgtattatctcttacgctatatacgttgtcaagaatctatgggtgcgggtagtaattgtggaagagcgaggcagaaatcatggagaaacggttgtgggtggctgtcagtctattttaattctagtatgttttaccagcatggaattcagaagaactgaaatcccctgctctgatggctgcagcatcctgtgctgggaccgtgcagcattgagaggcttgacacatgtcagtatgtggaagagtttggagagcagccagcaagaggagtgagcccctaagaacaaacaagactcttcctcaggattactcagggctggctgcatgatttgcaggacacagtgcagaatgaaagtgcagggcactttgttcaaaaattaagaatttcaagacattgacaacagagcttcaaaataaataaataaatacataaatgggagatctgtgctgatgccagggtgggtggtatccacaaagcctgctctgatctgatgttaggtgaaagaaaagcacctaaatgtttctcacaaagctttggttcttaattctaatatgagacaacagaatggcgtgggagttgacttagccctaaacattctagatctttaaagttttcgttggtccttccacagactgcagactgagctcacaggagtgtgtccatgatgcaaacagaagtatcttataggtgccaaaggatggacttaccttttcctgccttttaccaacatatttgcaacagaaaaaggatcatgtgaacagatatcacctagggtagctgtcatttggaatttgtgtaattattagaatttgtacaaaacacagaatatccctttttttaaatccattcattctacatttgcactcttttccctcccactatcccaggaagttacttaattattcagtggctcttctagctgttatgcattaagaattcctattgttggcacaaaatccatcatttaagcctcatcttgaggaggttgtcatcttcttatttctgatatgtctgtgaaatactgcattttttagcatatttgtgtgtaccctggagggttgtttgcaaatacatattgcctgtgttgtgcatttatctgtaaaatgccggaatttcttacacttttaatgggtcttgagtaatgactttgtgggtgggatagggtgaagctctgtcagtttcgaaatctgtaaggtgaagaaaacttggtactagttttccaggaacttagatgggcccccaaagattaagatttgtgctgaaacacatttctcaacgtggcctctcatcttatgcatctatctacaaatctggacagctacttacatgctcatgctccagctgtgtttggctgtctttttttttttttttttttttaagacagagtctctctctgtcaccaggctggagtgcagtggtgtgatctcggctcactacagcctccacctcctgggttcaagcgattctcctgcctcagcttcctgagtagctgggactacaggcgtgcaccaccatgcccagctaatttttgtatttttagtagagatggggtttcacaatgttggcaggatggtctcgatctcttgaccttgtgatctgcccgccttggcctcccaaagtgctgggattacaggcgtgagccaccatgcccagccagagctgtcttattgatagacagacttttttttttttttttttttttttgaagacacgggggtctcactatgttgcccaggctggtcttgaactcctggcctcaagtgatcctcctgcctcagcctcccaaaaggctggaattataagcatgagccactatgccaggctgatgctccaacttttataaaaatgtagcttctttattttccaagtcccagaaaaaaccaaccaaccaaaagaaatctttgaaaatcatgctccacagcatgcagatttgaggaggggaactggatccggcaggcatgatttttccacttgcctccagcctcatctttctcctcctctgggtgactctgcctgagtttgtggtgcctatactgcctttctctgcacccggagcacgtgactgtacacacctgcacacatctgtagacatacgctgttttagtcagggttctattaaagggacagaactacacacacacacacacacacacacacacacacacacacacacacacacacacacatttccctttatatatgtatagtaatatagatatatgtagttctgtatatatataaagaactaataggatatatctatataaaggggagtttttcctcatatatatatatagaagatatatatatataggagatatagatataggagatatatatatataggagatatatatatataggagatatagatataggagatatatatatataggagatatatatatataggagatatatatataggagatatatatataggagatatatatataggagatatatatataggagatatatatataggagatatatatatataggagatatatatatataggagatatatatataggagatatatatataggagatatatatataggagatatatatatatataggagatatatatatatataggagatatatatataggagatatatatatataggagatatatatatataggagatatatatatataggagatatatatataggagatatatatatataggagatatatatatataggagatatatatataggagatatatatatataggagatatatataggagatatatatatatataggagatatatatatatatatataggagatatatataggagatatatatatatatttaagagtatttttggcagggcacagtggctcacgcctgtaatcccagcactttgggaggccgaggtgggcggatcatgaggtcaggagatcgagaccatcctggctaacatgatgaaaccccgtgtctactaaaagtacaaaaaattagccaggcgtggtggtaggcgccctgtagtcccagctactcgggaggctgaggcaggagaatggcgtgaaccccggaggtggagcttgcagtgagctgagattgcaccactgcactccagcctgggtgacagagccagactccgtctcaaaaaaaaaaaaaaaaaaaaaaaaaaaaaatttcattttggggctgtttcagatcagtggcatacctagtgtagttgacatccggcatggattatttttacaccaccctagtgtacaacaaaattattttcattaataattagagcaggaaacatataataataatcaccagaagagaaactcagtgaaagttttcccttagtgaatctacaatttttaattctatcagttaaaaataaatattactgtacaaagaaggaaaaaagaaatggactaataggttttagtaacattgagattttttttgaaaagtgaaaaatgtaaacttatatattgatctgtccagtaatgagtaatagcattgcagtttctcttttgagtcttctgcaaatttatcagtgactttgtcagaatttatctctgccgtatattcgcattcagtagacggtatagcgagatttgtcaatatctttgttgcttatagttcaataaagtacacttttattttttataattttaatcttgaaaatatatatgtaatatagaactaataggatctctatatattttatatatcatatacatctttatgtatcatatatatctttatatatattttatatatctttatatatatataaataaaggagagtttattaaatattaacttacacgatcacaaagtcccataataggccatctgcaagctgaggagcaaggagagccagagtcccaaaacggaagatcttggagtctgatatttgaggggaggaagcatccagcatgggagaaagatgtgggctgggaggctaggcctgtctctccttttcatgtttttctgcctgctttaaatttgttggaagctgactacatttcgcccaccatattaagagtggatctgccttccccagctcagagtcaaatgtttatctcttttggcaacacccacacagacacacccagggttcatacttcgcatccctcaatccaatcaagttgacacttggtattaaccatctcatacccagtttccttctcctccgaaaactgggaagactaacaagaaattagttgtacttgttgactgatgggttgcagtttgtttcactcggacatttgcccttgcttttggtccctgttttgtggcctgaggggatttactcacttcttaagaggattttaaggtagcaggttttggggggaaaactggatggtttttaaatttcttgttcctggacgcacctgggactgaagacacctttgaccgtcaccgccttactccaggatctggttatggagggattggctgcgtgtcggacagttttctctgtgtactgtgcccttggttgctgtctgtcattgagctcagggcagtggcctaaaccaacttactgcctgcccatctttttctttttgctgtgagtaccacatgcaaatttaatgttttctggtacagtttttctgttttcattctgtgctcattttctgcctcctctgatccttctactccctgtctaatatgttgggatgaatattatggcctcacgtactattacttgcctctggttctaaagatcatggcaaagaaatgagtcgtttggagttcctaatcaaggttctagtctgcatattgaactctgattgacttggaaacccctttgcccaaacaaaagatgaaatgttccatcctgaattcagcatctcttgttcaatgtgttccgtgactgtttgtcttcctcttcacattattttggaacaaattaggcagaagagacaatctttgcagattgaatttaggcaagttaataatgtcattgggcaaagaacattaacccctggggctcttggaatgtatcaagtcttctgtgccaagggcagatgccatcagggacagagatgagctcttaagggacacaaggacacaacttaacaccagagctgcggagcaccaggcaggtggttctgatttaaacttgcagcccaccaaggcactattgcttcattctgggacattttgacaacctgtcagccaggggtaattttctaagcaccacatttatttttctggtatactccctcatgtctgttaattttgacagctgtccactgctccaggacttgactgtactttcttctttcccttaatcgctctctaccaaactatcactccaaaggatagaacataattacattttgaaatttcaaaaccacagcactattatgtgtcaactattgttaactatctataataacttttaagtactaatgatgttacatacacatttgacattttttggacctcagttttgctttctgttaattgtgtgcctacgtgggcagtagaggcctttaaaaaaaattcaagaggatatatagtgaaggcttgagaagtttttacatgtctatgaacctatgtaactttcacgcacatgaagatacagaacactttctgtatccagaaggctcgcctgtggccttcccagtcaatatcctgcccgatgttcacaccatagattatacatatgtacattatacattctctcattgctggctgcttttctcatattacatctgtgagattcatctgtgttgttgagtgtaacagtagtccatcttgtgcagtattttgtcgtatgatttttccacaattttcttttttactccattctagtgctgatggacatttaagagtattttcattttggggctgtttcttatcagtggcatacctagtgtagttgacatccagcatggattatttttacaccaccctagtatacaacaaattttgtattttcattcataattagagcaggaaacatataataataatcaccagaagagaaattcagtgaaagttttccattagtggatctacaatatttaattctatcagttaaaaataaatattaagaaggaaaaaaagaaatggactaatagtttttagtaacattgaaattttttttgaaaagtgaaaagtgtaaacatatattgatctgtccagtaatgaataacagcgttgcagtttctcttttgagtcttctgcaaatttatcagcgactttctcagaatttatctctgccatatattcgtgttcagtaagacagtagagtgagatttgtcaatatctttgttgcttatagttcgacaaagtacacttcttttttttataattttaatcttgaaaaatttctttcacataaaggaacaatctctatacaagtaattaggaaacgtcttacagataaaagataattttgcctgagtttcataaacatctcatttcacagtaaattccaggaattgcaattttttcccgcttctggggattaaactagtgagtttcaaatgatgtctccatagctgaaaattttaagcacacataaaaagtccaagggcccatgtagaatgacagaatggaaataagttgtatttctttatcattgcaataaactttgctatcattttttaatgatatttaatgaatttcaaatgtagtcggaaactgaaggattccatagtgccacagggattggagaaacaagctgtgcttagggcaagcttgaatggttctcaactcttaggagcttacctgaaatgaatctgtgactcgatacctgtggggtgggccgctctataatgagttttctgaattaacttccatgtgaaaaataatgttcactaaagcataaataactagttacatttgtgtcatgtaacctaatatgctaatttgaattttatttacttatttattcatgaatgaatgaacgacgggttctcactttgtcatccaaggtagagtgcagtggcgcacttatagctcactgcagccttgaactcctggactcaagatcctcctgccttagccttttgagtagctgggaccacaggcccctgccactatacttggtgctaatttttgcttttttttttttttttctttgtagagataagagtcttgctgtgttgcccaggctggtctcaaactcctggccctcaggcgtgatccttctcctgcctttgcctcccaaagcattaggattacaagggtgagccgctgtgcctggccttgaattttaaattgaaattaaaatttaggcttggcacaatggctcacgcctgtaatgcgtgcactttgggagaccgatgcaggaggattgcttgagttcaggagtttgagactagcctgggcaacaatagtgagaccccatttctacaaaaaaaaaaaaaaaaaaaaaaaaaaaattaaaaaaatgggcgggcatggtggcacgtgcttgtggtctcagctgcttgggaggctgaggtgggaattatcacttgagcttgagaggtcaagcctgcagtaagccgtgatggtgccactgcactccagcctgagcaacagagcaagaatctgtctcaaaatattaaaacaaaaacaaaacttgatggtagccctaccaagtatttagaacttacatgaataaaatgatactgtttggggaggagtctttcatctgtgacattgtttgaaattgctagtatgtggtgatcataaaaacaagactaattttcagactaattgttttcagattttcagtctgttccttagtgcctgtatctgggtcagtcagtccccttacctccctttccttggcttaaggtcctgctctgaacatgtccctttcaatattcatgtacagatattctggtggacacatggatgctgttttttcacatcctccctaacactggatattactgattttttttttcatttcagacattctgcatgtgttccataaataacaacaatattcctcttcctttccaatctttataccttttattttaattaattaatggatttatttatttttgagaccggggtctcgctctgtcgcccaggctggagtgcagtggtacaatcttggctcactgcaaccaccatctcccagactcaggcgatccttcaccttaacctcctgagtagctaggactaccggctggtgacaccacgtttggttaattttttttttttttttgtatttttgatagagacagagttttaccatgttgcccaggctggtctcgaactcctgagctcaagccatccacctgcctcggcctcccaaagtgctgggattatagccatgagccactgagcctggcccttttatttcttttttatttcttgttccgctgggtaggatctcatcacagtgtcaaatatggtgacagtagcatgtctctctttgtcttgttcatgagcctagaggaaaggttccagtttgacaaatgtaggcttctttgtagataccatttatcagattaaagaagttccaagaaggccttttattaaaaggaaaatttagttatgccatagtaaatttaaaacatggctttaatatgatttcatgaacatgttgtagtggaaagaaagggcattgctgtcttgtagacctcaggttgaatgtgggtcttactgtctgtgatctggacttctgaacctgcagagtaaccaagtaagcccacataaggtcattcgaattatgaaagtaaaatgagagaatctcttcagttgttggctatttttttcctgacattaatttgaatgaggtcataaagtaaaattttaaagttgaattttatgtagacttggttcattcaaatacttgaagataacaacattcctagtctgagttgtctcttaagaaagatttagtaggggttatgtttctcagttccatgccggcagtctgaattctaattataaatgcctgttctgtcataatcttccaatgagtggaattgaactgttcatatacattttattgatttatgtctgtatttaaagctgagtgatttaatcattttggacggtggagagagccgtggaatcgggtctggctgaagtgagggttagctatcatttgtttaaccctcatgtgtctggtgctgagtaagatgagttttagagtttatgaagggattaggtgacagcgatgaaaattccaagccatacttacgctaagagttatgatggagtcatcttcggaatgtgctgatgacggaagtggggatgcggttgcttgtgggttttgttttgtttgggggagtgtggggagagacgggtgatggttgtagagaatggggaacgctttcaggcatgacccttgtgttgattgggtcagtttagctgcaggggaaggcgcagggatattcctggtgttgggagaggtatccacactggcagaggctggggcagggttctgtgtgtgcagttctggaccatcaagggcagggtgggtaggggctggactctggaaggccatccttcatggtgctgaggggcttgggctttcagtcttgggaatgctttgccaagatatgccgaatctgagtgttcagatctgtaactgcaggtctatggcagtagcattgtctcctgtgttagaggctctttataactctttactgctggtacccccaggacttactgatggctcttgaacccctgcccttgttttccccagttttcaaatgtatttggtaatggggtgcaaccccatttactaatgaagtcctggtttaaaatgaagcatgcgtaataatagttcagcttaataaatgttttggaaaaagagccttgtttacagacattcactcttccctcgatttaaaaaaatattttttttcattctcatattgtcaagagagtgctctgaaaagttacagtgtaacagtaattgaatattctatttatttttgcctttgaatactaagatatataagtcaagggtggactattccttgtcataaagctgaaagtttaatttcaaactgacatctgctgccagttctgtgtttcagtattttatttatatttaaaattccaccttccctatatttgtaatatcatttttttgtggtaattgtgtctttgtgttcttcctttcagtaggtgttatttattaggctcacttttattctgcgggcaacttcagagatcccttgttcctcagaacatgctagaattccttctcttcttcagtgtcctaagtagatgatatgaatgtgcataattaactacgttctgcagttctcagctcaggaatacttttcagctcttacagatagacacttaggcgtaacagttgttacttatgagctcattttaaaagtagataaatgtctgaattttcaaagacaaagggtttcagagttcttgatagtttcttatagaggtgggtttagagcctgtgagaaagccactacttcagaatcttaacaaatagtaattgacacccagtggcaaaaatcagaatccgcttttctttcaacagcagatatttaaggcttaattgctgactgaaagtgcagttcgccctcctgcttctggagacagtgatgcccccagcccagctcactggacaatcagccagggtcaaggtgtggtccccatacccagagacgtcatcttctcctcttccgatctccacgtgtaccccagcttaccccagcttcatcttccctatgcacagaaaattaggataattctaagaattgtttttcttggaaacaatgttttcaatatggcaaagtgaaaattgtttttctaaacaagatattggctggatgtggtggcttacgcctgtggtcccagctacttgggaggctgagatgggaggatcacttgagcccaggagttggagggtgcagcgagctgttattgtgatactcctactccagcctgggtgacacagtgagaccttgtctcaaaaataataataatagtaaataaataaaaatttaaaaagttaaaaaagtaagatgttgatgccagcaaaacttattggtgatgattgaaagccaaaaatatattataaaacacacaagcagtatatcaatattatattatatataaatataaacaaaaacaaaaaaaagcgctaaaattatactaaaggaggaggtgcagttatgcttcttgtaggtcaggtgctctgagcagcagctgccatgccggtcctgccatcaccacaaatccaaggcgactgacaacaccaaacccttcccaactgttcttaactctagtatattcttgctaatgcctttcagtactaatgttttccctgctccagcgtaacacccagaatcttttccttgaccattctgataggagcctagaaccttctgtagttttcagtgtttctttggtgaggcaaattcttggaatatctttggcacgggggtgtaaaatttccactcgctatatttaagtctacagctgggagcaatttcttattgatgtacctaaaactagttaaatccccactctccttagcagtccctcttgagagttatttaagatttaggtaatatattacaaattgtgagtgcaaatctctgccactctctgagattgctgcactaaggaatcactagccctgcccttccctgtctcatcctcccagcgcctggaattggattagcacctgtggtgtgtgttggcattttctgcagggctgatatggtctggctctatgtccccacccatatctcatcttgagttgaaatccaaattgtcatccccgtgtgttggggaagggaactcgtggagggtgatgagatcatgagagaagttcccctatgctgttcttgtgatagtgtgtgagttcttgcgagatctggtggttttataaggggctttccccactttgctctgcactaattctctctggtgctatcttgtgaagaggtgccttccgccatgattgtaagcttgctgagtcctccctagccgtgtggaattgtgagtcgattaaacctcttttctttataagttacccagtctcaggtatttcttcataacagtgtgagatcagactaatacaagggctttaaacatttgtgtgtttgtgatagaaggaaattccatatgcaggtatggtcaactaagtgagtacatttccttaaaaaaaaaaaagtaaaaatttggatttgatggatattgcttacaaacttgagtgctcccaaagttatttccacaggcatgctgaatctcatctgatctgtagtgactctcacatttaacttgaattagagcttgggcacaaaagcaataatttgaacaaagtttgattcttaaagagtaatatggtatccacttccccacttccattgtttttcaagaaaaagttggtatgcaatacaagggtaatattaagcttttatcttcatcatttatttatttatttttataaagacagggtctcacaatgttggggaggctggtctcgaactcctaggcttaagcaatcctcccacgttggcctcccaaagtgctgggattacaggtgtgagtcactgcacctggcttcatttattcagtatttgaggcagaataggaaaaaagaaaaccaaggaaattctaatgtataaactgtgacagagtgtttttttttaacctaaataatgaattccttatatttgaaataactaagtgaaaataaaattttattttgtgtctgtttcaatgtaaaagcttatttcattccactacagcatacagaaactttattctttttcctagaaggttatagtaccagacacccttcttccttgaaatagtttagatgggactgactgaaaagaatcactgtaattggcatgtagagtgtcactgggtactcgttaggataagaaaatgtagtgaaatcaacttgaaatttaaccaaattgatggcattgtgccttgtaaggtgctttatggaatgtagtcacattttatagtagacttaagttctagttttaagtaaattttttttatttttacattttcaaatgacttttaacaaatactctgaatgaatactcagtaaatacttaggccattaatattttgcaatggaaatttctattgtagtttcagttcatgaatctttgctccttaccccatcccacaagaaagacttaaacattcaatgagaggcaaatttgacttcttcaaagccggaatggaagaagggagacagaatgtcacaaactgtagtctgaacttgacattgtgatattcttagagaatgtttttacttttaagccttaaaaagtattcatgttcttgaactgtggaactccagtctcaagtttggttgtttggcaagtaaattaagactaatcattataacagtcctttgctacatgtctactgtagctgagctctgtcctgtgtgttttagacattaccgtatttagaaagagaatgactccaaggtgctacatggagaaactaaagagagtcacatggccaagatgtaccacactggagatgccaaaacttggttaaaagccctcatctgactgactttatttatttttattttattttatttttttgagacagggtctcacacttttgcccagcctggagtgcagtggtatgatgtttgctatagccttgagctctctgggcacaagtgatcctctcacctcaccctctcaagtagctgagactacgggcatgagccatcatacctggctaatttttgtatattttgtagagttgaggtctcaccatgttgcacaggctggttgacttattttgaagccgattttctttttgtcgtcctcctctaccttcaggacttttcaggtagtataatcctgtcgtcgtaattcctggcatcacttactccattcttgaggttttctggtctcttgcatagccaggtgagagctgagttgaaaagctttttatacaggcttcatggatatgtatactggtataagtgcatcacacagttaataaaaatattggagaagaccatttagttcacttctttataacagcagtgcctgtacacactttcctcaagactttctggtagttggaaatatgagtttaaaagtaatagtcattaaattaagtggaaactgtgggtcatttcaaagacattgtttttacaaattgattatacacatactaggtccttccaagagcatgcttaggttgaacagaaagtcttactaacaaaacacgtgccctgtgctctgtattgtcctcagggcatatgattgactattacagtaataaacccttgctttctctgaggtgcaaaaagaagctatagtctgagtgcttgggagaggcataagtcataattgtaggctgtaataaatgcaaatctatgaaaaatgggttagcttcaaacagctgagtcgcagagtcttgcaaaaccatgccccattattcctctctggagcccagatcatagaagaattatccatcttttttaacagtgggatttctaaggcttctcagaaatctccggtctcttggtttccagcaagagaacaatatcgagtcttaaatgacagaaatgaattcctaaataagttgaactttttcaagtttttaccaaatttaaataataatgctcatatgaatggtagctcatgtcttccctgtgcaggtggtactgaactaacattctaaatttgaaatggcaggctctctgttcccctgtctgggtaatctctgataaaacattaatcatctcaaggttctattcaagtccattgatggaaattgtgaaatgtaatttagcttgaggaattgaattaatgttttctaatagccctgagatattcactgatttataggtttgaatgctgggaggtgcatttgtgtttctctgtgtgtgcgtgagctcatcctagttaatctaaataggtgtttagaaatgatgcacattctatatcataaaaatatgtattatctctgtgactggtgaatattggtatggtttatttgtgtctgtcatggaacttatacattgctttatacacctggtataaattcgtgctcaactgagaaatatttgttgaattttaaaaatcctttaaatgtatatgcatatatatgtagacatggaatcacagatgtatatatttagttctaatgttttattttcaagcaggtgcagaatttatctgatttgattacttacactatgtgcctctgttgtgcaaatactagttttctcatcctttgtttttctccttacagctcctttatcactttgcaatatctagctctgctctgtaacatttctgcctcaaacccacattgatggcgtacttgtgtctttctcactaccctcttcctttacaatgttacagcttaacaatgggtgcagcatccatttgtctttcatttcattcccttctgcatgtgtagcgtctgagaagtttctggcccaggtaggcatgcagtaatgtattgaatgaatatggtaagggaagaaggaaaaaacatggttccaagatcctggggaggtctagttgaatggactgtgccttttttgtgtcaccttggagcagtcatttcatctcttgaggcttggtttcttctctgtgaaatatgcatgattattattatatagtttttgagacagagtattgctctgttgcccaggctggaatgcagtggtgtgatctccactcactgcaacctccaactccgggttcaagcaattctcctgccttagcctctggagtagctgggactacaggtgtgtgccaccacgctcggctaatttttgtatttttagtagagacagggtttcaccatgttggccaggctgatctcaaactcctgacctctggtgatctgtctgccttggcctcccacagtgctgggattagaggtgtgagccaccatgcccagcccagtcctctttttgatggcagtgttctgtatggggtgctctatggagccttccaatagaatgctaataggatagaatgcattctaatattacattctaggagaagggaaatgtcagttattcagtccatgtcctcacctgtgcctttgtatcaattaccattcacagaggaaaaaaattagtgtcccaggtgatttaaagtagggaggtttcacctgttctcatagaatttattacatcagtatgtgttacaggcaagttccaagtgttacgaacaaatattgtgacataattcactgggagttgtgtatcatgagtccagaaaagaaagttgtgcctatgttgtggaggcttgaattaaggataaataattaaagttgatggttagttaggagcgcctaaagtttgggtctgtgtcaggactgaaggtttaggaaagaaattttggaatctagaagtgaagaactttggaatggtggcgtttactggagtgtgttctaaatccctgtctgtgtttcaagtcgttgctaatctcccttgtggctttctgctgttaccatccatcgtaccttaggcctgcagctgcatagaggacagggcgtgataatcatgattgtgttggctcatcccagaagctggcatgtttaggttttaagtgtagtaacaatgagtacagaaactcctaaccttgatcgaaactcccccggcttagcttgcaccagttgtaccatacccaccaacacaatggtcatacggagtttctttttgctccttgagaccagcgacttcatttctggattaaggccttgcattctgtttccccactgggaattctcgtcccctgattttaggtgggctcctctttatcttgggtttgtcttcagtcttgatgctcagaaaagtctcccctgatcgacaagtcatgctccatcacatcctcctattttaattcttactttactatatgatattaccttattagtgtaatgtgagctcatgtgagtaaggtctttgtctggctcactgctgtagccagtgtttagaatgttcgacatgtggtagaaactcagatgttggttgaatgagagaatgaatgggtaaagacaccttggcctcatttcctgtatctgttttccttacccagccccacttaaatgtaatagaaaaacagaaagaccatatttactaattataaacacttactgagagctgggtaatggagaccctttgtttgggcacacacagagataaagtaagatttatttattattggcaagcaggtccaggctcacaaattggtattccattaccagaggtggatgaacgatgtggagtgggatggggagggggtgatggggggtctgggaacaagctggtcttcgtgactgggactggggccctctgggttgggacagaatggtgtgcaggtgtgttttcccctgttacttcccgccctgtttcctggtagtcctgccattgcagacctgtatctgtgccagaaggaggcatttcaaggtgtcaatggggttggtagtggctgaggaaggaaaggcgggggagttaataaatggccatagtaaggacagagagagattttttccagcatttgggtgctttgcctccagtgcctgtctcatgcagctgcttgtggacacagcgtttatgaggtttctcttgtgcattttaaagaatcaggatttccatagaagtcctaaaagacaaatctagactctgggtgtgcccacttccagttcttcttttaggaaccatttcaggaaggattctttatacaccaggaaggatgccctaagtgtgatcattgttggacagggatccttagctgacagcgagaagagagtggcaaggcacctttgaacgtgacctctcctttggctaacacaaaaatcaaaagctggtgtttcccttgctgttctttagctgaatttccaaccactctgcccactcccagttttaaaataataagtaacaattttactatgaatcaatgaaaatgcaatcaactatggattatacagtattacagttttcagtgaatgcttatgtcttttctctgtcctttccctccaagggaaaagttgggaagtaggggaaaacaaaaggagaaggcattcaggcaacaattcctcatatattctgaaaagcaattagatgcaagtcacatttgatttgttgcaattttaaggattctttgagtggacgttggtgtgggctggccggcagggcatcagggggacgttgtgagtcctgcccctcctttagcactaattttaaattagatttgaagagtggttggtgaacagccttccactgcccatttgcagtgaaagagaagagccttgagaaggacgtcctgctgagatggtttttcatagaaggtgtcatcatattcgtgttaggaagacccagagtgagactggcaattggcatttcatggaaataagtgtatgaaatgatcctggattggtaatgttcaccatctttgtataaataccaaaaatggaggttgtggatcactacagatgatgtccatgtcattctctgcttcctgttagcatgcaagttctagtgtgcgtagcagtagaaattatgaataaatactgtctgttactgatacatatgacttctgtacatggaatcacttgagtattctgatgtaaggccatttggagaattctaaaaatgcaacacttgattaacagccccccacccacccaccccagccccccagtaaaactgtgaattcaggattaacaagatacaatgagttcatggatgttgtccaaaaaaggaagaaactatattttgacatgcttggttttttttttttttttttttttggacatgtacttatattagttttgctgggatgccataagaaagtgccacagactaggtggcttaaacaacagaaatttattttctcacagctctggaggctggaagtccaagatcaaagtgtcggcagatggtcatttttatgttcacatggagttctcctgctgtgtgcgtctgtgtccaaattttttcttcttctaaggatgccagtcatattggattagggcccactctaatgacctcattttaacttaatttcttttctaaagactatttccaaatacagtcatattctgaggtactgggtgttaggacttcaacgtgacattttgggggatacagttcaacctataatagtactacacttttttaagtgattgtggggagctcttgataaatgaatttaagggtacactctggctctgtttaaccaagttcttacattgatttttatagagcaaaatatttcacttctactcattactatgtaatctcacaggctggttgagttttggaccatttgtcatgtatcttccacatatcttctatgtctctctctctctatgtatacatagtagaaagagagagagacagggtatcactatgctgtccaggctggaccaaatgaaccttctgtcttggcctcccaaagtactgggattataggcatgagccatggagcctgtgctactttgtattttaatgtagaactattctcaatagagcagtacccctcagactttgaggttatattaatgtcctacagatcttgattcagtaggtcttgggtggaacttgagatcatgcatttctagcatgttctccagctgatactgatgctgccagccctcagaccatagcttgaggaatagagtcaggagtggctgcacaatttgcaggttcagtgtttcagaaccactcagtgtagcaaagccaaacactaacgggattgcagcaagagaaagtgagacatttattgcgtggccccaagcaaggagaatcgggcagcccatgtttaaaaccccaactccctgatggcttacaggtagggatttttaaaggcaaggaggcagaggtcacaggtatggtaataaattcatacatggaggttgtacatggttttgacctatacaggtgggctttcttgaagcgccgggtgattaaacgtgataggtagattttaaaattttcagatttgcagttggttaaggaagagaagctttgtttaaatatttggggtcaccagaaaagaatgttagctgtggcttgtatcacctcagatagactttacagcaaagaacaagaagagctgtcagaggcccgccctcagttttctctcacctgagctctgcgtgccagcaggtctgtttagtaggggtccaggtttctgaaaaacaggacatatgctaagatgttatcttacatttctgttgagaacaaaacatctcatgactctaactttgttggctactgttttaagcaactgttaccttcttatcaaattgctcatttacttctcagggctagcaaggtgcctggcatttccctcatatgaactcaagctttttctttacttccatgcctggaaggggtggaggttaggcccgtaagaggggtccctgcttcatcttagtaatgcagaatgaaaatgcgagtctattgtttaaaagtgattcagaattttgaactggtcaccgcagagcaagacacctattgtggcccctgtgtgagtatacgggtgattccacccacggagccagccctgagctgtgtgggagtgctgatggaaattatctcagggcacttatccgcaatgatttgtaagatgatggcttttattggccagtgatgaaatccttatacttctaactagtcatggttttacatagtacttgcacgaaactcagagcatggaggagcattagcatgcaggagacatagctaaagcaagttgctcctgagactgtagatatcttggtgtctaaaacacagaatatcaccaccaacaccacagtgattataatatataacttgcccttcttttgcaaagtttcaaaggaatctagggtatgacacatgaattcctctgcccaatgatgatgattctcctttgtccttgaggtagcactgtgcctgctttttaatggtggtatttaactctgggagcaacattcattgcatttttcagaggggaacaatcatcatcatcataatacaagattataaaactcatgggtcaggctttgcacggtggctgacacctgtaatcccagcactttgggaggccaaggagtttgagaccagactggccaagatggtgaaaccccatctctactaaaaatataaaaattagccaggtgtgctggcaggcgcctgtaatcccagccacacaggaggctgagacaggagattgcttgaactcgggaggtggaggttgtagtgagtcgagattgtgtcactgccctccagcctgggtgacagagggagactctgtctcaagcaaacaaaaaaacacaataaaaaaaataaacattagcctcagtggcttatattttcattctgcttaatttaccatgtctacccatgctgggcattaggatgtcaattttggggctgtggtcccagttgactggactagaaaaatgagtttgtcccgtatcacccctacatgagtgccttctttttttcggagatggagttttgctcttgttgcccaggctggagtgcaatggcaccatctcagctcaccgcaacctctgcctcctgggttcaagcgattctcctgcctcagcctcctgagtagctgggattacaggcatgtgccactatgcccggctaatttttatttttagtagggacagggtttctctgcccaggctggagggctggtctcaaactcctaacctcaggtgatccaactcgcctcggcctcccaaagtgttgggattacaggcctgagccactgcgcctggccatgagtgccttaatgcttagaatcatctagcaaatatttttcaaatatggctagaaacaaaattttctttaatcattatgcattttacagtgccaaaggctgtcagagtatattttttccccctatagtgttcttatggctcagtgatgaataaggtggatttgatctgtataaaaacacagacactgatgtgctcagtcatacatctttagacctatctccatttctctgccccttcccctccctttacattatgagagctctgcaggttcccttatggaagtcacagaaatgttttttcagttacaaggtatgatgaaaatggtctgaggtctattcctacttatcctactagattgcctcttggtgcttattcaaattcttgatcctgaattcctttaatcaagtaattatttcaaagaacataattaggtttccatagggtcgttacttcttttatattcttggttctttttaccttatccacccgtatctttattttcagggatttccatatccatcagttgggactgaaaactaatctgcattaaagtagcagttgttacttgatatgacttacttttttttttctcatggatatttgaatgttacaggatttgggaaggtaatttttttaaattactgataaaaatcttgtggaggattctgattctcaggtctggaataacctgcattttttgaataagtggagcattcacatgtggtttaaaattcaaaatatgtaattgatgacaccatatccgagccattcagtttccttctcaggaggcagtgttgttagtgggtgtgtctgttgtgtgtgttcttctagagatagtttatgtttatataagcaaatgcagatataccttcctctcattttacatacttttcagttttctaagcctttagcaaaagtatataaattaatgttatgggattttacaaaaggcagaagccttcaagactataagcagtgcagacagagtgatttgaatgataggaagtaggtatgctaagtaacctctgaaatgacacccgcacaccacaattttcactttctgtgcacagagatggtactatctgtagatttccagagttttgccaaaaaaaaaaagaaagaaaaagaaaaaaaaagaaaaattagaaaaagtggtgagccttagtactagaaatagtaaagaattagcaggtgaagtttagcagattttttttaaattaacattgttagtttaatttcagttcctaatagattgatgaaataaacattaacaagaatgtgtaaacatctgtaagttaatgggtgcaggactaaagcattttaagtagtaatcatcatacaaaaacctgattgctttccttgatagctctatggaattacttaattttaaaaaggctatagatgttaaatatcacgattttcgagtaagtgattttttgaaatcttattcaccaaactaaccgaattggataaagaaatgtcaagtgtgtaataaactgtccaagagttagtggcaattgaaaacatatcaagttgaagagaaccacaggataatgtgtatcttttcttttaatgatctagaagaattagctaagcaatatattaaatctacagatgatcatgaatgaggtgttttctttttgttttttatgagtgttactgagaatgaagcagtagggtcaaacatgcaagtttaataaaatggcaaaagatgaaaaaaaagtctttgcaaaaagctaactaatgtttctggggatggataaatccctaggaacaagagaggggaagacctaatgagcctgggaaaacctaatgagcctaaagtgttttattccatgtaacgaaaacatatcaaacagtaatcttgggtgactagcctatttttttgtctgcccagttagcttaattgacagccatcattagatggcattatgattgggcaaaccaggaacttctgcagtaatggaagttttcaaaaaaaggtttgtctctcaactgaaaaataatagacaaacatcacagagacgcttaaaaattgattgagtcaggtaacgtttgttttcatgtgaattattaggaaactccgctcgattagttggacaccatgtacctctctttttcaaggtactgtacacaggagcttgagaagagatgaaatggggccaagaaactagcatctgaatgcactttactaaaagcattttttctgttttacatatgttttggcttaaccttagagatgttgcaatatcctaacaaatgccttacagagaatccatggccaaagtggaactgaaagtcctaggtctttctgccaagtgcataactctttcctccttactacactagaaagactttagcattgtaatattctgagacaacatcagtgattcattcctcattttaggaagcagtaagggataggtctacatggacaaagaggaaggtaaggtttcagtctctaaagcaataatggtgggttgcccttttgttaaagagtctcatgtcaacaaattcatgtctagtttaggctaggaagaaataatagttgggaaaacaatagcttgaaaaatcagtagggcatgccaggcatccttgtatcttcacatttgtgtatcacgtataatctaagtgatactaaaaatttgttacgctctaataaatgatgatttatgtataccaaaggctctaataaaatatctagaattggtagcatcatagatatgaattaaatagatggagatgaagtaattaaaattagttcctaatttgcactgattttttttaatcttcaattttgtaggaaaaaaaaattggagcattaaactgatagaaaattgtaaagaacattctgcttccggtagggaaaatggtctgttttcttttcttactttaacataagatcaatactaatgtcatttatattgtactttagtgtttacaaagtagattcacatatattctcttatttcatctgtgcagtaacctctggaagataaggtttcctcattctgttttttaatgtctgtttcttaactctgtgtaaaggcagattgattgggcctcatttcctcaatttagaaggctggactgattgatggaacattaaagaaggcagaggtaaataagggatagtgattctaaaaataaaagtgacacttgaagtggtttgactagcagtctcacttatttttccaaaggcaaaaattaaaaaaaaatcaaaaagacaaaaattaaaacccagagatactaataaaagcagggagcacatgtatctttctgatcctaacacttagagtagcagctatcttgacagcctatttttgtgaatagaacacttagatgtccatttttaaggacaactttgttttttcttcctggtgttttgttgttttactggcatatatctaaatttgatttaaatttcatggcattaaaccaaaaacttagatggttatatcgtgtcatttgttatatttattcagtatttgttggtgcattttggtaaattttttactttattagttggggttatataccaccacatttaatcccaggtactcacaataataacagcttaaacatgctaagagtttgtttctctcttatgtgaaagaagtcaagcagttggcagtccaggtctggtatgtattgacaaccccagtgtcagagaaccagacacttgtctccccgaagtatcattcttagcagtatcacctcatggttcagggtagctgcctgagcttcagccatcaggctgatattccaggcagcagaaaggaagaaagaagaagggcacctggtttcccttttaggatgcttttgtgaggtacaattagcattcttgtctttaacttcttaaagctcatgcgaaaacagcttactgcaaggtgagcacatgactgcctagcttaacacagaatttccttatgaaggaggactagaacagtggatgttggtgtaggcactgcttagtctgtgtcacatatagcgcataacacatcaatagtgagaatgcttcagttcaaccagttcatggctttgggggctgtaccaattggtttataatggttatgattttgtgaccaattattctttatgtggagatatatataagaggaactgctttattcatttagaccaataaaagcgatacctgaagtgatttgtggacaagtggctacaagaggatattggtgagcatatttgttcccatgagtcattttctaaccagttatcctaacactgggtttctgtactgtctttaattttcacattatctctaaagtcttcaggaggaaatataagcagtgtggtgctagaatagctttctatgtgaattcttttcccccttattcattactggaaccagtaattgcctagagaatgatgggcaaaatgccagctcatcatttctttaagggtctaagaattggctttggagaatggaagaaaattccagaaacactgtcaagaaagttattatttatttcaaatgttatttggaacagcaaaggacaatatgttttatagcacaacttttaagatgactgaattggcaataaattcacatgatgaaacttcagcaagtctttatgtttctgccggggaattctttggttcttggcgtaaatttttaaatagttaatatcagcttcctattcttaacattcctttagttgtagagctaatgtgaaaacagcttgctgtgttgtgaagaatgcctttagttagccaataaatcaactcatgcgtgtttcagttgtcaagcatgttaaatagtagtttttagacacaagagggattgcccataatatcgttattgtgagattctgtttctcatccaccacgaatgaaatcccttctttcccagactgcctctcacagcccctccagcactgtggttcaactctacaccaagagatgacaagtcctgggttctcaaagacttggattttggttctagatttgcagtgtaggagtcaggcaaatggatgtgtctcttgaggcattagtatcttcacatttcagacaagggcttgagttaaaatactgtttcctttcacttccaaaattctataactctgtgcaatggtttttaacaaaaatctttgaaaaataacctaaataggccgggcgcggtggctcacgcctgtaatcccagcactttgggaggccgaggtgggtagatcacgaggtcaggagttcaagaccagcctggccaagatggtgaaaccccagctctactaaaaatacaaaaaattagccgggcgcagtggcaggtgcctgtagtcccagctactcaggaggctgaggaaggagaatcatttgaacctggagggtggaggttgcagtgagccgagatcgtgccactgcactccagcctgggtgacagagtgaaactccgtctcaaaaaaaaaaaaaaaaaagaaaagaaaaagaaaaataaccaaaataaatttctagaacaaatttcccaagaatcccaaataaatattaatttatatttaaagatgctgtatttaaacagtgcaataattatgagcttttaaaggaatctaaatcaagatatgtttaacattggctacttacgatgagttcaagtacttaagctaatttttagcttgatacctgtatttcgttgggggaaagaaaacaatatcacttcacacactgatcatgttttatattttcttttagaaattaaatgattaatgtgttagaccatgtaagtcagacaaggaggattgaaggacataccttatgagtcagctaaaaatcttgccagttcaaatagtacacatttccttgtgtgagcagctgtcattgttctgaagttttggaagttgtggtgaataatacgttgtgtctctaagtggccctgctattgtaatctgtggttactctttaagttatggtggaaatctttacgtgaccaagcttgatcacagtttcaagcttaaaaatttaaatgtgggagatgataccaaatttttggcaaatgttttatggcccacagccaggattagtaaaaactatggttaatagataacttacagttttctgtaaacatattaaaatgctttttgggattcaatcaagcttgatttatttgtttatgaatgaatgaatgacaggatctcgctctgtcacctagctggactgcaatggtgagattatagctcattgcaacctggacttcttaggctccagtgaccctcccacctcagcctcccgagtagctgggaccacaggcacgtgccaccatgcctggctaatttttgtatttactttttattttttttttctagagacggggattcgtcatgttgcctaggctggtctcgagtgatctacctgctttggcctcccaaaatgctgggattgcaggcatgaactactgtgcctggccaagcatgctgtaattggaaaatttaaaatgcttttctggctgggcacagtggctcacgtttataatctcagcactttgggaggctgaggttggtggatcacctgaggtcaggagtttgagactagcctgaccaacatggtgaaacctcatctctactaaaaatataaagaattatccaggcatggtggtacatacctgtaatcccagttacacaggaggctgagacaggagaattgcttgaactcaggaggtggatgaacctcagtgagctgagattgcaccactgcactccagcctgggagacagagtaagactccatctcaaaaactatttttttttttttctgtagtgaaaatggtagctctaggctgtaatcccagcactttgggaggccgaggcaggcggatcacaaggtcaggagttggagagtgggtggatcaagaggtcaggagttcgagaccagcctgaccaacatggtgaaacccagtctcaagaatacaacaattagccaggcgtggtggtgcacgtctgtaatcccagctactcaggaggctgaggcaggagaattgcttgaacctgggaggcggaggttgcagtgagccaaaatcatgccactgcactccagcctgggagacagtgtgaaactccgtgtcaaaacacacacacacacacacacacacacacacacacacacacagagaaaatggtagcttttatttatttagttcacgttgtctgacagtgaactaggcttcttacgtattttttttcattgattttaaccaaatgcccattcatgagtgaggaaactaagttcatctagggcacctgggaggggcagggggcgttacggaagggctcacctgacagcagagccagaggtgcacatcctcacgcaaggtagtgcttagaggcgctggggtttattgaaaaggatgctgctacactggtttaataattttctttttcttttttttttttttgagaccagtctcactctgttgcccaggctggagcgcagtggcgcgatcttggctcactgcaacctctgcctcctgggttaaagcgattctcctgcctcagcctcctgagtagctgggattacaggcgcacgccaccatgcccgtctaagttttgcatttttagtagagatggggtttcaccatgttggacaggctggtcttgaactcctgactctgtgatccaccctccttggtctcccaagtgctgggattacaggaatgagctactgcgcgcagccttataattttctctttgaataagcagatatcttgaaaaggtatatgcttaggctatctagctcccctccatcttcctcaacacctctacctataagtggtataaattcaacctgaactaattataaaagaagaaattaaaaatttcagccacataaaagtctagttagtatgtataattcaaggactggtagttaactcactgttagacaagtaggtaatgtgttccctcagcgattgagtgtatttgagaagttggaaacactgaatatagcttggtaagggctcagtggcctctgtagaagggagcttgggtttgaattctagctccacaaagtacttgatgtttgaccacctacagcttcagtttcttcatatgtaaaatgggctaatagaactcacctctgagttgtcaggttaaaatgagctaatgtgtggaaattacaactgtggtgcttggcatatactatgttctcaataaatattagttgctcttgctattttaaaacttattctttgacaattctgttgctcattggtatgggaatactttcttatttaagaaaaatggcatgttctaacccatttatgcctgaggttgcaattttgtgaattttgaaaatcagaccttgacaatgactttgagcagtaggatataaacaacgctcgcatgcttggtgttccagtaatggaacactaggcataaatgggcttaaggatggcagtatgtgatgattcaggtaaaaaacttaaaaaaatttttttcagcacgaagttttgctgtgttttggttggaatattgtaaggaggtatcacatttttaaaaagcttatcttagcctctaatctcagcactttggggaggctgaagcagcaggattgcttgaggccaggagttcatactgagacactgtctctacaaaggaaaaaagaaaaaaaaaaagagcaacagaaaacaaaaaaacatagccgcatgtagtgaggtgtgctggcatgttcctgtagtcccagctactcaggaggccgaggcaggaggatcgcatgagcccaggagtttgaagctgcagcgagctctgattgtgcccctgccctccagcttggttgacagagtgagacccctgtctgtttaaaaaaaaaaaaaaagtttattctagcattgactaatgcattaaataaagaatttctatgcctggtcagcataaagccctcatcttaaaatttaaagaatccatctatgtacccacgtgtgtgcctgtgcacacgtgcacacttccacacatattctagtagtcatgtggagttagtgatgaaattttttttcatccccattttacagacaggagatgagccatatggtgctcattttacgatagtgatagaatgatggatttagacagaaggaaaggtgtgtgaacagagacacattatcgattctcattcaaatcggattcattctgctatgctgtgttgccttcagctgagtgtccagcggtttgaaacatttctaaattttgatttggggccatcatgcagctcagtgcttgtgcttcggtgcaaggtctcttgggcagagatgctaatttaagaatgttgtcggtttaaatgttcctaagaggattaagcaaattctacagcatataaatggacatatttggaagatttttttccccaagcaatttcagaaaacacacatgcatcatttgctaaaactctgcaggtgtattaatgagttcatctcacatgaatggacagtcactgagggaacttcatatgtaggcttgagttcaggtatatgaaatgcaggctaagttttaattagaatttatttacagctcgaagctgctcctttgtttttctgcctgaagtcagtaatgaaccattcctctttgcctagtcattagtattcagagctccatcagcctgcagttcaaaccctttcccttgtttttgtcagagaagatgatggagcaaggttgcttagaaacacttagccacactctcaacgggaattatcaatctgtgctgtatgttcacccccacacgcaggggagaaaattgagttttactgctgatgacgttaattgattgcaagttgttttagtgggagtgtgatgttgaaaaccagatttcctttcatttttatgcattagatgcagagaagctatacagtgacatgttcattccactgtaactaaaaatatcatagaggtatctaaatttggttttgtatgttttatattcagatcttgacactggtcagcttacaggattatctttgggttggagactgtttctgtagtgatttctttagttcccagtaaattcacacagtcatctccttcaatagagttctgattagtgcagtcagggggtgacacactaaattaggggtgggcagaggggtgaaatggaaaccagctgttatctgcttacctataattttatatggtccaaaaaaagcttttgtcttttttttttcttttgtccctgttcttttcagatcatcttcttcaaaaatttcttgccttaacatgtaaagagtgcagtgtgtttctatgggtgatttaatttgacttgtatttatttttaaagattccttgatttggctattaacaacttttaaaaggtgaaacaaacattgctgatgagagaatgcacaagcaagcagacagcccctctggaaggtcgggatggcgagaattggggtgaggaagagaggccagaggcaagcgaactgtattatgttgtttaggattttgtcctccacagcatctaagtggatgtgtatatttaagcatagtgtcttttgttatactttatcatggattcccattgaaagtaatagattgagactttgtgggggagggcttaccctgtacttctctggcaaacatcagtgattctgctgcttattcattcaagactgcacataaccattgcctgcagagcttgaagaagcaacacacatttccctgactcgttcttatgagtcagtagaaaagaaagatggctaagcctatgcctggtgcatctcagttagaacctacagagaagagctcaaatacctgattttctttctttctttttctttttttttgagacggagtttcactcttgacacccaggctggagtgcaatggtgtgatcttggctcactgcaacctctaccttccaggttcaagcaattctcctgcctcagcctcctgagtagctgggattacaggcacccgccaccatgtccagctaacttttgtatttttaatagagatggggtttcacgatgttggccaggctggtctcgaactcctgaccttaggtgatctgcccaccttggcctcccaaagtgctgggattacaggcatgagccaccgctcccggccaaatacccaattttctacaagtgtcactggaaagtgctgctcctgtaacttaggagatatgaaatatgagttcatgtgtcaggcctggggtttcttattacacagaagctaaccctatcctaaggggtgtgctctttatgtgcagaaataggagataggagccaaattatttctgtgtctaccaaatttttccaatttgaggaaaatagataaagcctactcccttgtgattatgtcccaagagtttaaaatcaaattaaaatttggtgttgaaatctcaatttcctttaaataagatgacttaaaaattaatagtcactggtcttaattatgaataatgcattatcatgtaatattaagcctcacataagatataatacgataaaaattctgggatgttgaatctggtttaagaatttgtgcattctcagaattttgttttactttcattaagaaacagtacatttaaggccaggcatgatggcttatgtttgtaatcccagcactttgggaggttgaggcaggaggattgcttgagcccaggcatgagctatgattgggccactgcagtccagcctgggtgacggagtaggaccctgtctctttaaggggggagcaggggaggggaggagaaccatttcagtaatcttttctactttatgaatgtgttcataataaagactcctgtggaaactgttctggataaaattattagtgcaagtagtgccagaatagcagatatttctgcatggctgcttaggaacttagtttttgctgacaattttgaaaatgtttcttattccaaagtgcttagaggacctccaggcttatgattgttctttcccaagagtattttttgagggacagggagaaggagctcctatatcttggttccgtggttctctgtctaaagggaacactgccgtaaatacttgagtcatactttaataaagcccatagaagagtgaattgggcttaactccctcatttttcatttgaggaaactaaactgcctgagtgaggcctgaaagccgtttttgatgattttcaggcgtatgcactgggatgggtcactattttggagtcatgtaactttggattttgcatatgtctttgattcctggtgaatgtggaggatttccatgctcctcttggtagcaggagcactgaggagtgaatcctgctatattgcttgttcagaggcctggaggacacaggaattatggacaagtgtctaaatttggtgatggtcagatcagaatgctgagagactagatatgtctgtcagtgaaactgtgaattcaagggaggagtttgggaaggattggcacaattaagataattaaaatcatttgcttttgattgtttaaagtaatgatttttaacccataagtccagtgtcccctttttataatcaatattttgtaaatcttttggtatcctacaataaaattcttagaaaatataacctaactgaaaatacaaataaatgaataataagtaaatagaaaaaagaaagtacctgaattcttatagaatatactatattaatttataatattaacattataggatgtattgtattataggctaatttgctctcaaaagataaatacaaagggcataacttataataaaaatatcaatccaatatataaatgctcaagcatgactaaactggaaacaaatgccttcacaatgtcaaaacacctcccactgggtggcagagctcctcttgacaaactcttggttgaatacttcacagtggcattgtatgaagagtgtgtgcatgaagcaagtatagttcggtacttggaggctgattctctgtgtgtgtgtgtgtgtgtgtgtgtgtgtgtgtgtgtgtgtgtgtgtgtttttgtttgtttgtttgtttgtttgtttttgagacggagtctcgttctctcacccaggctggagtgcagtggcatgatctcggcttactgcaacctctgcctcccaggttcaagcaattcttctgcctcagcctccttagtagttggtactacaggtgcctgccgccaggcctggttaattttattttttgtcttttggtagagatggtgttttaccatgttgcccaggctgatcttgaactgctgagctcaggcaatccacccaccttggcctcccaaagtgctaggattacaggcatgagccactgcacctgctcgattctgtgtattcttacttagcgaagactgtaatacattcttgaaattcttacctatttttaagagacagggtcttactctgttgcctaggctggagtgcagtggtgtgatcatggttcactacagcctcaacctcctgggctcaggtgatcctccaacctcagcctcttgagtagctgggactacagacatgtgccatcacacctggctaatttttgaacttttttgtagagatggggcctctcgctatgttgcccaggctgatcttgaactcctggcctcaagggatcctcccactttggcctcccaaagtgctggcattacagatgtgagccatcacctgacttatccttgaaattcttgatattaagtacagatgctattttaaatcttcaaaatttggagtatctgtgtatgcagtgtcccctagaaaatatgtaaggtagacaacgttgagacctttttaggatacaaatagaaaataagatattatttaaaaaattctgccaccgaaatggattttatgttaaaattcattattaggtttcacaattgcattatcacttttaataccacagctagttgttatgttttatctatagctttagaaagaaaaaaaaaatcaggccatatggcctgcgtaagagatgacagatgaagagcaacaaaacccccgttagttttgatgctgatcagtcaaaaattaacttagtcactacttaatggttcatctgagctcagtgtgctttttcctctttaagtttttttttttttttttgagacagagtcttgctctgtcaccccggctggagtgcagtgatatgatctcggcttaccgcaactgctgcctcccaggttcaagcaattctcctccctctcagcctcctgagtagctgggactgcaggcgcacccaccacacctggctaatttttgtatttttggtagagacagggttttaccatgttggccaggctggtcttaaactcctgacctcagagtgatccgcttgcctcggcctcccagagtgctgggattacaggtgtgagccatcgtgtctgcacctctttaggttttaatgagacagggtctcactgtgttgcccatactggtctcaaactcctaagctgaagtgatccccccatgtcagcctcctaaagtgctgggatttcaggtgtgagccacttccccagcctcattgtgcttttttcaagtcacaatcttggaataatttctgtcttggttagttttgttagtgagacaaatctttttcttccttatagcatcagtaatattttcaagatacaaaagaatttgtagaaggtatttagagttaatagttgcttgatctagtaattcatagttccaaatgttcatatttatgacaatttgaaaaatgtctttttttgtagaaattctagttgcttgggtaacgcaaaggcaaataatttcttaccagatagagcataataatatttgtattctcccactaaatctagagtccaacattatttttgcttgttaggtaacttttttcaaaaaacaaatggttttgtttatctggatagctaaccttgtgaaagcggtgcaacatcaaattggtacagatattaatacctgcatttaaataaaagagtaatttcacaactcagtgttcccaaaacttgacttgttggttcaaccttactaggtatattagcattcttaattgaatcagtcattgcattcttcaacaaaagtttccattccatctgttctttggtttataattctttggtgtgtcgtttgctttatttcccaaatatataagattttttacatttagaattattgctagttttgctacaccatgctgaagaggaagccttgtgactttatgttttatagtatctgatttgcaatggttaatcctcctcacaggattgtaaagcccaaatgagtgatatatgtaacagacatagaacaatgcatgtcaatgttagctgctcttatcatcatcatccttttactatcatcagcagcataagaagaagtttattctaaatataaaatctttgccaaaattttatcaattaagatactttttttgttttgtcttgttgtttttaagacggggtcttcctctgtcacctaggctggagtgcagtgaggtgatcatagctccccacagttgtgacttcctgggctcaagtaatcctccagcctcagcctcctgagtagctaagactacaggtgtgtgcactactacccccagctaatttttacaattttttgtagagatagggtcttgctatgttgcccaggctggccttgcactcctggcctcaagcaatccttccctcctcagcctcccaaagttgggattccaggcatgagttactacgcccagtcgaaacatttctgtagataggaccataggtgcttgatatgtgtagttctgccccttccacatgttgttgcaggagagtagttttatatgcctgatgatcagaacacttgacacttacaagaatgtggtctagggacacctgggatcctcaggacccttttaggatttactgaggtcacaagtattttcataataatgctgtcatttatcttttaactcctgttccctcctgagtgtacagtgcattttccttgtagctgcttcatgtgctggggtgtcatctgtctgacagtgtgtttgtgacaatatgtgcttttctattgtttttctaaaattttatttttcggtttctgatatgtagtattcatggatttcacccacatgaacaaaagctctctggagttctccgtgatttttaagagcacccagattcccaaggcatcgaaactttagtctaaattggaggggaccaggccacagctcctaagtcccacttggcagtttgaatttggcaactcagttggctcactgcagcattagggtaaaaaattttgaaaagtctattctgtgttatctttcatggaatcccagaattgaacattttaatatccaaaggggagtggcaattttaacttcatctagtaagaatatattagtgtgcctctcacaatttggaactcaataattaactattagaattctcaatggaaacaaaaacagtctatacatcttgatttttcctgaaaagtccttggtaccccaaccttcagaagtaagaagacacacattgccaagcacagttggaaaaccacagagtttgctgtatcgcattgaaaaaataactccaacaatgggtagaaattgaaatatatgtatttgagtattttggccagaactgggagagtaagcaacttttataattcaaaactaaaacttctttacttattataggattagatagatgtactatgttaagttttctattttgagaaaattttgtctgagcctaatatttgtctctgtttgagggaaataaaaaagtcttacgataacattggaatcacctattctttatatacagcttttaataacaaaatgagaaatatttataatgtaatctgttttttttttttttgcttgagtaggaagaaaaatcttgcataactaatggtcatttaatcttcattctttaatcttcattgtgaatgactttagcgtttttttcctgaggttagattttttcaaaaataagttttgatatcctttagtcatgctgacttatgtccactttttaataaaattagtcactagtaggtgccgggcacggtggctcacgcctgtaatcccagcactttggcaggcggaggcgggcggatcacgagatcaggagatggagatcatcctggctaacacggtgaaaccccgtctctactaaaaatacaaaaaattagctgggtgtgatggcgggcacctgtagtcccagctgctcgggaggctgaggcaggagaatggcatgaacccgggaggcagagcttgcagtgagccgagatcatgccactgcactctagcctgggcaacagagcaagactctgtctccaaaaaaatatatatatatagtcacgtgtaacacagtgttatatttaagcattgcaaatttactttgtgaataatttctccctcataatttaaaaatatttaaaaatcaaacccaaattaaatatccactgtaaattatcctatagtaaatgtcctgtggtaacatgaacatttcctccccaaaccctcattattctgttgaatgattttgcgtttctctacaatttccacatgttgatgtttgaaccttaatgcaatacaatttttctcatgttgtatttggctaatgttgtctgctgtctgcttactcaggagagtgccacagtgatttgcttctgaaggaaaataaagttatttcttagatttgtaaaatacagttcatctggcattaaatattttttaatacttttacttagcatgaacaggactttggaaaatttgatgagtttagatttgaatatcaataaccttagtgagtgtttatttttagatggttttgttaacatttttatttggagataataatatatactgaaaatgtaattaagtctctaccagttgaagtgtttcatattcagtattattagaaaagtgaagagtaggaattgagcaattaacatttgagtgcatcttttttacaattgaggaaattgaagttcagagaggttaatttgccctgaagtcaaacagccagcaagttctggagcaggactttagctcttctttaactgcagcatctctgttctttagcttggaaatcgctgcgtctgagaacaggggaggtcacgccacatggtctgccaccccacagctgcaagagtgtgtaaatcattattcttaagactcagaattttgtttcttatgaaaatgaatataatctctgtagtctttgtaaaaattaaacccctatgatttttatatcttatttctataaattccatgaaataaaatttgtagcggttttttggtaaaattgtcaaagagaccagttttctttcttgttgtctagaaactttcaaaacgagcaagattttgattcaaaacagaagtatttaaaatcctaatgaattaagtcctcttaaaggatatctcatttgccaataatggaaacatcaccgtatgacttgttgaatataaacctgtgatcattatggtggcaaacttcaaccacacttgtagtactaactttagcagggtaaatttcgatttacctttatggtcagtgatattccagcagcataaaatgcaatttttggaaggctgttcctaaaactcattcccttttcactaagaactgtggataacagactcaaatgtggttcagggtggttgcagatggacactgggaggcagaggtgagagagcagaatattcgattaccccacaggaagaaagctgcctagtgaatggaagacagttggttttgttccttaacctgcccatgagcagtcattatcccattgacaaaactagattctcttttgttggatataggatacaaggacacgttcctcgtagtgaactaatcatgcttgctagctagagcctacaacaattacatctcacgattctgaggacagatggctggaggataattttgaaattgttcatgtcacatctattgtgcaaagcttcttggtacaatattgatagcttcacgtccagctgtagctgctggtttcagatcttcctatttttatcttattgtttaaatgaataatgtcattactactttaaaagccactgaaaaatttaaattagattaaattgtcaaagtgcataactgatgtttgtatctctctgtccttgtgttaattaaggatttgtaggaagtgctgtggatgaatttaacccgtgagtggttgtaaatctgactagactacttgtttgatgctaagtcaaacctgtgtaaaaagaaaatgccgccaaaggactcaacttttcttaaggtttaaaactatttcagaaatgacttggcggtttaaatgtttataatattggtaatcacagtatgttaagcacacatgcatatgtatatattttaatattttaatgtaaaatagtctcgttagtctccattctttaccattatttttgaagtgaacatttattttgacattgtttttaaaaaattgtatagtggattagcatttatttttagaacacatgcagaatcagtccatcgcataatacaaatataaatgttgatatcagtactttgttcagtatcattttctctattgcacatcacctagcaatcctccttttaggaatggttggctcaacaagatctcattaaccttgtgttttctttgagtggtgcactatactaacagctataaagtgcatttcctgttatttgtttcctatgtggcagtctttcttaacttgtcaatactttatttccaagtctttatagaggaagtgactatagtcaaagaagttaaatgttatcttaaaatacacttaaaaaaatcctggaagtacctgaaccattttagaaatattcttgtcatttttactctttaaaatagtacattcaaaaaaagagtgttaataataacacttaaagatatattcttatctttaagcaatattggcttcaacagcagtcacatcagtgtcttgtgctttatttggcctgatgtgggaatggatggtgccaattgtaaaaaaaactttggttaatttatttagtcagtatctagatagaactctataagactatgatggggcttttgtgtaatattttctattgtaaaagcaaaagaacacatttcttgtgcatttaggtaagagaaaaaactcacatatttaaaacctgcttttttgcgggagggtggagataatacacaggtaaatttttattttggtttgttttgcaccaccttctttccatttttggtcagctgttcaggctgcatttccgggataatgtatttaccatgcattttagtcattgtacctctcagcctccagctggccttcccccagggtatctttgcacttgcaggtcagaaaagaccaagttatgaatgtgatctcattttcaagggttttaatctgtttttggaattagtcaaaatctgtgttttgctgtaagattaagcttgtgaaaggctgcaaggctttcctctttgcagatgctttgaatgacttgtatagaaatgtcccacagaggtgcttcctgttgttttcacatccctttcaggaatacacaagcccccctgtttgtccatctctgagaaagacaaaatagctcaatacttcttgcaaaatagaaaatgtcatttgttggttgtggtggtaacagggccggacattattcctcattcccatcccaaaacattgttgactcagctccagacctcatgtagtaagaacagccgtcctcctgtgttatcactggggtggctccaggatcgatggaatgtattgagttggatcatcagtgccagttcactggactgtatttaatcattgaaaaatgaagatgtgtattttccttttgacacaatggaaaatcagttgaatcacgactttttgttccttgaatttgaaaaatggaacaaattatgaaaagccaattatcaccatcatttgaattccacattttttgaagctttcctcccctcaaaaataacctggtgatctgattagtgttgtcaatttccacaggatcttaagggaaggggccactgtctttccacatctgaaaagtgaatgccataaagataaaacagcttatcaagccatggtgtgaggcacactgtgcatcaaaatcacttcttaaaaacgaggattttaagaaccaggaacacaaagttgttaaagagcaagttatttacagagttaagataaaagtgtcccggctgggtacggtggctcacatctctaatcccagcacttgggaggccgaggcgggcggatcacttgaggtcaggagttcgagaccagtatggccaacatggtgaaaccctgtctctactaaaaatacaaaggtagctggttgtggtatctcacgcctgtaatcccagctactcgagaggccaaggcaagagaatcgcttgaacccaggaggcagaggctgcagtgagctgagattgcgccaccgcactccagcctgggtgacagagcgagactgtctcaaaaaaaaaaaaaaaaaaaaaaaaaaagccttgctcctttgtcttttatctgaccatctggtcttctgtagtgaccagacgaagaactgtcttaatataattaaactagctttcatgatgaagtatacttggctactagatgatcttagatttctggccagcaattaatatcactgatggtctaaagttattttaatgttattcattttatagacagtattgctcagcatagtgagtatgggcttgagagccaatctgcctgatcttggctccagaagttaattagttctgtgcacttgggcaagtttcttggcttttctgggcctcagtttacccatctctaaaatgaagataagagatgtacctacattgtaaagttgttataagaattaaatgagttgcatgaacattggagatgtgttgattattgtatttcatacatacattaaaattatattaatggcttgcaattgtagacagatcatcaaatgtggttactattttcacaaaacaagaacatcctaagtgtctactcattcaacttgtatgcaagtaacagaaaatccatccgaaagagatttaaacaataaaggatctgtatgttgcataatcacaaaataggttgactgtgaattaactgcataatgcagtaatgttagcaaggacccaactctttctctttcctctctgcctcttcgctagctcttttccgaatcacagaggctacagcagctccatcacacacattccagctacctgagctggaaacctaccctcaaaaccctccgaagattgctgatgacttgtgagcaagacctgtgtcttttgcctttttctaagcaaatcctgaaatggaatgaaatttactgtgagttacctggtcaaccagagaaaagtagatccctgataaaatcagggttctgttagtgaagaaggaaggttggatggatagtgagttagccagccttgtcttgttgcatcatatacttttttatataaacaatattcatgtataaattaaaaggctaacattggatgacacactacttctctgtcaggagatggttaattgatattttatgagacataaattttatatgcacatgtaacatttttacttctcataaaaaatgctttggggttgaaattaacttcatttcatgcatagagaaggtcagtattcgaaggtgctagaacaagtaactgctagcaggtatgtgatcctccaaaggtttatgcttttcccattatgacatgtaagtttttatttgcattaagtgtcaggatattagatgtaccattaatcttattttatcatcaacactgatttaccttagttatttttgaaaacaggtatgaattttatctatgaaaagattatatatacaagacacggtgttttatattgtcatactagcaaaattttttctaatgaattagctctttttaaatatacatggattcggtgtggtatctcacacctgtaatcccaacactttgggaggccaaggcgggcggatcacgaggtcaagagatcgagaccatcctggccaatatggtgaaacctcatctctactaaaaatacgaaaattagctggacttggtggcacatgcctgtaatcccagctgctcaggaggctaaggcagaagaatcacttgaacccaggagacagaggttgcactgagccaatatcataccattgcactccatcctgggtgacatagcaagactccatctcaaaaaaaaaaaaaaaattagcaggcgtggtggcgtgcacctatattcacagctacttgggaggctgaggcaggagaatcgcttgaacccgggaggtggaggttgcagtgagccgagatcgtgccactgcagtccagcctggtgagagtgcgagactctgtcttaaaacaaataaacagacaaacatgggatataggattcatgaaatgtttcattagctcttatgcagtgatatgtacatacttcttttcagcctgtgacttcaaccttattttcaggcttttagataatcaaaaaaagtattcatttttgcccacattcaaaatattacatttataatccgagtaactgaaagaatgatgatacaaaatatggttgtatgtagaagaatgaatgattgtagtgttatggttagtatagagttaactgatattcatggaattagaaaaatggatttgttttttaaaatcaataaataaggtcaggtggggtggcttatgcttgtaatcccagcactttgggagatcaaggttgaagaattgcttaaaggcgggagtttgagaccagtctaggcaacaaaggtagacacctgtcactacaaaatataaaaattagccaggcgtggtgacacatgcctgtagtcccagctacttgggaggctgttgtgggaatatggtttgaggccacgagtttgaggctgcagtgatctgtactgcatctgtgatggagccactgtactccagcccaggtgacagagtgagacactgtacttagaattaaaaaaaaaaaattaaaataatcagttttaataagttaaaaaggccatatttctctcttcctctcctctctccagataatgatggtgtatcatttggttgacactatgttttgcttggttttaaaaaaaagtttttaacatttatataaatgatagactaagaaaataaaagtgggaattgtcccatgaaatttctgacacgaagcttggaagatggaaaagcagattgggcctgtagagtaaccctgcatgtgagctcggtgctgctgatgccacttggtggggaaatgtggtagatgggagctgacagtttttttgtttgtttgttttgtttttgagacagagtcttactctgtcgccaggctggagtgcagttgtgtgatcttggctcactgcaacctctgactccctggttcaagtgattctcctgcctcagcctcctgagtagcagggattacaggcacatgccaccacgcccagctgatttttgtatttttagtagagatggggtttcaccatgttgaccaggctggtctcaaactcctgacttcaggtaatccgcccgcctcagcctcccaaagtgccgggattataggcatgagccaccccccaacaagcctttttttttttttttttttttttttttttgagacagtcaggctccgtcacccaggctggagtgtagtggcgtgatctcggttcaccccccctcccaggttcaagtgattctctccctcagcattccaagtagctggaactacaggcgcctgccaccatacccagctaatttttttgtatttttagtagagatggggtttcaccatgttggccaggccagtcttgaacccctgacctcaagtgatccacacaccttggcctcccaaagtgctaggattacaggtttcagcccaccatactgggctgagagttgatagttttaaatgtgcgttacagggccgggcgcagtggctcatgcctgtaatcccagcactttgggaggccgaggtgggcggatcacctgagattgggagttcgagaccagcctgaccaacgtggagaaaccccatctctactaaaaatacaagatcagccaggcatggtggcgcacgcctgtaatcccagctactcgggaggctaaggcaggagaattgcttgaacccaggaggcagaggttgcagtgagccgagatcgcgccattgcactccagcctgggcaacagaatgaaactccatctcaaaaaaaaataaataaattaaaaaaaaataaatgtgcgttacagcttcctaagacatctgttgtggaaaatgacattttaacatggctttcctgctgtacccagttttaatgaatatgactttgtataaagataaatggaaactggaactgacaaatgaaatactggtttgggattgagagcaaaaattcaaagcagttggtaaacctttaacaagataagattcccatcatttcacctttacaattgtcatgatgaaaaatgtattttaaggctggagtcatttcattccctggagaagaaaaaggttcggggatggtggccaaaggatttcagagacctcttgattttcttattcctcctcccacctcacacccctcaagattagagtcggtataatttgcatcacacgtttggagtattcagaataatatttcctgggcccttctccccttctcaagattagaatgtcagcaactgcacacttgacgctgagtagcagggctgcctgtttttaccaccaggatttctttttgctttaaaagcttatcccaaatagtggtttgagggagtcctcacctgcgcacatgcccagagggaaggtctgagagcagtttgaaatacagttctgacatttttgcatggaaatgttgagttccaaatacctcatcagattcagatgaggtgctgacatttattcccctagctatcctttgcacctcatgaaaacgtgatcataatttatttaacaccattgtctcaaaagaaaaagacttaaaatgaacgcagtggacacgccatggtttctgctgttccggaaccaccccatctccccaaattacaggagacaggctcccattcttgaaaaggctttgtctctctggaattttaaaaataaaattcttgcatctgttgacattaactttcaaatgtagaaattgttgttaatattacagacatttagtaaaataattgtgaaaatgcatctcatagaagaaccaaaaaacaaatgtgttttcacttagtagattgttttgtttttttgtgacattgtctgtattggccttgtgtcctcttttcatcaagtccttcacatgtaacaaccccctgaactcgtcaaatattagaatgagaattgatgtatatacaaatgtctgcttagacaagtatctatggtatcgttaactttttctgcacggcggtgttctgaacagctgttttgggtttgagaaatatgattgatatatgccagcacccctgtatagaacctattgaaaaaaaattcagagtaaagtaacattagaagctgaaggtcaaggaaaattcccacaaaataattgtttttggctttaataccttccttaggaattatggttagctatggtttctcctgtgagtcttagaaataatttctatttcctcggaagccaaagatttaccaatattttcaattattctgaaattgtatgtgcaataagatttattggtttttatgatgcagataaataattatatgtcccatctcagccttcaattcaaacttttaaaatgtttggcttaaaaaaagaactctcaagcttctctcttcactgactcattttaaatgccctatataatgtgaacgatctcagttcatctcccgggatcattttaactaacacacattgtgcccttctccattttgatgagtggtaacagccaaagcctcagaagtgcgtttttgttgttacagtcgcttctattctcatcaagtaggtaaggtcaaattatatcgctgtcctgggagtcatccttttcatcacttattgcgtgtctctttgttgggtgagtaactccatttattaaactctggaataatgatttatggaagaaattgtggcattgatgagtgggcattcacttcgagaatcttgatgtgttgggatgttaaaaaggtagcaatcttgttttctcttttgttggcatgtctattcttctgactgctaatgcaactcaggtagaattcacatctcagtgtttaggttctcctttaggaaatactgtgaaaggcctagtggcttgtagtttcttttctttttttttttttcatttttttttaggagaaaaatgaaaaacatctctgatcacttctctagtgtttgtttatgacccctgcctaaaaatgcatggctaattctaggtacttaacagttacaaataagaagccaagacattccaccgaaggcatgggttttagaaaatcacaacagttttgtatcaattagcctacaagcctttgaatcttggatcaatgaaaaatactactttgccaataagatcaattcaatcaaattgagctcttgtgagacacgtccgcaattaactaagatataaggctgagtatggtgcctaagttagagacttgtggaagtccaggtgaatgagaaagtcacagtgctttggcataggggctccagaaagtgcaaaaggccttagaggctaattctgtgggggggaaaaatgagttttcaattctaatgaagattcttctagaaaaatgtgtggatttgaaggcagcatttatttatttacttacttacttacttacttacaagaccgggtctcactctgtcgcccaggctggagtgcagtggcgcaatcttggctcactgcaacctccgcctcccaggttaaagtgattcttctgcctcagcctcctgagtagctggcattacaggcgtatgccacgaagtccagctaatttttgtatttttagtggagacggggtttgagatctgtggggtttcaccatgttggccaggctggtcttgaattcctgacctcaagtgatctgcccacctcagcctcccaaagtgctgggattagaggcatgagccaccgcaccaggccggcagtgtgcatttatgtaattaataattggagtaaaggtaaatgtgtacattttctgggaaggggatatttggcaatggaagctgaggcacactttctctggaataatatagcttcagcctcttgcagatttagtataattagagtcaagggggctgtcagaaaggagatagaactcattccccaatcatggttgacttaacactttgaggaaatgaggtagcaagaatgataagtattttatcaattgttctgaagatcaaagcaatatgatagtttatgattcttgcttataatcccatatgactaatacagtgaagcagaagtcctattaagaactgtagctactgaaaactttgtaacagcatccactcaaattggttttggaataagtagatcatacataaacctctgaaatagcggtagtagattcatttgggttgctgcaatggggaatataattacgtattcaactttttttttttagcaaaaagatgtgcagtccacatgcaaagtgagaacatggtgagaaacgttcagtgtattctgtagaggagtgtggggagccatacttagcacatacagccagcaacaccaaagttgtggtcatcttttgattgaaaaatagccctggcaaaatcataacgagaatagtaacagttttgtgataccttttgtacttttttctttctttcttttttttttttttttgagtcagggtctcacactgtcacccaggctggctggagtgcagtggcatgatcatagctcattgaagtctcaacctcctggactcaagcagtcctcccaccttagcctcccaagtagctgggactatagatgtataccaccacacctagctaattttatgtttttacactagagatgggaggccgggtgcagtggctcatgcctgtaatcccagcactttgggaggctaaggcaggtggatcgcttgaagtcaggagtttgagaccagcctgggcaacgtggtgaaaccctcttagccaggcatggtggcggacgcctgtaatcccagctactcaggaggctgagacaagagaatcgcttcaacctgggaggcagaggttacaatgtgccgagattgcaccattgcactctggcctgagcaacaagagcgaactccatctcaaaaaaacaaaaaaacgaaacagtagggatgggactctctctgtgttgcccaggctggtctcagactgctgggctcaagcgatcctactgccttggcctcccaaaatgctgggattttgctgaccctggctcttttgtattttctagttattctgtttgataactattttctaggcatataccatattctgtatgatgtgttgggtactgaggatacaaaagtgaatagagcacactccctcttgtcaagtcgcttggttggttataacctatttttctcctcaaaaccaacatactcggagatgagcacacattctaacaggaggagtagcccactttggcaagagtaaagaaaaagagatcatggagtcaatattatctggcagaaagtcagctacatggttgacattcctctctgcagggtggacccctgggtccattgaacattgctgagctattggctgaggaagaacatataaccccagcagttataccttcctttaccacctgttaggatttaaaggacaggacatctcacctggcttggcttgggagtagggtagaatcaggtatatctatgtgtctagaaaggttttgtatgacaatacaaaatctgtgaacaggagtatccctttatacataatgagggtgtagaacatagcccaatacaggagagtggactaggggaaaggaaacggtttgtgtggttttatgtgagagggttaggtaactcttgaagttcatgactggaacagacatggacagaaaaaataataaacactacgctcatctgaattctttaagcaaaggaattgggctgggcatggtgactcacgcttgtagtcccagcactttgggaggctgaggcgggcggatcacgaggtcaggagattgaaaccatcctggctaacacggtgaaaccccgtctccactaaaaatacaaaaaattagccgggcgtggtggtgggtgcctgtattcccagctactctggaggctgaggcgagagaatggcgtgaacctgggaggcggagcttgcagtgagcggagatctcgccactgcactctagcctgggcgacagagcaagactctgtctcaaaaaaaaaaaaaaagaaagaagaaaaggaattggaagggtggtagcgcagttgtgtctattaaattcttcttgcacacaggatgttacactatattcatttgagtttcttgatgtttcacttaacaaaagccagattaatttagctttagtagaaaagaaaaacgttgttgtaacggtactaccgggttcttcataacctcaaccagcatcgaaagttaagggaaacaagaactagaaagacattgagaactccagcagtacctccattcagtctctgatttctgctttcttcagggcttctgctttattcttctttcccatgagttgctttctttaatgctctatttccttgttacagtttgtctgactagtgttgctaagttttctttatcatagttctagccacaagtagagatctctctctctgtcctacctccaagttctgtggagagataatctagttggttccacttagatcaaagggtccaaccctgatgtcatcagtggtggctagaaggaggtggtgcagggtgatgacaatgaaggtggctgtggctgtgggtgatagggtggagtcatccaggacacctctgcctccccagggctcactcctttggatgggggttaggtaggtaggtgtgtgggcgggtgatggtatttcccagagaatggagggtaccaccagagcttggataaactggtaccttataagatacataggattaaaaaagactaatacatattgagggtgtaagaaaaataaggtcaattaaataatgatgtaaaagataagcatacagcccatgatccagcttggtttaatgtttcctaatatttaaagcaaaagttgaagtattacttattctgtgatcctgtacttcttttgttttgttttgttcctcaattatttatgatataaaattttcctaggagaccattttcccatgcaggcagtataaaagattttgtattctaagtgaattccaaaacagaagaaaaacttcccatcattttcaagtaaaaagtgattgtatcattctgttgagatggaatgggatcgtagttcatgtgtttaaaggtaacattcaaagggccttaaaaaaaaggactttattttttagagcaatgttaggtttacagaagaattgagtgcaaggtacagaaatgtccttatatccctttcccccacaaacttgcatagcctcctcattaacaacatcccccaccacagtggaacatttgttacagttgatgaacctacatggacacatcatcatcacccagagtccataactgacgtgagggttcacttttggtgttgtacattcaatgggtttggacaaatttataatgaccccattacagtatcagacaatatagtttcactgtcctaaaatcctctgtgttctgtgcattcatccctccatccccttgaatttctgtacctaaaagactatatctgcttacccttgattaagtaatagattctgaaatgctagactctgtcatctcagtattttagtattcgatgtctaggtatttcttcatgaatgaatgcctttggctgtttgtctcattgtgaaaagttgatttgattttaatgtaaatatatccattcctcatcttaataattttttttccaattttaaagcttgataattttttaaaaaatgagcaccaatactgtgagatttcgattcctaacgaaaggccgctgagttgtcattggccttaattgtaactagtattaagtttctttgtatttctattacttatttgtaactgctagatttattttccatagagtttaaagtctttgagttatgagaaatctatatcctcccttttaaattacttaagaataaagcttgtattaaaaccatgtgctagacattttaacttttcctgttgtttaaaaaaggccttcattaaaagttggtacaaagaaagatcttaagctaccctcattcagaatctttcacattcttaatacattgaaagcatttgtcaacacttcattactaacatggaatataagttaatgatgcacaaagtttaaaaccttatattcaattagagaacctattagctttgaaagcagtaaataataattggcatttactgaattttaaacaggatctacatgttacatttttgttttagagtgcatataacattttgcattgtgctgtgaaaacctgatgttttgagaatacagttgccttttagcatttaacctaaagtctcttcctgattttaatgtggaattatttcctccttttaattgctaacatgtttttcaattatttacacacaatttttaaggtgctaattggcactggaatagctgatggaatgtaaactgttggaatcaacattaacttaaagcacatccacagtaaatttttgtatcctggcctggaattgctggcatttgtgcattaaatgcatcactagtctagcagtaaaattcataaaacagcagtaggcggttgtagtatttaccttatcagagcctcaagatgccagccactggatctgctcagcagaattccaaagcatcctttttagtgttgtaaggttgggttaagtgtcttagacctcttttgaacaaaaacattgcttatttatgtgttgagctaatttgatccaagggggttaataaaataaaaacccaaaccattctcctaaaaccccaacattcgattcatgtaagcttttgtatctcacgcttgctttttgttttgtgcttctgttttcatcccgagttgtctttagttgtgatttgctctccttagcatgttccatgagaacccaacatgccagtaccttgcatgtgctgtgctgagcaagacagttttctcatctgtttatccccttttccctctgtgtggttttgctgagaatttgccatttatttatcccataccctaattttacagttattcctccacttggtcatgcaatttctattgtttgttattaataaaagactttcaaaggccttaacttctctgaatctaaaacattgctggcaatcacagtacccaggacatatttttgtgtggcttcttgggttctgctctgtgcactcagattcagagactggggaggaagccttcctttaaccagccctttccatggttctgacctaggaattgtgtttggcaaccaccacagcactcaggtagtcatttccagtgatttccaccactctgaacctggctgctgaccatggaggagactatttcccaggcttggtggatcgatggcgattaacctccgttctgctaagtctctgccaggatgtcacacaggatgtgcctgtccttaagtacaatcacatagtacgttgtttagttcattatgtggcatcattttatagggcatttgagtatttgaagtggctgcttcatctaaggacgaagtcacttcaagttggcattgacgtagtttcagttggtgttactgttatattaggttggtgcaaaagtaattacagttttaaatgcaaaaaccgtaattacttttgtaccaatgtattttgatagtaattttgatattttaagtgtttttttcagtccgtttattaaaggtctcttcaaacttaaaattagtcatggtcataggcagtagttaaaaattagattctggaagagtaaatttagatttttttttttttttgagatggagttttgttcttgttgcccaggctggagtgcaatggtgaggcctcagctcactgtaacctccgcttcctgggttcaaccaattctcctgcttcagcctcctgaatagctgagattacaggcgtgcaccgccatgcctggctaatttttcttttcttatttttagtagagatggtgtttcaccatgttgaccaggctggtctggaactcctgacctcaggtgatccacctgccttggcctcccaaagtgttaggattacaggcgtgagccactactcccagccataaatttagatttaaattatttgtaggctgggtgtggtggctgtctgctgtaatcccagtctttgggaggctgatgtgggaggatcacttgaggccatagtttaactccagcctggatgacatagcatctctacataaagataaaaaaatttagccaagtatggtggcccatgcctgtagtcctagctactagggaggctgaggcaggaggattgctacagccctaagtttgaggctgcagtgctgtgatttaccactgtactccagcttgggtgacagagtgagactctgtctctataataaatgatgattttttttgaagttagatttattttttgaagcactgagtgggaaataggattagaggtctttttagagatgctactgcctaaaacacaattttggacatacactattatgtggaatcttccttttacctcaagtcttgggtagtacttttttgtgtagggtcaagacagacaacctttggcagtgacagtaacactgtgttgctactccagtctatgagattttttttgtctctgcaaaatgcattgactaatcctggtggcttctcctgtgaggtcacagttcctcctacctgtggtgtcatccaatgctctgctttaagagaacctttggggaacacaggctttgctcctctctccttccccatggccacccccagtgcccatcacacgctgcccttacgtcctggcctaaccgcagcctgagctggaacctatgcttaattgctggggaaaccttctgcctctgccgacaccccgttattgcccctgcctggattcttctcgcttagttttggtcccaggcaggagtcggggtgcaggaggctttctgcttggggcagtttctcagccctctccataaacctccagcccaagggctgttgcaattggaatcaaaggtggggtcagtgaactcctaggctctttgaccctgaggtggcctgttagaatctgttatttgtgttcatttgagtgagtggatggactcagtgggtaaagaagtgactctgtatgttgtatatgactttaagttgttgtgatggattggttgagcagtcatgttggttaaaattgactgagtccacaggtagagctggtgatgctggtggctgggcttgctgcatcccaccctgcttcctggaggggctgaacagggcactgcttcgggatatgagcattttcttcttacccctttgacatacggatgtgcaaaattttgtgactttgaactttcatatccaactatgcatagccaagcaatgtgtcctataattcatatgaggtttcattgatcatttcggttgctttgggttactctttttttgcatacattttgcatttacagaattagtgtatttttgtaactggactcaggagagctgggtgaatatgagagaatgtctctactacttatggcattaaaatgacctgcgtaagtggagttcttgctcgtgcttgaaagtgaagggcatatgtaatacgaaacactgtatctgtgatgttttagattgggattgtgcagatgtgtttttttaaaataatgcataggtgaaaaatgagtagattattaaaataatgaaaaacattctgtttttgaagtgaagtcttttaatatcatgcttctgctgttttatttttaaactaatagttaaaagagcacaacgatttctttttttctgggttggaaggaaatcctaattatctccaaatatggagtgacttaaaataagtgagccctgaggaggggaacatttgtttttcttaagcttctgtgaacaatgatttccttgaaaatttttattttgcattctaatgtttttttcaaaaggaaggtgttttttttctaggtggtaaaggttccaatacattaaaggtggccggtaggccaggcgagatggctcatgcctgtaatccaagcactttttgggaggcctagccaggaggatacttgggcttaggagttcgagaccagcctgggcaacatggcaagaccctgtctctactacagatataaaaattagccgggtgtggtggtacacacctgtagtcccagctacctgggaggcagaggtgggtggatcgctggaatccaggactttgaggcagtgatcctaccactgcactccagcctgggtgacagagtgagatcctgtctcaaagataaaaggtggagggcacatggcagtgacccgcctgtctgtggtgacgtgcaaggacggtgtcctcctcaccatgcatgtgtgcatccagccctacctcgcacattcatgtgctccggatgtttgtgaaagaatcaaccagtggaccgtgattcacctcatggagcctgtgagattttcttttaacgtagtcggccaggatgtgagaaggtccagcaaggctcttggtgattaaagcagcatgattcttgttgactggagcttacatttgtatgctggatggtttctgcttgtccagctctctgggcctggtcgtggaggagaattggaaattttgaagggtttagatgcttgtgctgtcatcagaaccttcttaccttctgtgtgctcagagacacacagaccacctcagccacagaaggagacagtgggagagtatgcctcatctaaagacagacatggtgactttacagtttgaaatgaagtttcaatgaaatttattcctgtttgaggatagtagcatgaaaattttaaaaatagtggcaaaacccctccaaatacaactctagccaatgtgtaattgagtgtattttagggtatgttataaatgttttgtcactaaactggtaatcaatgtcatgaaaaaatacaactgcatggatggggtggggctgcagggactggctaacttttgacaaagtgcagaatctcaatggaatcagcagccaaaacaaacaaacaaacaaacaaaaaccagatcccattcttaccttgtgttggtgaattgtgggctactttgtaggacttcagaagagaagagaatctcatctctgtaaagtgaaaacagggactatggataagagaatgtttttacatatttttaatgttggactatgaggtccatcaaaatttaagactttcaaaggaaaaaattatttaaaatagggttttgtacattaattaaataagactgtactgtgggtactctttaaaggcaaccacccaagttctgttgaaacacatacccataatccccacagagctcttctttcagaggatttctcatgggaacaagttctactgctagtagttgaattatctatgttatcacaattgtatgaagaaacatattggatcaagatttctactgtttgcgaaaatatcggctacaaacacacagaaatgcaactgtcgagctctgagttacctgttggttgcagttttgttctcctgctgcagcccactctctggaaatgctggggcagccactgtttgatttgtttggacctggctgatgtaaggtctaagaatggatatacctggattattcctgtccaagtagttgaaagtggactgcttttttagagtgctgaacaggaattgaatttgggacgtgatagagaccaaagaaagacttgtaggaagtgaatgtcatttttgttcaaagtatttgcaaaactaaagccaataaaaggctgccttctcggtggcccttttatttagttcctggctttttccttggaatcagagaaaagtatggcaagtttccccacagaagagagtggaatgtcaaggaagattgttcataaaccacattcattgagtgactgctgtgtttagggtgacattttaatgccagctggtagttaattgcatgctattttatttttttttctgttatcttaaaatatccttcatacgtgaccacgctattttatttattagtttattttattttgagacagagtcttgctctgttgcccaggctgcagtgcagtggtgcaatcttggctcactgcaacctctgctgcctgggttcaagtgattcttgtgcctcgacctcctgagtagctgggactacagtcatgtaccaccatgcctggcttttttttgtgtgtgtgtgtgtttttagtagagttagggttttgccacattgcccaggctagtctctaactcctggcctcaagtgattcacctgcctcagcctcccaatgtgttgggattacaggcatgagccaccacgcccgcctgcccatactattttaaacagtggagaaacttctgtaggaaatgagacggacaaatgaagagagaaagagcctgcctgtgacctacagaaaatggagtttcctggattaattaatgttattgcttacaatgtttgaagtatagcctaactgctataacctaaaaaaatcaaatggaaagactgtgtgcttgatcagtagaagatgagtggcccgaaggtgtccatacctttgtataatttgcttgtcaccatctggttagcttttagagcccattgatgtgcaacaatatttatgacatcatggggaattttttatgttaacacttcataatgtaggctattttttcagtagttatcaacacgtagggccagaatttgctggttaatttaatgcttaaattttttaagcatcatcattgcctgaaatatgtttttttcttttttccatctgtgcagtgcattttttgtcatcattaagcaatagcattttaattggagtcaccacttggtcaatagatgtcaggtcatggcatgggaagaaaaggaaagcgcactcagtgataacctgtcctatcgggaactcacccaagtacttactatccactaccctgccttcagtgatcctttctatgtaatgttaaagttaaacatgtcatttccttacagagcataggagctgtataactcaacgtaataaatctcgacgagttcttggcaatgatgcccatattttatgtgtgctaagattatctctagtcataattatttaatacatatggtatatgtaacatttatagccttcccaaagggaaaaatgatgtggcataattctggcagattgtttatattgttcatgtttaaaatgtattgtaaaaaatgctatgcatgtgattttgaaaccccagtgttctatttttaaatgcttgtatgtctgtaagaaactaagcacagtaagtaatccagtttttaagtatttcctcttgtaaattgctgttaattgctaatgttcattgaattgacctgctaatgggcacaggctgacaaagggagtatccctctagctttttgatgaactgttcaataatgtcagacaatccataaatttgcatgaatgtttaagtttcatcagccgttgtggtctaggcaaatttctgtgttcttattatcaaacattgagaaactaaagtttataaaaaataacttgttagagtgagctaaacatttaagaagtattgcttttgtgtgtttgatgggctaaacaattccttgtcttttcagattatttcatttgtgttctgacagtaataactgtgttttatctggctgtcaggggtccttctagaatggtcctaaattctaatgtgctcattcattgtgtttagcctaaagaatacattaaatagctaaaaaaatttatgaaataataggaaagccagttcggttaattccaatgaaaattaaaactatacatttgtacccagtgaaaccctggaacttattgatgaggtggatattggtaattgctatgatctgcaaagtgctttttttttctttgtataaaagtgtattcatctagtacattcagtattttgcagtagttatttaaattaaaatttgccaggccagcccgggtgacagtgagactcgggtctcaaaaaaaaacaacaacaaaattccacttttttttttttgagacagagtcttgcactgttgcccgggctggtgtgcagtggtacagtctcggctcgctgcaacctctgcctcctgggttcaagtgattctcctacctcagcctcccaagtagctaggcttacaggtgccagccaccatgcccggctaattttttgtatttttagtagaggcggggtttcactatgttggacagactggtctcgaacccctgacattgtgattcacccacctcggcctcccaaagtgctgggattacaggtgtgagccactgtgcccggcctaaaatttgccacattttaactgttaacttcaaaaaaaagagtgttaacttcaaaatgtaagacaacttttcatcatttaaaaaatattaatagttactatatgttggtaatttgttaggttttaaaagtatacaacatatattttatttattgtatttctaatttcattttattataagtatacttttacgttaaagacatgcttatagcgcaagcaattgaaaaacaagtgcaaagcagaaaatacatcccttataattctacagtgttaagtattttatatactatgttaatgttttggtgcctagttttgcctttctatgcctatggatatatattttaataactacataggttttaattaaaatggttataaaggccaggtgcagtggctcacatctgtaatcccagcacttggggaagccgaggtgggcagattgcctgaggtcagaagttcgagaccagtctggccaacatggtgaaaccccgtctctaataaaaatacaaaaaaaattagccgggcgtcgtggcaggtacctgtaatcccagttactctagaggctgaggcaggggaattgcttgaaccagggaggtggagattgcagtgagccgagattgtgccattgcactccagcctgggcgacagagcgagactccatctcaaaaaaaggatataaagtcgtttgtttaattagtctcctcttctgtatgtttaagggtgttttaaatgatttttttgtaaggcagttataatattttttctgtcaatgtccatgtcaacaaatttcttactgataccatgtccaaatgtttatatctgttgacaagtgctttggggcagtgctggtgtttggccctaacaccggagtttgagggagatgttactttgaaaactctactcccaggttatctgttaagttcttaaccatctgaccttgctctttagatttggaatgttgaagttttggtttgagatgaaccagttgtggaaatttgcatgatgctggaacaggtgatcaggttgcaaagatcaggtaaggtgggttttgtaggttattgttgagtcaggtaattaaataaaaatctgatgaaagaggaatcaaatagccattaacacccttcctattttttgaagagggaacagcattatgcatgttgggttttgaagctcatgtgatagaagactgaaattatgtcttgacagaaccccttttttcctaaattctttggcaatttattgagtgcacgaactcaatacaggtactatgagagcagaaagtgttcttgcctgtggcttgtagtagtggttagtggtgggctttatattaccttttagtgtctctgcttcatggcttaacttcactaagcaagaggtgctccagtgtaaatgagaataatagttactacatcctaacattactgtaagaattaaacaaaatgaatttatggatgtcacttggtacagcaagtcttcatagatactgtagtttttctttgttcttgtcctttattctcaaattgtcatctctataaggttaggacagagtttcccaaacttgagttggtattacagatttctggactccagccccagagtttctgattcagcaggactgatggggcctgaatatttacatttctaacagttcccaggtgatgctggtgctactgggagggaccacactttgagaaactctgggttaatgtattataaaggcaggtgttattttgagccaatacattatgtaaccctttctttttaaaccccctgagtaaatagcatttaagatgggcaaacttgatattatatagtgccatatgccccaagcagttaaatttgaattgttttttattattaaggaaatttagagctagaatgacctagttatttcagaaatagaatgatttagatttttgaggattttgatagcatctaagtatatacctataatattggcttaattttaatgaaagttgttaaataaacattttccttgaatgtggacactacttatgtttctagtgaattttattcacttaaacatttttttccaaaaattttaagtgttaatagatgcagaattcaaaaagaaaagttaggctaggatccttttaaatttattttatagctccctgtgaaagatctgcagaaactgagctccttttaacgtcatgatttttaccacatgttgaagataactagaattgtcaaccaagtcttgttgtgagttgccagtgatctgccatcatctgtgagaattaagcttcactaatgtaattttcttgatgagtgccagacaggagcaggtaccgaatatatggtgttgacatacttaatttagtgctctttccacaaagctattacattgactattaattggccttctgataaaatttcagcttaatgcaaatgatgacaaaaggcatcctaggatactggctgctgcttctgaaattattcacatgccctgagatctcattagtgacagtgcacatacccacttttctttggaatgtaattagggttcttttaaatataatggctaacatttagactgtgatttaaaaaaatatttttgacaaaacctctaacttaagactttgtagtttgttcttctgttgtatagttgcacatcttccatagtttgaaaagcaaagaggagcttatgttccattcttcacactctctggttttccattatattggccttgcctgggaacaggttgcacaagaaaagttcaacaagaactttaagttgcgttttggtttattgaagtatgcatggtgaacagcaagtagatttctgtcttttcatggtttggtctttttttcttcttcttttcagttttcagtcctcttctcatttattagcttatattttaggattttgcaaaatgttattcttttatttatgttaaatagaaacatgagaaaatcctttgttttttaatttttattttttggagacagggttttgctctgacgcccaggctagagtgcagtgggacgattatggctcatggtagcctcaaccttctaggctccagggttcctcccacctcagcctcctgagtagctgggaccctgatgtctggctaattgcttttttttcccctaaattggaaaaaaaaaagcctttaaaaaaagtcagaatattccttatggatccaaaccaagttcatggatgcaaataaatgttgagttatttggacactttcatatcatcttagaattttttaagtcaatcctaacatctaactcttgagcatgttctcatggcctgagtgagaattgtcttatcattaaagttcttgtgtgaaaatagtgacgtttaaacaaaaattctggaaaatagtgaatttattcacaatatgtagatcacaggaatgtatcattttctggtaagtgatgtataaatgatgatgccttgttccatctttttaaaattgtatgacacaatgctttatgcttttttttagttttacagttctctgcaatgagcacctatgatattttataatcagaagaaaattatttgtaaccatgttttaacaatgcccattaagaggctactgttacacttactttgtaaatattatcagattttgcttaaggcaatgcacatataaatccatatatgttctacaggagtgatcaccagatgggatgaagtatagggtcagttagtggcctttaactttttggttgtctcctataatggggtttctcagcatctgcataaatgacattttggactggattattctttgttgtgtgggactgtcctgtgtattgaggatgttttgcagtttccctgacctatactgtttagaggtcaataatattgaccccagttatgacaaccaaatatgtctcacacactgccagtgtcccctgggggcaaaattgcccctcattgagaatcactacgctagagtaaaaaatacatttcacttggcagcccagtgggtaaatgcaagcgtgtgtgtgtgtgcacacacacacacacacacacacacacacacacacaccccaaacaaccttactgctttgtaagtgtacattgatatttcctattttattttgttccattctattcattccatatcattttctttaaaaatgtttgtgaggatatttttctgaatagggtggttcctgtgacagttagtcttcactttaaaatgtgcataggccaggggcggtgttgcttgcctgtgtctcagctactcgggaggctgaggctggaggactgcttgagcccaggacttcaaggctgcagggagccatgatcatgccactgcactccagcctgggccacagagtgagaccctgtcccaccttcccacccaaaaaacgtatgtgggttaaagatgagctgttttgactctatgtgggtttgcttacagcgaggcataccaagattaaagaatactgcttattctgggttctctgtggatgggatgtgtactgatgaatacatataatattggcttaattttaatgaaagttgttaaataaatgttgttttccttggatgtggacactgcatttgtggacacttaaaaattagctgcagtttaggcaccagcacttcccaggggcctcctccctataatctgacacatcacacacaaggcagattctctgaggtgtggtctaaacatgagcaggagacaaaggttgtgctgttagcatgaaaaggttgtgccttcttgggcttcagggttttgtacaaggttgagatggaaggctgcctatgaattcagaattcatatacagaagattcatatagaatgagagagttttgttgtcccttcaggaatatagattgtatcttggggcagatggctttatgtgtctcatactgcagattcgagagatttaaattttcatttctctaaaggaaacatttatagttctcagttcttaagcacactggaagttcttcccttctctttgcatttgtgtttcttatacaaataccatgtgtgaaatatcagttatactgcatttatgtacaggatgaaggtttctccctagggaataaataaaccatcctccatgtgcctcattaaaaagataggaaaagaaacgtggctttgtcttctaaaaatcagtcacaattttctatattgcatttcatggtatggctttatggaatatttttattatttaattttttgaatggctttttgtttttgctttaaaattttacttatatcttaaattaaggatgctggatcttgaaaaagttgctatggtgactatatacttaagcttgatgtctccaattcagaaatgggtcattgttctaaaacttcattgtaaaatctgttacttggaactttattttctcatggaaacaatattgcaagtaatagattccagactcaataaaaataacttatttaaatcagaaagtaaaaagattacacccccggtcccctccgagacaggatctcactctgttgcccagtctggaacacagtggcatggtcatggctcactgtagcctcgagcttcccaggctcaggtgatcttcccacctcagtctttcgactagttgagactacaggcaaatggccaccacgcctggctaatatttctatttttgtttgtttgtttgtttttgtagagacagtatcttgctgtattgtccagactggtctcctgtctcccgggcccaagccatctgctgagcgggcagctcagcctccctaagtcctgggattacaggtgtgagccacaatgcctggccaagtaaaggaaacattgtatacttatatctttgtatttatactggagtagtctccccgccatccaccttccttccttccatgaattctcatgctagaacacgaggtatagcagatactatgtttggcattttttttttttttaatatagtgtgttgtgaaccacagggagctttggaggatttgttcattccctgaatagatatttactctgtacctactatgtgcaagacactgttctaggtcctggggatgcagcagagcaatcctgctctaatgcgtgctgttgtttgacagcataacctgtaattgaatgtcctgggaagcaggaggcaggcagcatgaagaagccttagagctgcctgcagctgagggccacgaccctgggaaaggacacggtggctcctgaggcttctgttccagggactctgactccccattccgccctgcacacttggtgtggttttctagaactcctttttgaaataggaagatctggaaggtagtcgcgtatggtttcaagagagcttaaagtgacagtgtgttagtaaaatgtttcacaaccactctcagctgaggctgaaggagtggggactgatttgtagtgtttgccaatttctttggtgtacacactcccgccctggcctatttcaggaagccaatgggatgtccctgagtgtggagttggaaaacacaccatcatacacttttacatagtgtttccactgtgtagatacagcagacctaggacaatccaaggccacacagagtagtaaaatgcaacacagatgataggaagttttactttctttttgagacggagtctcgctgtgtcaccgaaactggagtgcagtgtcgtgatctcggctcactgcaacctctgcctcccaggttcaagcgattctccctgcctaagccttcagagtagctgggattacaggtgcccgccaccacacctggctaatttttgtatttttagtagagagggggttttgccatgttggtctcaaactcctgaccttaggtgatctgcccgccttggcttcccaaagtgctggaaatacaggcgtgagccactgcgcctggctgagttttacttatttattactctgctttttaatttatttaactgtaagtttatatatcttaatttttaaatgatgaaggtggtaataactggcttgcaaaattcctgaaaacttaagagtcctcatgagctagtcttcactggctccagcatctgggagcaccacaatactttacctaaaatcattatggctggatgttagaatactgagttgttcagattttaggcaggtaatatggaatatgtgtcataagatgtaacacctcctgtgatgtctgaggcaggaccctgtagtcaaaattttggtatttctgtagcaaaatgtgaatattcaccaagtaaataaatactacaaataatcttggattggttcagagttgcttttgccaccaaatgtacttctaacaaacttatgaaaaatttttcattttgagagtcatttgattttggaattgtggacaaggcatcatgaatctgtgtcattgtgtttgcaagtcacggttggtgttccaggtctagaagaaactgtgtgtttgctttctcacaatgagaaggagaagaaactcagcatgatctcctacttggatcattggtgccctgccggagcggcgcctcacccctgcgtttctgcagcctcttcttcctagaaggctcctgtcccggtgactcttcctgtacttcattctttctgcccagctcgtctggcctccactcctcaccaagtgcttcatgcaagattgatctgatttttcttttcactccctcggttggtgtgcagcccccgagcacatacttgaaagagtgaagtgaaacttacagccacctctgaataaacatcccagcagtggaactgcatgtcccaaagtgcttgaaatcttggcttctgtgtcttggcaaagcttattttctttcaatttctatgattcagacaggttgcaatctagtcagtcattacccacatctttctacacctattgtagcctgtttatcagcgaatgtatctctgaaggatttcagctggtaaatttgcattagggacagaggcagttgagccagtgtctcccagagtggtcatacgtgctaggtgctctgatttcttgatgttcctgttgtttttaagatctcacatggaatatttgatgctaggaaccctaacttaccgaattcagaggtttttcttcagtattactttttatgagtgggaaactataaagattacattttatttatttatttatttttgagacggagtctcgctcttgtcacccaggctggagtgcagtggcggatctcggctaaacaattcacagtcttgtgcaatattctgttttgttcatttattacacttaggatgaagtgtcacactttgtgaggtgatttttttcccttgtcatttgccacttgcctaagtgtacttcgctgtctgacagtactgaatcaggtcagtttttaggtggcagcaatttataaataaccttctctttccaaagaagaagcaacagcttattagtggtttgtttatgaagcttgcttttagttttaggcagcctggatgttaattgtctaatcagagttgtgtttcaccataaacactaatgtggtcagtgtttgagtttctgtttctctttcttggactggtattgaaagacataactgattttagatgtctaagcaatggcttttctttgtatttgctgtcatgtctccttattaccatggtctgtggggactggtgtatgaaagtgattttattgtcagagtggcttccagttcttggggcattaagacatttccagtaatttctgtggttgcagagataaagttgttagtgggaagtgtggaccccagtgtagtcaaggtctgggttggttggacttcgaatctgtgaacacccattgtctccttggctttggcagatgcatcctggttgctccttttgtagtactgctcttatttccttctgtgtcattggctctctcattcttcaccagaaattgttttttcattttgtttttaattttctttacccagaatataactcaattcagaattgactaggtcttcaagagaaggaatcaaaaagttagaatacgggccagacgtggtggctcatcccagtgctttgggaggccaaggtgggaggatcacctgaagtcaggaattttgagatcagcctaggcaatacattgagaccctgtctctacagaaaattaaaacataagccaggtgtggtgacacgcacctgtagtcaaagctactctggaggctgaggtgagaggatcgtttgagtccaggagtttgaggttgcagtgagcttagttacacccattgcactacagccaggatgacagagcaagaccttgtgtcttaacagaaaaacaaaacttagaagttgcttcctgttatatttctaactttgaccccaattaagtttatcactgaagccctaatttttctttcgctcagttacccacctaggggcctcatcactttttctttcagtcttttggtcatgaatatcaaaaatttaatgttttaaattaattatgtcccatccaaggtgttgactgtgttgacttctgcttagaagagcagggtgatgagtcaaggccactgtgccaacccaaagggacaggaggtaccactgtaaaggttcaaccaagaatggtgagaaccataattcaagacttcacactggtgattgtattctggtgtggacactgtccacactaaagattgtgagatgttttcaggaccttctacaagaaaacgtgatggtttttgggaaataatgattcagtacttgtaatatctttatataggttttaaatagtgtttccttgtaatatctttatataggttttaaatagtgtttttagaaaactgagagattaaagataagagcttaggccttttcccacttggatacttgacatgttgtttacagtctttgaaacatgttggtattgtaaagcagtactgctagcactgttacttctttcatagatgtttggggtgattattaatggagacttagtttttctccaaattttcttctgttcagtgaagtcactgtagtcactgtagatttgaagatataacaacattaaatgatttaagtactttttatatgcatatttgagggagtgagtaaaactattagaatattaaaaattttttttttgttatactgaagtcctacaagtggctccaatgtgtggaagcgtaggtgttgagtagaggtcaaggtgaatggtgggagagacaccaaagtctttcaacgagagttttgaattggtgatgaatcagtggtgaagaacttgggattatttttggaatgttttatcagctcttgattgacagaatacactctcgttctcagttttttttaacaacactattaataacagtactgactagatttattactaaaaaccagctcgggtgtttgtccagtaagtttactgtctttgaaggaaaagcatttttgtaccaacaaaattttgagcattgacatggagttaattataatcagatttggctttttaaagcctaactatttttttttttttaaagataattgtgggttaaacattaatttaaaactgtcttggccaggcagggtggctcacgcctgtaatcccagcactttggaaggctgaggctggtggaccacctgatgtcaggagttgaagaccagcctggccaacatggtgaaaccctgtctctactaaaaatacaaaaattagccaggtggtaatggtgcacgcctgtaatcccagctgaggcaggagaatcacttgagcctgggagatggaggttgcagtgagctaagattgcgccactgcactccagcctgggcgacagagtgagactatctcaaaaaaagaaacaaaaccccaaaacatatcttactttaatattgctctgttttaatttgtgttactgttcttcgtcatggaagatgctgaaatactctcgtctcattgcatgaactgtctggtatccgttttgacttccctgtttccctttgtgtcttagatgggggattttcaggcacaccaagacagcgttctctgatggcgataagccctttgatcttttccccaatacttaacactttttgctaatgtgttagaagaatttcttctttccattctcctaatctcttcctgcttctacccatgccaatatacttcctcaagacatatggggattaaaacgtaggaatattcaaagcagctacttatacagagttttatgtagattgttacataatttttttgttgcacttaatattattcttaaaccctgggtatcctgctcaggactacaatttgtctgcaaaatagacaaaataggatgattcattttttgagacaaggtcttgctctgtcacccaggctagagtgcagtggcatgatcttggcccactgtaacctctgcctcccaggttcaagcaattcccctgcctcagcctcctgagaagctgagattacaggcatgcaccatcatgcttggctaatttttgtattttttagtagagacatggttttgccatgttggccaggctagtcttgaattcctgacctcaagtgatcccccaacctcggcctcccaaagtgctaggattacaggtgtgagccaccatgcctggccctaaattaggatgatactaatgatagcaacaacaacatcaaccaccgtccctactgttctgcagccgctggaccttgggctcacttgctttgtgcctgtgattttgttcactgtctgcatatacaggcacatttgctcataatgacctcagaagtttatggcaacttcctgtggttggcattgtagccctcttcatttattagacgaacagaaactgaggcactgagagctcatgtgacccattcaatgtcacccactagtcagtgaaaatgtgtggatttgaatctttgtcttctgacctccagggctgccccctcaaatttctcctgccgctcttcagcctgagaggcacgcccgtcctttggagtggaactcacctctttccattgacttgacccagacagactcctcctgtctgcatttccacagcattcacattccttctgggtctttttttttttttgagatggagtctcgctctgtcacccaggctggagtgcagtggcacaatctctgctcactgcaagctctgcctcccaggttcatgccattctcctgcctcagcctcccgagtagctgggactacaggcgcccgccaccatgcccggctaattttttccttctgggtcttaagacctcctcacactgatacttgttgccttacaagtagacctgcctccaaaagttaacccgttggctatgtggaaattgaagtgcagcctttcatggaaatgggggtgtttattatctcttgccgacgtactgaatgctttctagagctgaaatatttttgccaacagatagaattgcaaaggactgttttgccatttctagtggatgtagatgtttagggcaaatggtgttaatccaaggagtaacagtgtacttttgggtcaatagtctgtttttttttgttgtttttttagatggagtcttgctctgtcacccaggctggagtgcagtggtgcgatcttggctcactgtaacctccgcctcccaggttcaagcgattcttctctcagcctcctgagtagctgggattacaggcatgtgtcaccatgcctggctgatttttgtattttttagtagagatggggtttcaccatgttgtccgggctggtcacaaactcctgagctcaagtgatctgcctgccttggtcccccaaagttctgggattataggtgtgagccaccgcaccctgcctgcaatcatatttttggtattctcatgttataattctcttatagttgatatagagtgattgaatattgcttttttaaaaaaatattttcaacttttattttggattcaggagatatatgtgcaggtttgttgcatggatatattgcgttatgttgaggtttggggtatggatgatcccgcaatccaggtagtgagcatagtacccagtaggtagttcttcagcgcatgtccttttcccttcctccctcttctagtagtgttcagtgtctattgttcccatctttatgtccaggtgtacttaaaacattgtttacttttaggttctgccttcgtacatttatatggtcatttactgaataacaatattttggtcaatattgcattgcatataggatgatggtcccataagattataatcccatattcttattgtactttttctttggttagatacgtttagatatacaaatacttaccattgtgtttcagttgcatagggcattcagtacagtgacatcttgtacaggtttgtatcctaggagcaaataggctgtaacataatagcttaggtgtgtaatagggtatacctccaggtttatgtaatatactctatgatgttcacacaacaatgaaatcacctaaccagaatgtatccctgttgttaagtgacatgactgtatcataaagtagaaaaatggagtagaacaactggaagagatctttcagtgtaaaaatagagttagaagatattcagaagaaattcacactctgctaatatgtaactttgtagtgtcagagtgatgtcatagaattgaggaaatgctcattgatatttaagtgaatgttagaaaatgtactttttcttctaatttctcatagaacaaggatctatgaatctgccgaaagtatatccagaacgaaacaactctgtgcatgtttttatggagaaagttcatttgtagctttattagattaacaaagtgttctataagcagcacttcacacagttcacaccatgtggcacatagcgggcacatggtgtgaacaaaagaataaatataaagaaaacacgtgatgagcccagccttataagctggtgcaaagttgtctactcagaaataatagttaaaaagtatagttgacccttgaacaacttgtgtttgaactgcttgggtgtacatatgcatggatctttttcagtaagtatattggaaaaatttttggagatttggcatgttaaaaattttagatgaactatgtagcgagataaggaaaaaaatttaaaaatatatgtcatgaatgtgtaaaatatatatatagataccctgtcatttacaaccataaaatatacaaaaatctgttacaagaagttaaaatttatcaaaacgtccatatacacagagcatacgtggtgccattcacagttgagagaaatgtaagtaaccataaagatgcaatattaaatcgcaactgcataaaattaactgtagcacagactgcactactatagtaatatcatagccccctcctgttgttacttgcagtgagctcgagtgttgtgcgtgtctgcttaaagtgcagtgtgatgctcatcatctccttgtgagcaatttgtcttcccaggaaattgcatatcacaataaaaagtaattgctcttggttctcatgcatttttcatcatgtttaatatgaaactgtaaaccttgaataacgccaagggacccatgtgaagtgccactagtgatgctggaaatgctcccaaaaaaggagagaaaagtcatgacattagaacaaagagttgatatgtaccatagattgaagtctgcagctactgcagttgcccaccatgtcaagataaatgaatccagtgtagggaccattataaaaaacaagaaaggaaattcctgaagccgttgctgcaggtatgccagcaggcacaaaaaccttgtacttttgtgaaataccttttcatctcatattgaaaatgcggcttttatgtggatgcaggatggttaaaggaaaagcacctattgactaatatgatttgagaaaaagtaatgtcattacatggcaagttaaagcaacaagaagctgaaggatttaaagctggagaatttaatgccagcaaaggatggtttgataattttttaaagaggcttggcttaaaaaaatgttcagctaacagaagtattaataacttctgccaaccaagaggcagcagacgagtttccagatgcacaatcattgaggagaaagagtgtctgcctaaacacggttttaatgcagacgaaagtgctggaaaaaatgccagcaaaagatatttattagtaaggaaaaggatcaagcactaggatttaagtccagaagagataggctaactcaattgtattgagcagaggcagtcaggactgccctcatctacaaagctgctaacccctgagccttgaaaggaaaagataaacaccagctgccaatcttttgattgcacaacataaaggcctggacactgggaacacttttccagattgttctattgatactttgtccctgaagacaggaagtaccttgccagtaagggactgtcgccttttaaagttcttttgatattgaccaacgcccctggctacccagagccccaggagttcaaggcgttgaagtagtctagttgcctcaaacacaatggctctaatttagacctgtaaggctcattacacacagtaccctttggaaaggatggtcgttactatggaagggaccactgatagaacattattatgaaagtctggaagaattaccaatgaaggtgccttccttgtgatagaaatatcgtgaaagccagtaaatcccaaataacaaattcttgctggagacaactgggtccagatattgtgaatgacttcacaaaattgacaacaaagccagttaaggaaatcattaaagagattgtggatatggccaaaaaagtgggggatgaaggacttcaagatatcagtctcagagaaattcaggagctcatagataccacagcttaggaattaatagaaaataacttgatggagatgagtatttccgaaccagtgcctgatcatgaggaagaagacagagacgaagcagtgccagaaaaccaaaattacaccatctgacagaagggttctgattattcaagactatttttgacttcttttataatatggacccttctgtgatatgtgtactgtaattaaatcgaacagtggaagaagggttggtattgtatggaaatatttttagagaaaaaaaacagaaaaagtcagacattgtgatgtatttctgtaaagtgacacagtggtgcctgtctctcctgcctccctttccaccttctccacttcttctgcctctgccacccctgagacagcaagaccaacccctcctcttcttcctcatgaagatgatgacgatgaagacctttatgatggtccacttccacttaatgattattaaatatattttctgccaggcatggtggcttaggcctataatcccagcactttgggaggctgaggcaggaggatcacttgaggtcaggagtttgagaccagcctggtcaacactgtgaaactccgtctctactaaaaatacaaaaattagccgggcttggtggtgcacacctgtaatcccagcttcacaggaggctgaggcaggggaattggcttgaacctgggaggtggaggttgcagtgagccaagattgcaccactgcactccagcctgggtgacagaacaagactccatctcaaaaaaaaaagtaaagtaaaaaatatattctttgccttatgattttcttaataatattttcatttctctaggtttactttattataagaattcagtgtggaatacatataacacacaaaataggtgttaactgtttcatgatagtggctaggcttccagtcaacagtaggctttggtagttaagtttttggtgagtcaaaagttatactcagatttcgactgtgtggggggtttgcatccctgcattgttctagggtcacctgtttaatagcactggggtgataatgcacatgtgtccttgttagagaaagagctcatgggcctccttgtggtgttgagtactgctgatccagctattccatgctacttttctttccctagttttgtgaaaccctgtttccttgattttatttatattctttagtcagttctcaaaatcctttgaaagtggtttggaggaagggaagaggaacctgcaatctcagcagttacccaggtttgagttctgatttccatgggtgatccgcattcagattggatgaaacctgtggcttcaattgtacctaagtgtggacggcacccaattacaagtagttagcctcgaactcttttttgtaccatggactcccatctccagttgtgtcccaggaactggctgagagcatgtgatagttttccctgtaactgaatgcatcatcttttgtttttgtttgtccttgtgcctgtcctctgcccaaccacccaaatgacaaacctagacacctaaaatctgtcattttccttcataatggcacccatccaccacataccaagtccttttaaataagtctccattctgcatttgaataattatacatcctgattgtcttttcaccacctttccattagccttggccctcatgacttcttcattattagactaatgagctacgagtgtttaccctcctagtccttctccataccccttgaaacctcgtgcagaataaatgcaagttaaactgctgtgtgttaatgacaccccgcagttttcaggataaagtctatatggcttaacttagttgtctttcatcttcccctcttgattacctcagtctcttgaaactttctcaaatattagtaacatttcttaaaaacttgctacttacaggaaacatcctaagcaatttgtcataatcaaatgaaatttatggggaaaaaacaaaacaaaacaaaacaaaacaaaacctatcactactgagcccagaggagtgaagaagttacctagggccacgcagctggtgagttgtttgaggctgactcatcttgagagctcattcatgattagcaaccttgtggtggtagaatgagtggaattcctggcaaaccgcaggataaagtgtctccatctccattattctgggtcacttgtgtggacgttgtcttgggaagcaaatgaaggcaagtagagggtttggctttccttagaatagattttctttaaaacttaaaatttttaaactctttgtgcttgactaagtccattagatggcactagtatttaccttccagaagattggcattaaatttcagtattaaagcaatttgtggattgggggaaatatttaacttgcaagttatttcttttacctgtcaaatatgggagtgaaaagatgggcacacaatatttattctgtgttcagttttttaaaaacattgctaaacaggttatactaatgaagagttgataaaaagaattttattatttagttactttttgaataaacctgccagttgattaaaatgagcctaatttaatcagtattgtattgcatactgaagataatttaggctaatgtcaaggacaccgttatctctcctttgtagaaggtgttgaaataatgagagtagcaaaaaaggagtcagaaaatgaagtttttcatctttgcccctgggtgggtatttaaaaatcacacccttccttcttgcatgcaaattaaactgaaagtcattttgtactgtaatattaaccttacattttacaaaataaatttattgaactttgatcttttgctaatattggtttgtggttgtcagaatgaatttgaggttttcattgtgtgtcattttcacctggactttcattcagaacttgaagtgaacagaagtggtgggtttgatatatcttaatttgaaaataaatcactgttaagcagcaactcctagttctactttcttctttttttctgaatcacttttttcttctctatctaccctccccactccagcccatgtcttaatagaatcatctgaattcctttcttcctttaaagtagttaaacggccctcagtttttcttgtgatgcttttagatggaagctaagtcattgctgaggttcttgttcaaattgtgaagtcagcaggtaaagggattatgaactcccaagtgagtcccctatacaaagggcaggttgccttggaaacaaggctagttcttagagttggaaataccatcttgtctttaaatgccagggctggtgatgtgctgacccctgctgcatcatctctagacctaacattgtgtggagaagttttccatgactttgtgcaaattgcttaactgcttcccagttctgattgattggccaaagccacagccaagttttcttttctagtgcttctcattttaaatataatttgcaaaatttaggactaaggaagtgatccttcaagtttctattttagaatgaaaagttttccactactgattgccaaaaaataaagtatagagtttaccagatggcaagacattttagtgatgagtcattttttacaagttcaacaatggaatgagtgatgcgttaaggaagcccaacgagggaatgtctcggttctgtgagatggtattacttgatggtagagacggaattacccttgtttctgacgacactggatatgaactgtagcagggagctcaacggtacaagttggtaggaggaggcagttgtagcttaagtgggactcctactttccctgcatctaaacattcgtaacttgctggtggcacagcaggaggagggtttgagggtggtgtgtgggtatggagacaagggctccccacccgtggaaccaagccctggtttactatatccagctagctgaagaggtaaaaagactagaaagaaagggccttcctaactaaagatctcagctctgaaagactagaaaggaagggccttcccactaaggatctcagctctgtttttgtggactcaccagtggatgcagacattcagaggagcaggagagcagggcatgctcctgcctggtcgtgactgtcctgctatgtttctgggttgtgcattcacattggcagcttttcatgccctgggactattacagcgtagggactgggggagatttcaggatgtgacttatgcctgggagtgaagggagtggtgtttagtggagattaggaagaagatggaaagtatttcacccccagttgcttgctcactaacgtttaacattgtgattggtgctgtgggttttggtggtggttgtcttttaattacagtttagagaggctgtgtgtgtgtctgtgtatgagagaaagagagattttggtttatctcgttaagacctatctatttcctacatggtgttggattttttttttttttttttttttttttgatacggagtctctctctgccaccaggctgaagtgcagtggtgcgatcttggctcaccgcaacctccatctcccacgttcaagcgattccccttgcctcagcctcccgagtagctgagactgcaggtgtgtgccaccacgcccagctaatttttgtatttttagtagagacgaggtttcaccatgttggccaggatggtctccatctcttgacctcatgatctacctacctctacctcccaaagtgctggaattacaggcatgacccaccatgcctggtggacttttgattaataaaaatattttggccgggcacagaggctcacgcctcttagaaaaaaaaaatcttttttttttcttttaagcaaaatccctactgcagactgtgttgttaatttaaagagttactattgagggattctcttatttatcatttgttaatgcaggcatttctggatacacgtaaacatatgaattgtcaagctaaattgttcacagattagaacactatgctgttgacccctgtttccacgttactccctcttagatatgttggaaggttggcagagtggcaaggctggaacatatacccataggtgaggtactgctctaatatcacaaaccatggggctagagcctgagacgggtttgaggtcaagtttcctggtactgtgtacgagaaagtctatccacactttgccattcttggcttagccagtaggaacattcgctagtctttaatgtgctcatggtattttagtgttcttttctaagttttaggtcttttttatcagacagtatatacccttcttaatatgctgatgaagcgtggaattaatctcacatgcataacatttaaagttttccagtggcaagcttaagattcttgttctgtagcgagtttttattggtatagtttgtattactatgattacaaaacatcattggttcaaatatatccttttgcttactcgtccagttaaacactagctctatttaaatgagtttttaatgaaccatgctagcaagtaaggctcagagaatgattaaggatttagtattgtctctgtgtcattaaagtaaattcagtcatcagaaagcttacaaattgatttttagttccctttttgttgtgtctacgtaataattagttactacatcatcgcatttgcttctgagattattcatcttgcccatttgccagtcttaccatgttctctttgagggaacactgcatgtgttcatgataaaatcacaactcgtgccacttcctccagtttggagtcaacctatctgtatgtgattagcccatttctgaattattttgttctgtcttactgtgctatcctactttttattaatacttaagcagtagtgttatgtagttgtaacctcatgggtggataccagtgtaacagtggcactcatgatagagagtagagcaagaggggtttatattatatttggcaggtgggtcagttagctgatggctatacgaatttgcatattttcattgtggtttgtggttgacatactcaaggctattagttgaacataagtcttaaactgggaatctaattagtctgaaggctcagtgggtgatagactatgtcaccctgagggacaacagaattaaatttcagctctgaaatgtaagcatcagggctagggagtatcataggtgaatatctttcactgtggtttccagatgcagtggaatatctctattaggcatgagtgttcaagaaatactttcttcttaaaggatggcattagctcttgtcggacaggtctccctttggcaattgacagatagaagcttatgatgatggtggtctcctgtgttgttcaggaagcagcgggaatgttctgccctctcctgcatgatattttgctggaaatggctttattaaagattgatctcatttagctccctttcttatgttggataatacactgtgataatctacaaaagcatgttagtgtttggttagtttttcttttatgtaagtgccacaggttatcacgtgtgctttatgggagacaagtgtaaatgaaatcttaaaaaaaaataagagatagaaaaaggggaattcagaaactcaaatacttgatctaatttataatttttttggacatccttgagtgaaagggcagaagaatttaaatgtattggtaggtatgatcctaattatagaaatctataatttataaactatggagacgaaaagtgatttttgaattagtgatagtttagaattatacatcatggaacagcctgacttcaaacttaaaaaatgcatgtatctccaactcctttagttttattgttaagtttttgaaatttatttcattatgctctagttctcccatatctgttgaattttctttctattctcttctgttacattcttctttataggcacatctgcccatgacatctccctgtcatctctcaaacacgcactttctgtgttgtgcttcttgttgactaagccgctggatctggcttgactcatggaggctgctcatgtttcttagatgaagagagggtcatggaggcatcttcaagtttattcttgtttctagtattctccaacatgttttgtactttatccagggccaaaatatgatgcctttttaaaagaattataagtctttatttcataggaaaacaattgcatatattgacattgagtgtccaatgacacccatcataattgactttccctggatatgtctagcttatacatgaagaaagcaatggaaagtgagagattgctcacagggtgtcacattaaaatggcttctcagggtgtgtggagtttgaacctagaggtctttgagatttcacttagacttggcttaaatcagctttcattttcctgtatgagggtagaatctgcaagttctttgatccttttaagccctctgtttaagactgagtgatggcaccagcaggatgaattgtctgtgatgatcttcattaccctcagatatgttcagaaaaattttaagtggtgtcatcaaaattgcattaatttggtaaaggcaggttattacgtttgattaatcaaaaacgaacagaatcctattcagaggtctgcagataatcttagtttgtagcctgccagtgccctgtgctgtggatatgttagatgctccagagcaggaagatttggagaaaataggatctttgacttgatttcccatctcaaatttattctgtatttatttatatgctagtcagattcatctctctgaggctcggctttgcttcctgttaagtgaaataataaaaacgactttgtgtttctgtggggccctctagaggaggatgtagagcgtctgtggaaggtcttcattttgtgccatatctatgttgaacatgcattttctagcatgctgtcttctttccgtgttctttttcccattactattcctgtgtagatccaagacacagcgattgagctttgcatctgtcttctttactcttgaaactattctcatatttacaaaagtagaacgtatttatcatccatcacaatataatttaataaaagctcatagtaaacatacttattgtgttctggaagttgtataccttatctctttatttgtcctacatctggcagagcaggcataagtggctgaaaacaatgcaaattcattacctggcaattctgcttggtagaaggctgacatgggtcagaatgccataaaatcagtgtgttaaccgtgctcctttctcgaggctctaggggagaatctatatccttgccttctaaatgctgctcactttccttggctcatgactccctttgtttgtcttcaaggtgggcagtgtagtatttctctggccatcatcacgtttctctctggccgcagccaggcgtggctctccatttttccagacttatgtaattagatggggctctacctggataatgaaggataatctttccattttaaggttcttaacctccatcctgtctgcaaagtccctttttcatagaaggtaacattcactggttccaggagtttggacatggataactttggggagaccattattctgtctacccacaaccaccatcctcttttccaaatgaggagagtaaggtctggaggtgttagagaggccactggatttaccaacagctacccaaaaaataaggtcagagctggctttgaatgtagctttttctgattctccattgctgttagccactttgctacatgcagttgtgggctttcaggtcttaattttacctattaaagggacttccctagatccaagggttttataagcatttctgtgtgatgtttctataagaggttttctgttggggggttctgatgtttcatagttaaagtgacttgtcctgaggtaggggaaagtgggtgacaatgtttagagtttatttctacttgggctattgtaggtgttatccaaattctgcctgtcttttctcatggagacttgatagatgaatggaacagaagagagattaataattattgcaaggaaaaaaatgaacattcaaaatgatctactttgtggacagcagtgaagattccatctgttaaattagaatttgagtaacatttcacaaatttaaaagacttttcctttactttttgaagggcatgatggagatttttaatacgcagttttttgtgaaggttccccccacctttttttttttttttttttgctgtgttactatatgcattcttatagagtagattttctaaaattatatatctttcccagtttaacacaaaattatttcatattgggacctggcacttaaattttggtttaaaagaaagctgtgcaattgtatgttattggcatattgcaaatcaccaactgtggttctataatgttttctaaaaatgctggagataattattgaaactaatatatatgtataagctcttccatcatgtggcatttaaagacttattctttgtaattttcaatctccattttcagtttgcagaaaggactcgattcttgagagaacacatcattgtgaaaagttaataacaaaacatgaatttcatttgcttccaattaagcaccaaaatgtcaaaacttaatatcttcaaaatgcatattaagccacacaccttatgaaaagtatgatgatattaaaatcaagtatagcaatccaaaatcttcatgcagagcttgaaatgagtattttagttttttgaggctacaaaggtaccttgacttttagttttattgctcaaactgaaactaaaattgcatgttactagaaagatgggctgggttgtcaaactagggaccatgggccaaatttggcctgtttattttataaataaagttttattcaaatgtagtcacagtcatttgtttttgtattgtctatgggtgctctttcatactataattagtgagtagagtagttatgaaagagacggtatgggccacagctccaaaaatatttactgtcttattcttttcgagaaagtttgcccattgacccctaatctagtggaatgtctgtgtctctaatacaggcagacacttgcaagtcactgtcagataaactgattttactatatatggatgttttggtgtatacgtatgcatacctttcccttttttttgtaactattaaggacttcttttctgatttatgttgttcattataaggttgagtggcccaattattcatcctactgtgatttcttcataccaattaccgtggtatggtatgaaccctggtactggttcttccagattgtttaatcagctgattctatctatacgtcagcaggtttctgagcttcctgtctctttgtgactgtacaatggttttctttgttgtgtcgatgataaatggattgatgatatataaatgttcatggaaatagcatttgttccaaacgacaaagccatttataaaatgaggactgtaattatgagtcctactcatattctgtacattcgcgtttctgtttttgacctgagacaagtgttggccttgaaaaagcttggattggaggcaggagaggggtttattttggttccagtcatggttcttttcttggaaggctaagctgagttgctaggtgtgggattgaagggtgaagctccaaggtggcagccagtgtggatccttagaagttttttactctttgggatttattttctatttttatgttatgttatgttatgttatgttatgttatgttatgttatgttatgttatgttatgttatttattttgagatggagtctcgctctgtttcccaggctggagtgcagtggcaggatcttggctcactgcaccctccgccttctgggttcaagcagttctcctgcctcagtctcccgagtagctgggattacagaagcgtgccaccacacctggctaattttttatgtttttggtagagatgggtttcatcatgttggccaggctggtcttgaactcctgaactcaaatgatccgcccgcctaggcctcccaaagtgctgggattacaggcgtgagccaccgcgcctggcctacgctttgggatttataagaagtatattagcattttaagaactgtattagttataagaagacatagagtacttttttatttttatagctttttaaaaatattataacatttaaaatttttaatttgaaataattttatacttcagaaaacttggaataatagttacagagtatttccatatacacttcatctatccctaatgttaacattttacataatcatagaacaattatcaaaagaaagaaactcacactgagtcagtactgtcaactaatcagatctcattagaattctgcctattttttcactaatgccctttttctatcctcccactccatgtagttctcattcttcctcagactcctccaatttgcacaatttcctcgttctccttgttctttcttttactttcatgacccttgatacttttggagagccttatttatgtttcagaatatccctcaatttgggtttgtctgatgtttcctcacgattagatggacgttatacatttttggcaagaataccacaaaagtaatgttatatacttcccagtgcattttatcagatggtacttgatattgctgcatcttactatgaatgacgttaacctgggtacagcagtggctgccaagtttctccacttcaacaatattactgttttgctttttagtcaaaatgactcttctggggagacattttgagctatgcaaatatcctgttattatcatattcacacccattaatgttagtatccattagtagattttacctgaacgatttttatggtggaggttgcctaatgatgatttctgttgccatcattccttctatttattatttggaatgctacagcagggaacagctgtttattctctaccatttatttgttcaattatttatatcattatggactcatggattttagtttattctttggataatgatccaatgccagtatgatttctttagtttgtaagttgtctccgctttgtccattgggagccccttcaggttgacacctgcttccatttgatgtgccttcatcatttttgagtacccctttttgacatcacaaggcattccaggcttaccatgtgtttccctgaccacagccctgaaatcaaccatttttcaaggagcccttgttcattaactggagaatggtattagaaaccacgatctgggtactaggcatgctcagtggcactggggatgccattgtttctaggatctctgtgtggacagagctgggaactctttatactcacacattcattaacatttattgatatacttacccatttgtcggtgtatttacttaactatgtacttataaaaactgtgagtttggccgggagcagtggctcacgcctgtaatcccagcactttgggaggctgaggcgggcagaacagttgaggtcagaagtttgagactggcctggccaatatgatgaaaccctgtctctaccaaaaatacaaaaattatctgggtgtggtggcatacgcctgtaatccccgctacttgggaggctgaggcaggagaatcacttgaacccaggaagtggaggttgcagtgagccgaaatcgtgccattgcattccagcctgggcgtctcagtgagtctccatctcaaaacaaaacaaaacaaacaaacaaacaaaaactgagctcatactgatgtcctggattccattctgagcaccagtttattctagctttttcttctctgtaacttctgtttctgactgtgaaaacatctgcttttattatcaaacatatttgcactcttttgttcattcttggtgtgtgtgtgtttgtgtgtgtgtggggggcgtgtagtagagtaagaattgctaaagagaaacaaatttactaactggaatatttgtatgacaggtttgtctttagcatgtatcttatgcacaaatgagaagatacatgtttagtttttaatatcccctttttatgtgaatagtagttcataccatgtgtgtatacacacacacagatatatatgtatactcatatatatacacacttttgcatttttcttttccatttaaatatcctatatttttaagaagatttatatctgtccctgacttagcatgctgtgatagcaaacaattttattattttttcacccatagacttttgaatgtgaaatgtacgacttagaattatacaagtaaagcatcaaaatttagggaaacactgtttctttgaggtttttcttcgtaaaacttaccattctagggtcatttatatcagtatttttgcactgtagaattatgtcaaaatagtacaaaattttggtagttaattaagtgcctttatttataagtgcacatttacctttcatttctagctggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaagtaagtgaaagctctttcttctcttccatttcatcttaatttacaggaataccaacttttgttattcatccatgaccctgtaaatggaattaattatctgttttattcaaaaattaagtttaggacccaggcaaatgttctttgcaagagaagtaggcagttctttacattgtaatagattaggctttctttactttcgactagtagactttccgtgactcgctaactgtaaataaggacaatagttcaagttaaattatttggattttcctttccatatgtttatctgaatgctagaacaagtagaaatgaccaaagagctttgcactgaaacaaaacgtagcatcattcattacagtcaactctgttacaaccgtcatttatattatttgaactttatctgaagagctggggaagaagagaccgccgtgtcaaagttatcttcagggatttgggagagcagtgattagaatacctccttagggaaggggaatatggacatagtgagtcctatatgaggaatcctaggaccctgggtattccagatctgggatacttgcctgaagagttctgttagccattcttggaaggtactcataaaagtcaggtatttttgctacaaatatttagtgtttatagttgtataatcttgtaattgagcagttgttaagagaagatcaatttcaataaatgtgtaaggttaaaagattttttggctgggcggggtggcttatgcctataatcccagcactttgggaggctgaggtgggcggatcacctgaggtcaggagtttgagatcagcctggccgacatggtgaaaccccatctctactaaaaatacaaaaattagccaggcgtggtggcggttgcctgtaatcccagctacttgggaggctgaaacaggagaattgcttgaacgattggaggttggagatggaggttgcagtgaaccgagattgtgccactgcactccagcctgggcaacagagtgagagaaaaaaaaaaggattatttattttttaggtacatctatttggaaacacttcagtttttttcaggtagaaaatttgggtcttacgtgtctttactgattggtagtcttcagtagatatttataaacagatgggtaataatatgtgttaataaaatatatatataattaagatacagaatataggtagataatatttagaatatataatttattcttctaaaaatgcatcctaattccctttttttgcattgatagcaatctgtagtaatttggcaatttgcttctagatgtttacaaactacttctgcttctcttgtcccttgaaggtgtatataaagagaacaaggaaagaagagcagtttaacagttagagatctgttagcccatcagaacccacaggacaatgcgccatacagagtgtagagaatttagaaggtgtagttcaagatgggatacgtaagtgatgctctagaggattgcgtgcagctacagaccagtgctaaccacttcctacaattgctttctatcatccagacaagatcggactcagatacaatgacagatgtttccaaggatacttggggtggaacagaacctataagttgttttagttgaatattttttatatgcaagagatttagctttatttatgcacatatgcaagaaactaattttgtgaaaataattttgttgactactaggatatactgtttaaaaattcttacattagatttgctttgggcagtgtttttcaaaaggtgaggcatgtaccatacagcgtatacaaaatgatgtgcaggtggtacactagttaccctggttgattttttattagttcattaagcctacgacttagtggatatctgcttggaatgatcctgtgtatacaatgtagactgcctaaatttgactcatggaaaatttaaatagtagttcaggtattcagataccagaagtttggaaaatagtgtctttatttgagtaataacactgtaatgtgtatacttaaatacagaactttctgttgtgttaccgttgtagtgttgtacttgtatcttttctaaagcaatttgtagctttaatatagccacaccataaaaaatattagaagaaaggttaatttctttatgttgatttatgaatttgattaacatactttccgtcaatttttaccttttgactcctctggactcaacaaaatttctaacacataaccatccacatttgactggccttatgtgttaaaatttaaatggtgttttaaaccccaaatatctctttttatcttgtttttattgagaaaaagaagttacatttgaagcatatgtgttgtcttgcagccaccagtgggagaatatgcaaatcttattttcttgttctcattttggtatgctaaggtttagattttcagatcttggcaggcattgggttaagcatctactatacacaggtccataactatgtgaacgtaatgcatcacacatgagtcacctgtcaaggtgatttttgccaccgcattaatgacgttcattcagacatagaagatgaatttgtccatactggccatgccttgtgctaggtggtgagtcctgggttgagttaataaggcctggcgcttgctatcaaggagctatagttagtagtaaatggtagtctaactatttacagatatgaaaagaaagaagccaacaatatgtagagatttgcttaattgaagataaataaatttctaatttttgccttaaagaaggagtggtcactttcctgtgttttccaatgaatgaattcactcatcccctttattccataaagaattggtggaagttgagaaaaatatatagagtatgtatttttttccatagaaaaatggatacgaagtttgggtattaagataaagcctagatggttttcatagatggaattctcatcttgaggtctttttatgtttccctagaagctgccattaatttagccctgagcttttttttgtagaaaatacagagagaactctgatttagttaatcattgctcctcaacctcagaagtgttttctccccaaggaacatttatcagtgtctgatgatatttttggttgtgacaactggtggagttgggcattgagtagaggtcaaggacactggtacataccttacaagcacaggacaatccgacatcagagaactctgcagcccagatgtcagtagtgccacggttagaaaccctgaattaaatacatcattgtttgtatagtcaaaatagcagttaacttaaaacttgagaaacattttgttgattccagtatattgaacagtatcctgaataacactcttaaactagaagacaaacatgtgattactagttaataaaaatgtaagaaatgagaaagttaagtaagataatccaggctgggtgcggtggctcacacctgtaatcccagcactttggaaggccaaggtgggcgaatcatgatgtcaggagttcgagaccagcctggccaacatggtgaaaccctgtctctaccaaaaatacaaaaaaattacctgggcgtggtggcacacgcctgtagtcccagctactcggaaggctgaggcatggagaatctcttgaacccgggaggtggaggttgcagtgagccgagatcatgcccttgcactccagcctgggcggcagaatgagactctggctccaaacaaaccaactaaccaacctatggagaagggagagaataggatggaggaagtaaaatagaaactagatgcatactatttccttctgtatatttgaggttggaactatattatcttttacacaattataaaatgatcaatttttaatttttacagtaaacatttcaaatgaatattaatattcatacacttaataaattttaattttaaagacaaaaaatgagtatgaaatatctgaccataaatatatttttttggtagcctaaacataacaagagtaactatttcaattaactttaaatcaaaggaatttgtacaaagggagatgtatcctaaggaaaaaaagaactgcctaatgacaaggacccggaaactgtttgtcgttggtattgttaatcttagatttttgggtgggtattacaggatgaaagagatgggaaattataatattctaattttgtcattcctggtgtcattgagtacccagtattcttagtatagaagaaaaagtgtacagatataagttaaaggagaatgaacaaaaaatggatagtcctcagtttagacatgtcatagttaattcctgatatgttttagtttttaaaaaaggaacgtggagggaagaaaaactcctgtgtatattcacagaaaaggtctagaatcaatgaccaacccagtaactcagcatttctcaatccagactatgctctggaaatagcatttttcatttgaggggatcagagcttcttagagaaatgcctgaatgcaagcctgtacaggaaatgtatgggatcatcctggatcatcctgtcatatcagaaaatagggcagttatgaaagattactagggtgggccagagggcctaggagacaacacgatgctcctgctggccaaagacgggacagtgggagcatcaatacagatagcaacagcaatacatgcatgagtgtataatgataataaagaagccagcaagcaaggagaaggctaccagtgagccatcttattatttggaaaccttataaaggaaagcaggaataagtcatctattctgcgtttccttgtagtgtggtttcacgggatatccaaatacttgctttttatgtaagtatttcagctaataaatgaagacataatggtagcattggaatattactattctgcaacttctgatgacataatggatctaggtactgatcattgctaggctcttaatgtgtccccccaaatttacatgttggaaatgtaatccctagtacaacagtgttgggaggtgtggcctaatgggaggtgttcaggtcataaagttgcttattatttggaaaactgttcaaagaaagataaaattaacagcccgggctggtaatttataaaggaccttgtctctattaaaaatcaaaatattaggtgggcatggtggtgtgtgactgcactcgctgtggctcgggaggctgaggcaggaggatttcttgagcctgggagatcaaggttacagtgaactgtgattgtccactgcacaccagactgagtgacagagggagagtctgtcacaaagaaaaaaagaaatctattctgtgtatcctttgtatgagtggtatcactgtataaccaaatagtagatgaagaggaaatcactttgtatatatgtattaaaaattacttcttagtataaaaagaagagtttagcataaaaatagcttagtataaaaagagcttgaagtactggggttactctgtcgctttgtcatgtgaggatgctgcattcattctctttcccttccaccttcctacatgtgaggatgcagtaagaaggtcctctccagatgccagccccttgatcttggacctcttgggctccgggactgtgagagagtacatttctgttctttataaattaccagtgtcaggtactctgttagagcaggacaaaatgaactaagacagtcaccattaaaaaataataatcaaggagagacaaccaaacattgtatgcctcctgatgaaaaaaacacaacatctcctataaggtagtcttgacaaaagaaattaatcatgaatctgatcagacttctaaatccaagtgcctatttacaggaaatacagaaccctgagaagcatgtgaacacgataggggtgcaatcagcctagtcaagatggtgggaaactgtgtaagacaaatggcccacgttcttcaataaaatcaactgcaggggcagaaagagatggagagggaatttataagttattagaaacttttaagagatgtaacatccaatcataatgtctggatcttatttaaatcctgatttaaatgaggcttaatacaaagaatgacatttgtatgctgatgaataaaacacaaattgggcatttaatagtaaggaattatttagatgcaataaggttattgaaattatttttaaaagaacctttaccttttagtagtatgtaatgagttatttatgattaatacaatatctctagaattttcttcagaatagtacaggctaggggatgggttacctaaagattcagtatactattctgtctacttctatatgttggttcaaaattatccttaataaaggtactttaaaaaaaaataaaggaaacacacactcaaggcacttcttagtagtttgaaggtttatttaattacttttctctttgaacttttttcccccactccatatagcaccgaattttaacctaatcttttttaggcttgaatatttttattggtcatcttatttctttgcaacaaacaaagtacattaaaattttaaatatagtactgtgtgattattaatatataatagatcaaaatagcacaaatatacaaatatgtaacgttttgctttttaatgtggaaataagtgaagaccatccaaatgagaacaggtgaaggctatttattcagagcttgctgtagttagggggcagctatcatggcttgcctttgacggaggctcccaggcaggctgaggagtgggaatgcttttgcatggagaaatgggaaggcttgagtgtgctctgattggaaactgctggcatgaggtagctgcaggtgggctacctagaagaggggcatatatggtgtgattgcttagaatttcatatttggctttctctggttgttcctacgttggaaggagagtcagaacttagggagtaaatggagttttgttacatcagtattactcaattcttctaattccctccaagttaaatgctaaacaccaattagtgatcctttgtcagaaattatttttatagatatatcaatgagctgaaaactggcttatgatatccttcttttttgttgaaaggagggatctagaaactagttgagtggcaaaagtgtttgttatccagagggatttatgttctcagccttgtggctgctgtattaaactgtgctttgtcatcctggaagtttttatgcacagttgtacatcaattgtaagattcaggacaggtgatgctttttttttgttgttttgtcattttttcgatgcgtgtgtttgttgtttgttttttaattttgcaaagcagaagagctattcaggacactatcatgactttcctggactctgggcgctttggccatcatgggccgccctcaccatagtaatatcagtcataaaattatattttatttaactttaaatatttcagtattgtactttttccattttatgcatcattgaattgattttcatggttcctaagagtatcattttcttctgatatgagaaaaaagtgaaaacattttctttgactctaaaaatttgtttttctgttttgattttaaaggaaaataaaacactatcctgggcttctaaacttattgtggccctggacactgcctcatggacatactggctttggggctgttgaccatggagaattggatgggaagaaaccacattacaccttgacccccttgttttcaggctcgtagaacctttttagggaatgatgcatattgaacacgaagagcttgacatgggataccttaaaatgtatctctcggaaggtctttgcatgctcccaggtagatgcatgttctgctctgaaggaaactggttactagatattctacataactgttggggtttttttccccacccagattttgataagtttgagtgtatattatactttatgggagtatattctacttatgctttcaacatgagcttgttatgcagatactcctttgtaatatagagtgtttacatttcagaaagagtacaggaaagagagtcacaccatcttggacactgggcaaggttagtaggtaattacactggtcgcctctttgagtacctgcctcaggatggttttgtatagtaatgagataatgttcacagttctaatgcagcctgtgacacaggagaagcactagactaacagatagttgtggaatggtgtgcgcgatcatgtctcctgagtgcagatccacttcctggggatgtgtaaagaggttgagacgttactcagcccaagtaactaggacatgtattctggaatgggacactactggccccttaggtagatggagtggaacttttacagagtcaaattggaaccatgtctgtgatatacatttaactgtctttattttcaatattaacaaatcaggcttagatctgaagctttcagggtcacacagttcaggtgcaaatcattgagtccaaggctggtgatattttgtgtatgactttttcactctatgattttttttttccttcagttcccaaggactttttgtagaagtcagatatttgagggtagcccaggtttaggtcatggctagattccttttacctcacaattcaaatttttaaatatctcctctggaagatctagactgaagaatgaagtttcctttgaaaatgatgtaagcccgaggaatggtgaaatttctggaaatggtgttgctataaaaatttggggaaacaaagtatctgatttatttcatttctttttttgctgccttttaaatcttttgttatttttaactttttattagctatgttaattttagttaatttttatccattacttgggaaatttgtctgaaatgatggtatttaattaactgataagattttactatcttcctaacatttagaccttaaagaaatatcaataattgttatagaaagcttgtacctaagttagtgccccctcccacttcttgatttcttaattttttttcttagcaagcatatacagattgattttgtctttctagaatatccaacacctttggtatagagatctgtccttctaacatttgctggtatcagagtactattttctggatctgatgtaagtacatattgcaaatagaaataatattcctattgtatttccttttaacttgtgaagtggagcatggcatacaaatggtattctcagtatttcaaataattaccttcttactgtgcaagttctattcagcatataaaacccatccagttttgttgtagatgcaatctgattattacatgttgacaaggtcatatatctattaattggattggagatgggatacaaaattgctgtaattattgtaattttctagctaattgcagggttggtggtgaatattttacttctgcaaaatgaaaaacagtattccatcagaagttgttttatggggtttcagacattttgttttatatctttggtgctttttgcccacaaagtatctccttttttgtttttttttttttgtttttttaattgatctgaatgtcacagtgctcattggcagggatcggcaaaatcaggcacaggcagagagctgagtagtactctcagctacctctttgttcccgttgccacgttacctctattgtttatttataaattggagtactcttttttctgacctgtaacaaaggttggaggggtcagagccaattggaagaggatcctctgccctcttgtcccctgcaccccactcagaaatactctcttaagatgagcatttaagaaattaagtttatatggtttatgtgttcttttttgcattaaaaaattaagtaaattattggtcatcttagtatttgtaatacagggcttactttgcatattctcccgtagttttggttagaaaactgggagctgtattggcatttaaaaataatggtgtatatgcaagatgtgtttggagggttgcagatcagggacactgtgctactgtggggtgttggaagctcactgcagaagatggtaaaagcagactgatgtgtattccctgctgaaagataaactggaggcgcaggtgaaaattgccaaacctaatgagcaatttggcggataagacaggctgtcaggcggcggcagtgcagcagcaggagcactgtgaatcaacttgtgtgttccagagaactatatttaaataacaccaataaaatcttctttttcactgatatttgcaatcacaatgaaatttactttatccttcagatttccaattaaatggccattaacatggtgatttttgttgtaaaattattttttaatttgcctgttgacatttttcatccataaaacacgaacaagatatattttccatacctagagacataagtaatattaggttttctaacacattaataacatgtaagtgatcacctcggtggactgaaacatttcatctgtggacttgacagtggagcagacttagataacattatactctcttcagtgtatcatgtcatttatatctgcttgcgttgcccgggaattctttgctcccattgggctcatgaaaattgagacatgtgcatgacttctccccattgaggccatcaatatattgtataggagagacttagaaaagattttcataaatgtgttgggtgcaacagctccttaggaaacttcccagttcaccttcctgatgtttaccatttggaaattgaggcttgatgtaaaataataacatattctgtactcatggcataactgaagcccaggtctccaaattcaggacaagcagaggtattgctgaaaatgtatgagtacttattacccctcaagatctgtggcatttccaaactcctgactttggtggggcccaagcatctttgcagttcctatctgttatgtcatcagtatttcttttttcttttctcttttttttcctttttgatggagtctccctctgttgcccaggctggagtgcagtggtgccatctcggctcaccgcgacttccacctcctgggttcaagtgattctcctgcctcagcctctccagtagctgggattacaggcacctgccacaattcccggctgatttttgtatttttagtagcaatgggctttcatgatgttggctaggctggcctcgaactcctgacctcaagcctgcctcagcttcccaaagtgctgggattataagcgtgagctaccacatgcagcctggcatcagtatttctaagttgtctttaagcagaataaacatttggcccatatatttaattgcatctctgtgatgcctgaaattaaaaatcattacacatatgtaatataatattttacactttataatagtaactggtgcagtccattggccagggaagtattattttttagagatatcctgccccatgtcatcagatgtagacattggcctggcattcatctggaaaggcttgcctgttgggggtccacagggctgcctgtagggtgtccacagagccttgacatgtggcccgttaggatggcgtgagtcacagatttcaccagaatttgcctttgaaattagacccaaaccatgtgctactggaccccctgtgcacaaagctctctgtatcattcaaaacctgatgaaatcttagggaagaacaggtttacacattcattttttcccacacaaaagatttccccactgcccaattcttccctcttcacttccttttacccttgactattatatttgacttgactctgaggtcttgcctggtactgttacctttgcatgagaataagccttatttgcctaattatgttacctgtttatcggaagcagaaatagttacttacacttgaaaatttgtaatgggaatgtagctgtgaatatgttaagaaagcctgtttaaatcaaagcaagaaatcccatttccaaatggtagtaagacgtgtgttacatggagaaaataattgcctgaaagtgtttgttgtatttgccaagattagattgtacactggtcaataaacaagagttctttttttttgtttttatctttcaatccaaccaggtacttgggttcgtttttctgttggtgcatgtcacacagagacccatattgtggattattttgtcagcatgaaagcctggcagatacaattctttcccctcttctcgctgcacttgatatagatctctcctttacttcttgataatacgtttgcttatttatttgttcgttgcttttagtgtcagcagtggctttgtgtcctcagttctgtttgctcctgcctggctcctctacccagctggagaggtgcctcatatctcagaatttctgagtcactcccaatcagtgactcctttctttttcagtgactaagagaaagctgcccacaagccagcaaggtgctgataagtgtgcctctgagattctcacctctaacttttccatggaatggacagctggtagtctctctctgggctacattttaaaggaaaaaaagaagtctaaatcagtttattaattcatggtgttattttgtgtttactcaatttatttatattgattggtaaattagtaatttacaaactattatttgtcaatttattgcctacatatcaacaaatacttttcttttttttttttttttaatcttggggacaagcacattggctcagcctgtaatctcagcactgtgggaggcagacgtgggaggaccacttgaggccaggagttcaagaccagcatgggcaccatagtaagatccagtctctacaaaaagagtaaaaaatacaaatagctgtacctggtggctcacagctactcaggaggccaaggcaagtggctcgtttgaaccaaggagttcgggctgcagtgagctgtgatcataccactgcattgtagcctaggtggcagagtgagaccccatctcttaaaaaaaaaaatctgggggctccagtgtgtatactgcatggcttgtgaatgtggaagtgcagtgagcatggttttgctcaagaatgggttgatgatagcactttcccagagtaaagctcgtttttataaaatcttcatgtctcagaactgatccctgctttaactacttttctcactggcatttgaaagcagttaaccagatatgaaatgaatgattttcataactctataaaaggagcattatgacatcatctactatttctcctttcttgttctcataaatccaaaccatcaacctgtttattcttgtgtactggcacactgtgtattcccagcatagaatgcctttctacctatgttctctctaaaacttgtggaaagttttctgcaccttaaattttctaccctagggattaaacagccgctataagtcactttcccactcctcctcacagaggaaaggatgaatatgtaatagccatcacagcagcctgttgtctatcctgcggtgtgtttctaccatatcacacaaagcctctttttcttgtctttttagtagtactttggtagtaatttttttaaaaagtatgtaatgtctgtatatacaaatacatatatacgtaggcacacacagagctgatatttagtgaggttatatatggaaggattataggaatagcatgtaatttaagaataaattatcttttaaagatagatcccatgtttaagatgagaaaatacagttagatcagttagggatgcctctgcccaaccataatatggaaaaagtgtaagcaaagggcattttagtgaactgctagggtactcaacctatcatcacatttaattaaaatgtcattttgagccatggccgactcattcgttaatttgttatttaaaacagcttgagaagtatttattttaaatacagaatttgtgttaatgaattggaaaagaatattgtattgcttggcagagatgttatagcctaatgatttgtggcttagaacaaggaaaaccagctggtgatcagtttgtctaagtagtacatgagtatctactaatatttgataatagccaattttttttaataaccagaataagggagttgggaatgggaggcagaaacaaggacactgaggcataaaactgcatttaattctgagtatgggtctgtgatccatggttcagttggatcccttatgaggagagggaggaaagccagctgggcagagatatgcatgggcctgtgtctgtgcttctgccagaaaagaagtcaccagctctgccttcctcacttctcccccttgtctaagatctgtccttctcttttcttcaaaagtgggaaattagtttaatcaaagttgttgttttttgtttttgttttttttgagatgggatcctgctatgttgcccatactcaagtaatcctctctctgagcctccccagtagctgggactataggtagtcaccaccacacctagccaagtctaatgtatagtttattttttccaattttggaaagcagggtatatgtagttctgagtgtctgtgtgtgtgtgtctatatatcgctacacacacaattagtactagtctattcttgctataacaaatcatcatcatgttagggcttaagagtttattacagtcctgcatgtcagagtctggtgtggatctcactgggctgaaatccagggttggcagtgctgccttcctgcgggaggctctaggtgagaatctgttttcttgccttctccagattctggagtccacttgccttccttcgtgtatggcccttcctccatctctagcattatcaaccttgtaccttgtggacccttcttctatggttacatctctctctgactcttccgttctgaccttctcttccacgtttaagactcatgtgactacatagtcttgaattgagtgagactcaggatcatccaaatgagcccactgtctaagtccattcaggctgcttcaacagaataccttagactgggtggctgataaacaaccaaacctcatttctcatgtcctacaggctgcgagtgcaagatcaaggtgccagcagttttggtgtctagtgaaggcttgccttctcatagatctttacttctcaatatgtctttacatggtgggaggagcaaacaagctctattgggtcattttaataagggcactaatccaagtcatgaggacacagcttcccacaaggccccacatcctataccatcaccttggggattaggatttccactcttgagttttggtagacacaacattcattccataccactagggtaatgtcctgatgccaaggtctttaccttaatcacatgtatgatgtaaggtaacatggcaggttctagggattaagatgtagacatctttttttttttggcggggaggagggtgggagggcattattttgcctaccacattttacatgcatttaaatatttacggtagtgtgaaaataacgcactttacaaatacatcgtcttccatgataatatgaaatgagcatctgacctagtgatattaatgggctgatcattttgatttcagtattttgggaaggaaagtaatgaacagtaatgatctagtgagtgtattcacccattcttacattgctataaagaaatacctgggactggggtaactttcattggctcactgttctgcaggctttctaggaagcatgccattggcatctgcttggcatctagggaagcctctggaagcttataatcatggtgaaagttgaagggggaggaggcacgtcacatgacgaaagcaggagcaagtcgggcagaggggggtgccacacacacacttttaaatgatcagatatcctgagaactcattgtcatgaagacagcaccaaaccatgaaggaatcgtccccaggattcagacacctcccaccaggccccacctccagcattggggattacagttcaacatgaaatttgggcagggggcaagtatccaagccatatcagtgagtatttctttgagaccattttttatttaggtgagccatatggggcaatatttgtacaaataaaactctagccattatataattgtggttgcttgataaaaaacaaaaatctgtggtaacaaattagttatttttaactcttttgcacaattaaaagtaatatagtaattttttagtgctgtagatgggaaattttgatgagaaaaattatgtacaggttgtgaatattgtgcatgttaggaagtttcattctttcactggtactctctcttgttcaagctctcctctttccttctgtatgacttattttacttttaggcattaaattattgttacacaagttacgttactgtattcattttatgttattataatttatgttattttatgtaacttttgttattggaacataacagactggagtgcagtggtgtgatcttggctcactgcagcctccatgccctgggttcaagctgttctcccacctcagcctcctgagtaagctaggattacaggcatgagccaccacacccagctaatttttgtatttttgtagagatgaggtttcaccatgttggccaggctggtctcaaactcctgaccccaggtgatctgcctgccttgacctcccaaagtgctgggattacaggtgtgagccaccgtgcctggcctattttagacaattttaataattctgttttggacagaaactttaaaaatggtggaagattggttctaatgagtcttcatgagcacattgacctaaaggccatttttgttttacaacttactttcttctttcgattttgaaaaagtgcattcttgggcatttactaatcttttagataattaaaattttcttaagcatagcacccttttctagttttatgtgtgtcctacattctgctttattttgtagcttcttccagacctctgtagcacataaggttttataaagtcagaatcacatcttcatcatccctgtgtgtgtgtagcacgggtttgatgctttgcattcagcaagtatgtagtcagccctctgtgcctgtgtgttctacatccatggcttcagccaacatggattgaaaatgtttgaaaaaaattgcatctgtactgaacatgtacagactttttttcttgtggatgttccctaaatgatacagtataacaactatttacatagcagttacattgtattaggtattataaataacgtagagatgatttaatgtgtcctggatggtgtgtgtaggttatatgcaaatactatgctatgtcatatccaggactggagcattctcaggcatctgggaccaatctcccacagacactgagagatggctggactctcctttcttctcagccctgtcaaactagcagtgacatcaaaaggaagggccgcatggtcttgggcagagttggcttagagaaatagagtatgcttaattcatttcaggttctagataatgcagcatgataaaagactattcatatgttataaatataaaatttcaacagatccatgtttaaatgtgtacttcatatcttagcagattcctttaatgggatttttttttttttacactgaggaaatatttcacactattttccgctggatgcaatttaaaaaatctgtttcaatttgtatacattctccaaggttgtaattttatatggaaacctcgcaaataactttttgtgtctatatcctcacctggtatatgcttgctgagtgtccagagcaatagtctatcatcgtagaaaatggagatacccttgattagaaaacatagctactgaaagcacatctgaaacaataactatttggtttttaatttatcatccatcttcacatactctttttattgtcaaagtattctagactgctgcattttgttaaaatctaagaacaaagctttattgcttaagaggatgatttggctataattttgtagttatattattccttatcaacttaaaaaaaaaagaacatgtacttagagaaaaaaatcttgagctaaacaaattgagtaaccattgggggcatacttttattctcaggaacttggctgctgtatgtcttcctctggactcatctacagtaaatgatgtttcaccatctattggtaatgaaaatggtgatatgtgtgttatactttcttatgcaagagtcagggctattacttcagtgctattctaagtgtctaaaaaaggtaggagtgtgtgtatgtgttgcagtgattcattacctttatttttctatgttcacacgtaagtgattatccttatttattggctggaaattgagtattaatgtaggctttttaatttttgtttattttttatttctttttgaggcagagtcttgctcttttgctcaggctggagtgcagtggtgcaatcttagcttactgtaacctccgcctcctgggttcaagagattattgtgtctcagcttctcaggtagctgggattacaggtgtgcaccaccacacttggctaatttttgtatttttagtagagacagggttttgccgtgttggccaggctggtgtcgaactcctggcctcatgcaatcctcctgccttggcctcccaaagtgctgaaattacaggtgtgagcaacactgtgcccaggggatagtggcctttttacttcaagtattcatagcaggaataaagcgtgacataaatggcatgtatgaaatgagaatgatgtgtataaaactcatgggacagtgactaatatgtcttaaataaatgaaatgttatattccgtggattattttctagatttattttcctaaacactgtctttgaaatgaatacctacataccacacttatgcatctccctcagacttttaaaagaattattaatcaaatgaagctgagaaatactgaagtgtctctttctacatctgactgcttcttataatttgctgtcagttcctatgggtttcaagcttaattctatgctactcgtatttgaaatttttgttttttttctgcctacttacctacaatcttattggtaaatataatctttttgaacatcttatagtaatatatcttatggaaatcaaaataatataagaagttctttgaggaggtaggagaggggggaaagcacttctttacatttctttgtcacggtttttgtatattacttcggtgccccttgaattattttccaagatctaagtatgtgtgggtaaaatgcaactgttttacatgtgtaactttattataattaattgtgtttcatcttttttaaagatggaaaaaatcacactgcaatagtatttgttacttcttttcatagtcaaagcacatctaagtaaattgagttgaggccacatcttgacccgctgatcatcttgttaaatttcatgttgcttcctagctcatttaacttgtgaggaacagcattttaggaggcttgatttagcaattcttttcagtaaaaccatacctcttctcaatgaatgttgtataaagtcagcacaacctgttccaaagagatttattacactgtagtgcagaaaatattgtagaaattattatggtgaacgtgtgacttcaggcagcttttctttaaaaaaatataaccttaattgtggggaaaagctctcactgtcatccttcagtatcgcttgggggttggttccaggaactcctgcagataccaaaatctgaagatgctcagtttcttatttaaaattgtgtaatagtttgcatataacctgcacacatcctcttgtacactttaaataatctctagattacttataaggcctaacacaatgtaaacgctatataaatagttgttatactatattgtttttatttgcattatttttaatttttgcattatttgttatttttattttctttttcaagtattttcaatctgttgagattcagtccgtggattcagtttgaatccatgaatgtggaaccaacagataggaagaccagtggtatttagtgttactacattggatatttttcactagtcttctgcattgctggatcacattatttcattttttattacagaaaattttaaacatacagctcaactatcagctctaacaattattaatttatggctagtcttgctgcatctatactcctacgaactcatccaaacaggattattttgaaacatatttcagacctcatgtcacttcttctgaaaacattttagtatacattttaaaaatagtatactatttttaaacgttaaaaatagtactgtttaataacaaaaatacttaagctatatgtaatagtgttattaaaatatctgaatgttttgtaaatgttgctttatatttggctggtttagaatccacacgaaatccacaccttacatttgattgatatatctcttcggattcttttagtctataggttgttcctcctgcctgacccctgtgcatgtgtttcagtttcttcgttgaaattgggcttgctttctcctgcagcttcctcctgtcttgacttcgctgaatccatccctgtggtatctaccatgttctataacctcggtgtttcttataaactgataggtggatgtagagtcttaatataactccgatttcaatttgtaataatattatctccaggcattgttgtatggttccatcagcagatggggacagtgtggttgttcatcattttgtgagcagcccctggtaattattacctggatcttttatctgtctacctgttattactgtaattcctttatttagtaggggaatatttctataaacagaaacttttccttctcagctattcttgccagttactctgaggtatacagttcatatggaaagtgtaggccaaatgcttaatttcatctgtttctttatcagttttgtttttgtttcttttttttttttcttcttcttcccttttgagacatggttttactctgtcacctaggctggacacccagtgcagtgatgcaatcttggctcgctgccaagacctcctgggctcaagcatcctcccatcttaacctcccaagtagctgggactacaggcgcacaccaccatgcccagctaatatttgtatttttgcagagacagggttttgccatattgcccaggctggtctcaaactcctgagctcaagtgatccacccaccttagcttcccaaagtgctggtattacaggcatgagccaccatggctagcctcttcctttattggtttcagaaaaaataagttggttttctggggccacatcctcacggttcatgtttactgttttttttttttttctttttaaaagatatcattaagaactcacaaacatcaacatagttattactgcagccggttgcattattcttcttactgatgtttcagttgccccacatttgaataaccagacccctctaagctgactcctgagagctgttggtagcagcatcctcactttctgctgtgacagtgtgtttcatgctcttctaatatattttctgccccatacctggaatcagtcatttctcaaagtagccttgcccctattaatgggaaagggtattcagagaccactatttggaattattgcttttattttgcaaatgcttaaagtaagttaacatcaggagcacgctggctctaaattcagttttcacagctatgtctgaaaatgtagtgagtctacccttgattatccgagtgattaatctttccaagggtaccaataaatgtgggttctccttgccaattcagattttcctttatttggactctgatgaacttcttacagaactgtagcctgacgtttctgtgggcactgtgactgtgtgttggatgaggtcttacttggcaggtgtcagaagcaatgatgggcagatctgcttgtctgcagtaggatgccagaacacagtgaccactgtgcttgtgttgagttgtgggtttttgtttgttttttttttgctttttttgtttatgggtacagatagttaggaagcaatggtatctcaatgagtttaacattttcttttgccccctgcgaaattgagtgccaggaaattgggctcaaccattgtgttgtcttcagtaggcaaattgggttggggggctggaaattggtcacagtcatggtgctaagttttgaagaggtttttcctagtgtggaatgtctgagcatgagcttggtcttccctgacagtggaattggctccagctttgcagaccttatcaatcctgttaccagtgcatcctacatttcatctcccaaagctggcttcatcagtgatctgtgaagtgtgatgcagaaccattgaggcatggaaaacaaatggggacctttgatcaacatggggattaggggaacaacaattattaaaaaaatatcaggacttaacatatctgtattttattatctcacattgtaaaatttcctattccttgtatatgtttaataatgtttgtattagtggaattgagcatttaaatgatcattaaataaaagtcctatacagctgcatgctcagaaagattttcctaacagggctatgttatcaagaaagtttggaggcactggacctgctttctggtcactttttctgcatcttttcttgggcagtcttttgatccattctccagtttagtcaagtgatcgtttagtaattcacatctctcttccttctacctccatgcttaaaaaccttcagcagcttcccagtacggttaagaatactggtatgttttgttcaagtgtataagaattgttttgtgtctttgcagccttgtctcttctacctcatgactagcacgctgggcctctgaatttcttggatgagtcttcttcctgcttaactctaggcactctcttttccctttgtctggtaaaacttctctttggtgctctcctgtctagccttacttatgccataggcatctggtcaagtaacagtttcttcagtaggtgtttccggattccatagagttgctacataatcctgtagtgctgtgtatttttggtgactacgggagagtagggaatttgtgtgggttctctagatccactgctgtgttgggaaatgtttaatagccggctctctgaaaaccgcagaaacctggctttgtcacattttcccatttccatggtgtaaatatgagtattatggccagattcaggctaccaaattgatgtcactgaatgttgagttgggatgagatgcatggtagcaaactgtaatatggtatttccatgataatagatggagaaggtgcatcatgtgtgtagatactaataaaatatagtaaaataattcgaacgtgaagatttttgagtattatctttgttttaatatagtttagttggaagtttatgtactataattttcttttcttttttttcttttttttttgagacagagtttcgcttttgtcgcccaggttagagtgcaatggcactatcttggatcactgcagtctccgcctcccaggttcaagtgattctactgcttcagcctcccgagtagctggaattacaggtgcctgtcaccacagccagctaatttttgtatttttaatagagatggggttttaccatgttagccaggctggtctggaactcctgacctcaggtgatccgcctgccgtggcctcccaaaatgctgagattacaggcatgagccaccatgcctggcctgtattataatttttaataattttatttaaccatcaactctcagaaattcctgaaaatttaataattctctctcatgcaatggtaggagccaggagtagagatcccctgtgccacacgcagacaggtcacatttttttgaattgattgaagacattggaataaggtaatgtatgcatgtgcttccatttttgggcatttactttgctttgcattatcaacttattcttttataacttgcatgtcttgcattgtactagcttttatatgaggagaagtatgtatcacagagggaaatatgcacaaatgcagccagatactcaacaccactccagtagtgcaactgattgactaaggcattaacattgatctaatgaagttcagtggcaggtggttggctcagaaaaatgaattataatacattaatcttgctttgtggatatacaaggtagacagaaaaaatggtaaacactttcgttcttggaattcccattttgctattcattccctcattttccaatcattgagaggtgaattatcagaaaaacgctttagcgatatttgcctgcagctactatattggtagttttgactgaattacttaatcgattcgacctaagtttctaaattgactaagtgtttgactgaaaagattctttggaagaaaatacagatgatttcacaagattatagtgacatatcgtgtgaaagtgtagattaagggtacccaacacatttctgttaatccaagtaaatgtttctgatcaggatataagagtaaatgccatcagggttacaaaagctggtgtaaaatttagacattttaatagccatgtggtaggacatttcaaatattattttctaaaggttaactgtcaatatttaggtcctataaagaaaaagttttaaaatgctttagaatatagtatttattttgtaagcaatctttctagacagaacagcccttctatattttatttccaaaaatcaaaagctgttagggacagaagtttttaagatagaaggtaagccctttttgttatagatgaggaaactagagccatgcgtgaatgtggacagccttgttctgtttgaatcggtgttttgaagtgtgtggtttaccctgtgaattaagacctgagcaggtgcgagcctgtctttgcagcagatgatcttcagccacatgcttcgtcctgtgctagcccgtcatcctggatgactcttctttttatgttgattcaatgtatggtaatgtttgcagagaaaactaacgaggcatattagaaatccgtactaatgtagatacattttgtaaaatcaaataagattgatcaccatccctacttaattcagagcaaaggaagggaatctaatttttctctttttccacacctcgtttgctgtaatgaaaatggcattctgctttgaatcatttccaaggaaatgattttcaatattgttgtctgtgacattttgacaattaaaatgcatttcttaagcctactggaaatgctgcgatgctttttcttgttttcattttttttccccccagtggttctatctgtgcttgttgcctaggaaaccacgactgggttgaattctgtttgcctggttgtctgacagactggcaaagttatggataaagttcttggctttagagttgtaaaagtgctacttaaataacagaaacattttatcaatattaaagtgctttatctcctcaattaaaaagcagccaagcatttgtttggttttcttaaaatgctaaatagagaattattgttttccttgattattattgaaacttcctgttttgtatacaaatttgcaataggatttgaattgtcacagtgagctagttctaaatatagcactttaataaaaaaatgcttctgtaaatttgtttacttccttggggagtcatgtgcatgtgttatcattcccaagagggacaaacataaacatatttcatgaaaaaattcaaagaggtgttagaaaatgcagattattttgccctatgtttgataagtagaaaaacaattatttctatataactttttcaaattaaagttagaaagaagtagtggaaatccctcagatcttttctgagttgatagaactgagagtatatagttaatggttatttaattatactttagctaaattcagtgtccttgcttaatactaaaaaattaattacattgcttaatactaaaaaaatttcagagagatgtgtttttggatgatcctgtgaccactgactccatgaagctgtagagcccttgaaatgaggcaagggtaactgaggagctgaatctaaatagccggtgtggctagtgactccatcgtctggggacttgatggaaatgcagagtctcaggccccatccagacctattcattcagaatctgtatttttcatgaggtcccttagggctgatatgcaatgctgtctcttctagagcaataattctcttctagagctgtcttggctgcatgttacaatgacctgaagagcttgtgaaagtaattcctgggcttcttcctagaccaaattttcagtatttctgatggggatcctggaaccagcattttacagagtattcccacgtcattttaatgactggtgaagtgttagaaccacatatataactcaaagagtatacaaacaagtgtgacgtttggatggggaggtcttaagtactgccctggattttccactttttgttgaggttagtataggaacagtatatgtaagaaagagttagtctgtactgagtgctaagtatattatcttaaattgactaaacatttgactgggaagactcttttggtgaaaatacacaagactatattgacaggctgggcgtggtggctcatgcctgtaatcccagcactttcgggaggcaaagatgttagtgacatactttgtgaatgtatagattaagggcacccaacgcatttctgttaatcccagtaaatgttctgacatagatatgaagcacgagcattttgttttgtgtacacacaccctctccctctgtctctctctctctctctctgtaatgtgcccttccttcaatgtaccactccccatttcttctcacaaatcccctaataataaaataaattgtgatgaattttctgtttgctcgtcttagctaaagggaacttatttcattcttaaaatgtttttcatggtctttctttttccctgtgaagaatgattacaagatccaagcatgagatgagtcattgtctaatgaatagtgtcttttcttccagctctgacttgcagtgtggttgagttcagctaatgtgcatttactgcactcctaccgtgtgatggcagtgatggtagatgtaggtgagaaaggtgcaaataaaccagagagtctttctttcagttcttggtgttcctggatttcatgcatactggataggagcatgttttctgtggcttgacgactgaggcttggatttttatctccactaattattgttagattaacttttgccaggatatcttatctctgtaacaccaagtcttcatacctgtaaaataggaatacctataaaatgggaataataatagaacctattttatagccttattctgaggatttgatcagtcatgacattaaggttcttagcatatacataacccatagtgaatgctcaacaaatgttagtgattacagacttaattggctcattataaatgatcaaggcatgtttacttttacattactctttccttaaggaggagaatgaatggtttagattagctatgaaagatctctgcactttgaaggtaatataaacagacacgcagccatatgtttcagagccatgaagtcttattgctgccttggagcaaccagttggtgccaaatggctttattaatcgccagtgtgtacagggttgtgtggtaaggaattaatttgaaactggaacagttaagacagagaagtggataatgagccatttgaatgtttttaaagtgcttccgtcatactccccctgtagaaaataaagcttttcaacttccggcagcatccgatcctttacttcatttttgttcctagcactgatctcttcgtggcgtagtctgtgttcacatgtgtatgctttgtcctgtcctcaccagaatggaacatcctggagggattattggccttccagttcaaacgattcttctgcctcctgcctcagcctccctagtagctgagactacaggcatgcaccaccacgcccaactaatttttgtatttttagtagagacagggtttcaccatcttggccaggctggtctagaactcctgacatcacatgatcttcccacttcagcctcccaaagttctgagattacaggcttgaaccattgcgcccagctgtagatatttgtctttggaagaaagactttgtaaacctccttagaaagcttttagtggggcgggcaagcggcggggccatgcgcatggcatgctgggctgtgggcgctggctgctgggaacccggcagaacatggccgtgcatgtgtgctgaagggagaggtggccacagagatagcgtgttcctcatgatcaagtgccactgcatcaccatcttcacagatgccagggtgtctagcatggtgtttgagttgaagtgcatcgtcgagggcatcctcagcagctgtacagggatgaccagctcttggatgttggcaagacgctgggagagtgtagcttcaccagccaaagtgcatggccacagccccggccacagcggtgctgggcttccaggcggacgacggccttgaggccctgcacatcccatggttaggaagccccaggacacaggaagcagtgctcacgagcaagccgtgcacagagggcactctgcgtgtccgtgagaggcccacttcccccagtaaaagagatttagatgtcgggggcaaaaaaaaaagggttttagtaccatgaagattcatttgcatcccagtgcctgtggtcccagctgctcaggaggcaggggtgggaggatcccttctgcctgggaggttgaggctgcagtgagcccagattgcatcactgcactccagcctgggtgacagagcgagactctgtctcaaaaaataaataaataaaaataaataaataaaataaaaataaaaaattcatgtgcaagatgaaaagcccagctctgataaaaatgaagtatggagattacagtggaagtttaacacctcatagttgtagagaggcttgctgctgtgaagtaattgttgatggtcaacatacactgggataattatgaaatcttgtaaagtgcaggagcttcaaacgcacatcctgaggtgacagaaaactggcaaatgaaattggcaaattgctagtccccaggtaagagaaaaagattacgcttttatatagtattgtggagtaaaggttataataataaagaaatgggggaataatgcttgacagttactgctgtatttgaatccttaataaaataatagaagacaaatgtcaaaggagagggcattgagcatttagagaatatctgcaatgcaatcaatagtcaatgtcaatttttgaaagacaaattacttgttagatgaagttataattttaaaatttaattacatgattgttgaactaaattggtaaaatgaaagtgatatgaggaatttggtgcagatatacctataaaattatatgtgaagaattaatttagattgactcccactcagatattctcataagggagtcagcactgcatgaaggaccatagtgcaaaattaatagttaaaaaaaaaaaaaagtaaaacctggatgggatttctagccagggagtttatcaccaatatttgaagcggcaattctttgtccttttcctggtagaaaacccttttttttgttctctggggccttccaacatctgtaattgtttctttgctacagagattgccctttcaatacttgagacaatcaatgtgaaaaggacagagatagatggaagtcctgtatctcaagatggaagtcattcattttcttaatttatttatacagtaacactttaacaaacattttctcggtgtcctttgctggattaaaaactgggggtagaatcacaaaatttaatgaggcagacagatgagaaagtaccagatctaagtgaagtcaagcatgatttcacttagtctgtagaaaccttttaaacttctcagagatggcaatgcctgcccggccgaccttagaaaagagagtgagtgagaagaggcccagaagagagaacttggaagcctctttggccttctgtagttgcagagtgttccagttgagtgtaagggtgcagagacattgttcagctcacagaggatacaaaaatggtcttgtgccccaagcagaccgaaaattctgagttatgacgtctgatttgtggtttacaaaaggtatcatgagtgctttgtagaggatgacttggagacggccaggcctggagagagagaataaatcaagctgagaaatgatgaggatccgtgactgccagtatgaagttcacatttttaaaaatcacagctgaattatatatgtgtacatatataatatatttattttatatatagcaattatatgtatatagtatgacatagccctgctgctcagagtcacaaaagggtaatggtcactcagaccagcagcactgatgtcaccaggacaatgaaatgcagaatttcagatcctacccattccagacctactgaagctctttaacaagattcctaggtggtttctgtgcacatcaacctttgacagtctctgacttagaagacactgagttgcctcatccaaagctaccttgtttgctttgtcaccttctaatcacattgtttccaatcacatctggtacagccatactgaatttcttgtagtttctttaattctcttgaatttcagtgtctggcttttgcacatgcagttttctctgctcatgtattgtcttccttctgccccattcatctggccaggcaccaccaccattgccctgaaacaaaaccaaaacagactgtaaacaaaaaataaaattttaagacccctaaccaactgaatggacccattcttggccaagaacataccaatgtaaacctgaaaactagttcgggccatgatgggaaagggggattggatgtacctttttataccctcctccctttggaattcaggtattactgaccagcattaacattaaaacaggctggctcgtgcctctaatcccaacactttgggaggtcatggcaggaggatcacttgagcccaggattttgagaccagcctgggcaacatgacactgtatctacaaaaataagaaaattagccactcatcgtggcacgcacctgtagtcccagctgcttggtaagctgaggcaggaggatcgtgtgagcctgggagttcaaggatgcagtgatctacgatcgtgacactgctctccagcctgggtgacaaagtaaaaccctgtctcaaaaaaaaaaaaaaaaaaaaaaacccaaaacgtttaaacagccacattatagtctctttgtagcaataaaatatataacaaaatgacaggtagctggaccttaaagaaatcaaagtattttaccccaaaatatatttctgtgatgtattttgaaatggccccacaaatctctctcgcaaggagtctgacacctttttaagtctgattaaaaatcatttaccatctattctccctgaagcctgctacctggaggtttcatctgcatagtaagaaccttgggctccacaaccccttatattaacccagatactcctttctgtttattccagatctttagataataacttaactctttcaaccaattgacagtcaaaaagctctgaatctatgacccggaatcccttgcttcattgtcctacctttccaaactaaaccagtgtacaccttacatgtattgattgatgtctgcttataacttctgtcccctaaaatgtataaaatcaagctgtaacaaatcaccttgggcaattgttctcaggatctcctgaggctgtgttgggggcatatctttaaccttggcaaaaatgaacttttttttttttttgagacagagtcttgctctgtctcccaggctggagtgcagtggcatgatcttggctcactgccgcctctgcctcccaggttcaagggattcttgtgcctcagcctcccgagtagctggcgttacaggtgggcaccaccacgcccggctaatttttgtatttctagtagagatggggttgcaccatgttggtcacactggtctcgaactcctgacctaaggtgatctgcctgccttggcctcccaaagtgttgggattacagatgtatgccactgtgcccggcctaaacttctaaattgattgagacttgtctcggatacttttaagggcctggcctctgtggatatgacagtgaaaggtgaggttgtctaggagtgggttgccaatgaggaggaaggtcctaaaacctaggagggcagcatggcaaacacaatgacacgatctggcagccacgaaaggagcttgtggaggagtggtcagaggctttccacaagaggtggcctgcaggagaatgcaaaaggttcataggtaaaatttagcagttatttttcacttgaagtctttgctaaagctcttaaagacagtgcctctcttagatgttcctgtagtgctgtgtacttatgaagcagcaggatcacgctgaagtgctggatcatgtctacattctccagggcactgaaaacttcacgagggcagagaccaggtctatgttgtatattatgagatcctagggacatggggctcaaaaatatgggttgataaagggaaagacatttatggcactcttggcaaaacaacaacaacaacaaacaacaacaacaaaaactatgttagttgagtactcgagaggagcaatgaaacagcacactcctgtcaaaagattgcctatgaagaaaataagcacaagagcagtatctggaatggaatctgacagagggagtggtatagttcctttaaagatttatgagagtcgttcatttagcaaatatttacctaaaattctcatgctttgtgaagtccgtatttgtgattttagctgtttgctaaaatttatttgtagctcctaaattaatactcggggcacctttgtgctcattcatgaacatgtgttggatggcaaacagtttgagtcacttgactaatatgtttccagttgaggctgaagaatgggaaactgccttcttgctctggttttcatattttaaaaaagtgtccttttcatgggctatttggtgccatgtttttcgtgctttttgctggtgattttgctgttaaaatggcgcccaagcataataccaacatgatgtctagcattcctaagcacagttagtctgtgatataccttccggagaaaatatattattaggtaagctttgttcaggtatgagttatagtcctgttagccgtgagtttaatcagcaatatatattaattaagatgtctttatacagatcacacctaaggcaaggctctgtattgaatggtgaacaacagggttgtggtcagaggctccacctaaccttgtatttctcctaggagcagtggttgagtatttgctaattcagtgtttacagttactttatataacataactattgtgcaaaactagaatcaactgtatttagttttccgggcactgttttgggcactgagggtgagacagtgaggaagaaagatacgttctatccccttgtgggtcttacattctatctggggctgttggccatatggaaatagaaaggtagcacatctcctactcagcacatatatgaggaaaagcaatattataaataacaatagcataagcttccccccttttttctgtttttttttctctctctttttttttttttttttggtgacagagtctcactctgtcgtccaggcttgagtgcagtggcatgaaatgggctcactgcagccatgacctcccaggctcaagcaattatcctgcctcatcttccagagtagctgggaccacagatgcgtgccactgtgcctagctaatgtttgtattttttgtagagacgaggtctcactatgttgcctaggcaggtctcaaactcctgggctcaagtgatccacctgcctcagcctcccaaagtgtcttttttctttctcatgttttgttcatttttgtttatcatctgcaagagaaacacatttttgtttgtttgttttctgagatggagtttcgctcttcttgcccaggctggggtgcagtggtgcgatcttggctcaccgaaacctctgcctcccagattcaagctattctcctgcctcaacctcctgagtagctgggattacaggcatgcaccaccacacctggctaattttttttttttgtatttttagtagagacagggtttctccatgttggtcaggatggtcttgaactcccgacctcaggtgatctgcccgccttggcctcccaaagtgctgggattacaggcgtgagccactgcaccttgcattttttttttttaattttaaggaaaatagctcactcttacctgttcacatgcccctctatcctccctctaacttgcttcttttttcttctctcagtttctttccaccttatattcccctggtctcagcttcaatctcctcattgctcattaaggtatgtttctgaaagtacaaaaagaatctagaaaaataattccataatattctctcagtgaaagtctctggtaccaggtatgtaaatacctttagttattttcatctgggcttctcatggtatttagtactcttctaactgtccctgttggacatttactaacatttgccttttacctgtcctgagccagtcgctggggagtagcaatctgttagaggatttgttcctttttgaatggtcagaggcctggggcaggggctcacacctgtaatcccagcgctttgggagaccgagacagcaggactgcttgaggccaggagtttgagaccagccttggtaatatagcgagacccattaatttaaaaaatagaaacattagccaggtcgggcatgatgactcatgcctgtaccagcactttggtaggctgaggcgggaggataacttgaggccaggagttcaagaccagcttagacaacgaagtgagaccctgtctctacagaacataaaaaaattagctgggcatggtggggggcacctgtgggtccagctacatgggaggctgaggcaggaggattccctgagctcaggagctcaaggatgcagtgagcaatgatggtgccactgcagtccactctgggaggcagagtaagatgctgcttcaaaaaaaaaaaaaaaaaaaagataaaaattagcagggcacagtggtgtgtgcctgtagctgagcatggtggggggcacctgtggtcccagctacataggaggctgtggcgggtggattgcttgaggccaggagttaaggctgcagtgagctatgattgtaccactctactcccatttgggagacagagcaagaccctgtctcaaataaatgaatgaatggtcagaatgggattcactttagagtgattttttttttctacttttctacagtaaatgactctcaacatcttggccccatatttattagttttgaaaatcactaggataatgatgtctagttagatgctaatcaaatatgtattggttgaagtagctggatggtagctctcccatagcaaaataaggacaccaaaatatatataaaagaggaaaagtcattgttgtgaactgctgctttccatttgctctctgggtggccagatcactccctgatgtgtctggcaggggctcaactaacttttcccctgaactgtactggcttagcaaaggacctggggataccacgtttttatgcacaggattcagtagccaatgcctgttttgataagtagctggtcatttacatcattgcctcaggccaggtccttcactctcgcctgagaggcaggaagagagaagtcaaaggcttttcacctctgatgtccatttcttatgccccttaaccactctgttctaccctggggatgaaaggaaaggagtccctgaacacacactggggcctacatgagggtggagagagggagagggaaagggaggagggtgatgataaaaataaataaataaataaataaataaaacaactgttggatactatgcttattacttggttggtgaaatattctgtacaccaaacctgtgacacaaaacttacctgtattagaaacctgcaggggctgggcgtggtggctcacacctgtaaccccagcactttgggaggctgaggcgggtggatcacctgaggtcaggagtttgagaccagcctggtcaacatggtgaaaccccatctctattaaaattacaaaaattatgcagatgtggtggcaggcacctgtaatcccagctacttgggaggatgaggcaggagaagagcttgaacctgagaagcggaggttgcagtgagccgatatcgcgccactgcactccaggctggtgacagagcaagactccgtctcaaaaaagaaaaaaaaaaaaaaaaaaagaaaaagaaacctgcagatgtacccctgtagctaaaataaaagtttaaaataaaaataaaatattggaatacatctatttaaaaaacgaattgggaagtatttttgttcctgactgatatatcttagccaactttaaaacattttgttcctactttgttggggtgtgtgtctagagtggatgagttgtaaaaatgaatagagtcaatacttgtcctctagttgaataactggccgatgctgttaaaagtagaaacaggttgggcgaggtggttcatgctggtaatctcaaggctttaggaggctgagatgggagtttcactttgaggccaggagtttgtgaccagcctgggccacactgtgaaatcctgtttttacaaaaaataaaaaattaattaaccgggagtagtggtgtccacctatagtctcagttactggtgcagctgaggctggaggagcactaagcccaggagttccaggctgcagtgagctgtgatcttgcactgcactccagcctgggtgacagagcaagaccttgtctctaaaaagacaaaaaaggagaagcaaggtgcagtaggagaaagaggcagaggaattttactagtacgtctgagctggattgtttcctttgatcctccacacctatctgtgctctgctccatatgccaagaggccagcccctcacactgactgtccaggctctatgccgtctgccttgtgcctgcaaggactgcagcagcagggcattgacagaagtggaaagatggaaaaggcaggcttattcagccttcctggctgtggcttttgtgcagctgtggccctctggggaatgtcacagctccccttgcctcatgtgagcagagggcactataccctttgttgtcattccttaatcctgccatatattagaaacagtctttctgctaaactgtcctcaaagacccctctctgagtccgcaaaacacttggtgccaggacacaaatactagatctgatgggttggaggaggtgctgtcatttgaggaggacttgtagagtacaggacacactgaagtgggtggagaggagggcaaaggttcctgataatggaagttgcagcactggtgcgccatgcagttgtctactgtggtgcatgttcagggagctgtctgtgtggacaggctacagggcaccggcagtggctgtaggggctaaacattgggtgataagaagaatattatcggaaataatgttaggaaggtaccctaagtctcgattgcggcaggccttgacattgagaatttgcaactgggattttgtttaactctttgtgctttaaaaaaaatttaaaggctgggtgccgtggctcacgcgccccaaagtaatcccaggactttgggaggccgaggtgggcggatcatgaggtcaggagatagagtccattctggctaacacagtgaaaccctgtctctactaaaaatacaaaaaattagccgggcgtggtggcaggcgcctgtagtcccagctactcgggaggctgaggcaggagaatggcgtgaacccgggaggtggagcttgcagtgagccaagattgtgccactgcactccagcctgggcgacagggcgagactctgtctcaaaaaaaaaaaaaaaaaaattaaatttgagctaatcatagaatctgatgcaggtataagaaatgatacagagagattcatttcaatgataagattttgagaaaagttcctgttctgtcacaaccacaatattaacatttatataacattaatatacagcctttatataaaatgtatacaatcttattcagattttttcttgtactcaggtgagtgtttagaagatttttgatcagagtggttatattgtcagtttcagagtgagaattgtaatggtatagatttaatatgcctcagaaaaatgcttggcttttggatggaaacattaatatgtcattagaaaattgcatatattcacgcctgtaatcccagcactttgggaggcccaggtgggtggatcacctgaggtcgggagtttgagaccagcctgaccaacatggagaaaacctgtctctactaaatatacaaaattagctgggcgtggtggcacatgcctgtaatcccagctactcggaaggctgaggcaggataattacttaaacctgggaggcggaggttgcagtgagccgagatcgcaccattacactccagcctgggcaacgagagtgaaactccgtctcgaaagaaaattgcatatgtttttttccccttgactttattttccctccttatgtgtgttggattcagtgcaaccattgaaaacatcctgttatccacagaaatgtatcttaaacttaccattaaatcacctgttgtttcaagtgcaacatataggcatcttgtacttttgatacgttttatttttgtctggatagcaatgtgatcagatctgaattgcacagagtcaattaccaagtactcccaatgcagctgggtcttcttggagtatagtgattgacctagcccttaaactatgtttgtggtgctcattgcacttatctgtaaaatgtaatatttcagtttatcactaagcatcttccaaccatagtatcctgtatttattgcttatatagaaaaaaaatttaataacaaggtgataagattcatttttatatccttctctctgagtcatttgttgcttttcaaagcttatttcttgccctgccttccacaaatttcttccaaagattctaggaaataaatgaagtatggataaatacctttatgaaaaggagtaacacatatctgaaggttggttttgcaatcgtgatgacaggtttgtatccccacagcatgtgataataacttggttcttcccatggttagatgtctctttaggaaatgtatgattgccctgaagatgggagagagacagttttcattttgcatgaagagtaattttgctgtttgtatcataagttctaaaagcacacatgtaactgcatattatatttagattcgattaaataccttgatgatttatgcctgtcttcttggcagagttttattcattgccttaagtggttaaatagttgaaaaacgacttgaagaatgaaggaagagagacattgggcaagttgatgagaagaaagggtgggatatttaacagttaaaaatgtatatgtctgccctttggtatttgctctaattcataattagatcaccatttcttccacttatttaaaaggcaccttacctagagagagacatcaatatttacagtgcattagtgccatggagaatttcagatcttgtgatgaaggtttattgctgttttatcccctcttcaaagcagtgtacacatcaaacagtctccaccctcattctggacccagtgacatcgcaccagtcgctctgtgcttcatgcagcagcttaattattgaagatccttgtctttgaattttctttttaatatttcagaggatatactttgaaaatctatatattaaataaatcagaagattatgggattagaaagttttatcatattttaaaatgcatcagttttgctaaaatttgagataaggagtggccataatgtgaccaaattaccttaaatgagaagctcctattatttctaattactgtaatgaacacaaattacatcagattattaataatgctgaaataggccatgggccccagaaacgtagcaaatcataggtgagaagatcatgttttattcatccgaggccaaagcaaaattaccttctttatgcaatgttatattagtcaggacagttagaggtggggaaccttttaggtgaacttttagatgaatcaggcagttgtgtttcatgattcattttgttgataaggccacatatttatatgaatgtctttccttaaaataaggtgaaactcgtgaaaagatctcatgccatttgtgactactactgcaccattctctagaactctgtgttgcttgtcgtactttgacctgttgggagttaccctgagcatggctgctgagactgctttgcagtgcttttatgtttttttctagtacatttttcataaattattattctctcaggatgaggtttggtggatgatcactggttgggggtatatgaacatatgtgtactcgcacctttttggtattaaagggaacttctaaacccagcaatgcagcctctgaatttataaattagggatggaggcccagagaggtgactgatgtgccagtatcacaggtctaggccagtggttcttagcgtgtggtctctgggccctaagggatcactaagatcatttcaggaaggccataagtgcagtactgttttcagagtattatgaaacgcgattttgtgttgttcaccgagttgacatctacatcagtggtgcccaggacctgaggggcaaaaatgtagagatcacttggcacaaatcaagacggtggcaccaaatgtattctttaccccacacactcgcagtgtttttaaaagccattttcacccactgtttttgatgaagaaacaaaattaattacttaaaatctgacactttaatatacaatttaacattttgtgtgatgatgtcggcataaaacacttctccaacatatggaagctcagtggttcctttttaaattttaattttattttatttttgttgaggtaaggtctcactgtgttgcccagcttggccttgaactcctgggctcaagtgatccttctgcttcagcctccttcagtagctagtgttacattcgtgagccaccacgcccagcttctcagtggttgtcttgagaaatacttttatgcgaaggcttgatttacatggtgaggttttctcatagaacagcgttttcatttgaaatacggacagaaaaactggttattcagacctgagtgtctggcagagagtttattaaaaatgagtgacacaagcctgtcactgtaaggcaaaaaatgggcaatatttgttgctaaagataaaattcaaactttctaggtaaaattaggttttggaaaacttatgtcccactgtgagcatgactgcttcccagtacataaagatatttctgattaaattggcagagatattaacatgtgattttctgaaataaagaaatgtatcaacatttggaagattggcataactcagtaactaatattttccaaatgactaatgttatggaatttctcgtgggtagaagtttaattcaaaatgtgagacaaatagattttaatgtaacaaagaaagaaaacttcacattcacattgtagctgacctttgagaaaccaccactggtcgagttatggtgtggtatcacagaagaaaatctaaaattttctggaaaagctattaagatattattccctcttccagctacatatttgtgaagttctgtttttcctttatatactttttcatatggcagctgagaatgcagaagcagatatgagaatccagatgtcttctattaagcaaaatgttaaacattgctgctctttccactaaatgtgctttgttttataaaatacaattttcataaaattgagttgtgttaacatgtgatgagttttattattattaaagtgaattaatacatattttaaagttgttctcattttcactcctaaaatggtaaatatcactagctctaccctcccataaacaaaaactctttgaggtcatcaatttttagagtgtgaaagggccctgagatcagagtttgggaatcactgaatctagtttgtttccttgcaggcatgctttcctattttatatgtagtacttcctccatttaatgatagatttttttccttttcctatcttaacatttctgaaatttggatgtctcttacaatatatgtttatggctaatgtaacgtttcttcctcttcccaaaatgaaatcgttctatgaattaaaatcaggatatgatttctcagtgcataattctactaggaaaacaacaaaattcttctcttttaaaaaacaaaccaacatttgtatccacaggtagctaggaatggaacttaatagatttgatttcataatttgtgatttgtgattgagcactggctcaggagcctgaagtcttggctggaaaactgacttttcatgtcatctctctgagcctcagcttactcatctgtgacgtgggtcgcatgtttttccatgtgtctaatgtagtgccttatttaaataaaaaaatttcagatccctccgtttaagtggtgggttctagtacactgttactaaactttgtgcacgcgtgtgtatgtgtgtgtgaaaactccataaaaatgccttataattttcatgcaatcataaatccaagaagaaatcataaaccaatacacatccagatgtgtaacagagatccatcagatagaagcacatcattgtgagagatgaagaagtcttgctgagtctaaattgtaggctgtatgaacctatacctgccccggggtctatttatttggacctgggttatgctgcctttatgtactgtgatgactcaggtcttacagcacttccaaccataagaaaaccttgatttcaacatcattatgatgtcatttggccatcctttgatgagaaaatgctgttgagtgactgactgacagggccttgctctgttgcccaggctggagtgcagtagtataatcacggctcactgcagccttgaactcctgggctcaagtgatcttcccacctaaggctcctgagtagctgggactgatgcaggacatgtgagccccacagtggggcttagcccataaaggtccttgtgtttgcccaggaaagaattcaagggcaagctggggctagaagaaaacagctttgttgaagcaacagtgtcgcagctctgtgactgcttctgcagagcaggggtgctctatgggcagagagtagcagcccagggcagttttgcaatcatatttatactcacttttaattacatgcagattaaggggaagtttatacagaaatttttaggaaaggagtagtaactgggacattaggttattaccacggaaacagtaggtaacacctaggtgttgccatggcagtagtaaactgacatgacagctggtgagtgtgtttgatggaaaactgcttctgtcccagccctgttttagccagtcctcagtttggtctggtgtccaagccctgcctctgcagtcaagtcctgcctcctacactaggactacaggaaagtgctaccacagttgtctattttttttttttttattttttgtagagacaggatctcactgtgttgcccaagttggtcttgaactcctgacctcaagcaattctcccactttggcctcccaaggtgctgggattataggtgtgagccattgcacctggcctcgttgacttgttttattgggttttgttctttctcatcagcgtggtaatcaaatctaggactccttcctgaatttgacagtggacataaatgtaaacgtggcacctgaaattgcgtgggagtactcagtgacgaggtagtgcaaatagaagatccagactgtatttattttaatttattttataaatattgctgaaatgcaaacaaaaagtttaatgttggaagaactaacaagaagggctgcatgatagagcattcgctgtagcagccttcacattgcagtttatgcaaacaccaccctatccatgagctccatcacccaccataagagacatcccgcagggcctggagctccctctgttatcttcctcttctcaaatcccctttcccccagtccatattttatttcgagagctacaggtatatagagataaatgctaattatttttgtctgtctgttgcagactaacacattaacacaatgtttgtgtctaatcttaagaagatggtcttaattatttaatcaaaatcatgtatgcaatgtattctcctgaggaaaatttcaaacacaagtagggcaagcagttttattgtgtccaagctaattcagtccttgaatttattggggggttagaatatacttttctttgattattttactatagatattgggtactgcttttggtcctatgtttgtgctattttttaaaggcctcctcttctgagttaatagtgcctcttgtagacttacatacagatgggtgacagaagagggagagaaatggaggtgtacagaggtacctaacaactgaataactaaccctgtaattggacagcaacagaatctgtgtctaagtaataacattgtctaaaagtttttagagttttcctgcccacctctccccattttgttgcttttttccttacagtttttaatttgatgattctggaaattttgcttcctcttggtagagaactttccttatagtaagggcattgtaatattaatgcatatcaatttttagatgtgtatttttgcgaccttgttctaagagtgactatatagttcttattggtgtttatttttattttggggggtgtaaattaataagcagcaaaggttgtcatgaatgtttacagacactaaaatccagaaattattaaaatcctcatgtttatgtttctctcagcacattaagatagccaccaaagtattaaatttggagttgactaaatttttgccctagtaacgttgctcagactgtgttgttattattgaatcctcatgatgtagaagtccatgttaaatttgttattactatgtttcatatgcttctgtttgctctgataagttctaatttgctttcacattggagactattggattgacagtggtttaaatacagctttcactgtatataaatagcctgtttggtatcctcaaggtttccatatctttaccattgaccagtgcaccagtgtttcaaaaatatccctcctagaacaaatgatgagtttactgcttcatggttaaagctatgtcattagaccggacgtggtggctcacgcctgtaatcccagcactttttggggccgaggcgggtggataacctgaggtcaggagttcaagaccagcctggctaacatggtgaaaccccgtctctactaaaaacacaaaaactagcttatcatggtggtgcacacttgtagtagcctgtagctactcgggaggctgaggcaggtgaatcacttgaacccaggaggcggagtttgctgtgagccgagattgtgccactgcattccagcctgggtgacagagccagactctgtctcaaccagtcaatcagtcagtaaaactgtattgttagaggctttaaaacaaatacttacatcctagtttttaaaaacagagtattctaaacataatttaaattttgtcttatgtttttgagtgatttcactcagttgctgagtggaacttttagttctgattgcagctattgcagactcttttcttcttcactttgcatttttaattctgtttcttctctgctgtgacagtgatcctatttgccaggctgttctcattgttactgataatgatacaaatgttcacctgagtgtattattgatactgttatagcaattgcaagcaagctcttctatgcaaatacatttgctaaaatactacctttcgtgtaattgtatatgtgagtatatgacagaaactacctgcagattaacatattactttgagtattttctgtcttaagtataaataatatatttgggcactacactttctgacaatactttattgaacaaaagaaacattttattcaacaaaatttttcagtagagcagccaaatgtctagattctatagatttttaaaaattgatacataattttatgtatttacggagaatatgtgatgttttgatacatgcataccatgtgttatggtcaaatctaggtaattaggatattcacacctcaattatttatctttttttgtattggaaacatttcaaatcctctcttctagctactttgaaatatacaataaattatttgttaactatatagattctgtgtttttattacagtagatatgattaaaaggtaggtgaaatttgtttacttgcttagattcattattttttaaatgatatatgtgatgattatttagaaatattggggtaatgatcacagtaatggttattatattactctctactgagtacacactatatgtctagcactgtttaacccctttatattatttagtccttacattaccctgatgaaagaggtactgttttattttcatttgagttggaaaggactagaggcagagaacagttaggcaacctggccagggccacatagataacaaggagtgaagtccaagtacaaacctgggccattttgctcggagccgacacttgaccgcatctctttcaccgtgtagtattttaaaggacctaaaggaatttgtgtttagaatactgacccacttgtccccttttacaaaagtgtaattctgttccttaatctttaggatttccctacgttctcctaacatgtagtttaccaacattagtatcttatttttcagcatagtgcttttgtgtttacagatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaaggtaaccacctctgcttgtttgctgctgtctcttgcccctcctgacttcttggtgtccgtgatgagtgtcgtgtcttgggtaaaccattggattccagggcatcttcatgatggccttttgtgagcgtggtaccaactttcatatcaaagttcagatagtctcctattttatatcacacttggattttctgatgaaaatcagtgccgtgtatggtgtgcacttattaatatatccattttttgaatagattccatttcatatcgttaaaaatgaaaacattcaacacattatgtgccatataaagtccctttcttgctgtgtctcctggtctcctctcccatttctcctcacaggcaacctctttatttgctttttctatgttcttacagggatatttgacacatttataagcaaatatttatattggttcatgaggtacattaaggaacttagaacattatgaacttttaaggatgaaagtggacttcatggtaatttagtttgattacacagttgatcgttttatcctaagtctccttgtaaatggaagtgtgttgtctagtcttcataatactttcttccctgacctaatttattttagtccttgacctaatttatttaatctgaataaagaaactttattttagcttgttttgtctgttttaaaaaatttgttggctgggcgtggtggctcccacctataatctcagcactttgggagtccaaggcaggtggaactcctggccaggaggtcaaggcccgcctggccaacatagcaaaaccccatctccactaaaaatacaaaaattagccaggtgtgctggcatgcacctgtaattctaactactcaggatgctgaggcacaataatcgcttgaacccaggaggcggaggttgcagtgagccgagatcacgccgctgcactctagcctgggcgacagagtgagactccatctcaacaactaaaaaaatgttgatgctctttgtcagaacccttattgttcctttttgtcacgcttctcacctcttatttaatgtgctttttgctgaatctgtcattttcacttttgaatctgtagatgctcaataaacttctgttgaaagaattaataaacattttttcagtgcagccagtaagttagcacagtatatattgagaaatgtcaaaataatactaatcacataagatgaaaaagatgtagcttgatatttgcttgatttattctttgcataggtataaaaatacctgttttaaatatttctttcaactttggtttgcatttcagcacactcctctctgtagtaattctagtgacaaaaaaagtacatggaaaacataggtttaaactgagaagaatctagttgaaaaaaagagtatatttagtttctggtttttttttgaattatgaacttaactgttaggcttagtctcctgaaatactttgtttttatagatgtgttgaggagccatattggaagatcttctcattaagattagcttgtaagttttgaggactttatcttgcagtagactatccaaagaagcagaatccagtttatcagtgggtctcatggcagttaatctttttttagaacagacctaatttaatttacatggatattcacaaatgtgtaaacaagtcaagctggcagtttaaaaaaatttttttaacttggttttcaactgtttgaaacatacggaagtttcttttcaagtcattcaacatcttggatgtgtgagtccgtttcagttgcagcaaacagaacgtgtttttatcataaaacatttttgaacaaaaggaatttatcacttagaatgtttttctcacaaaatcactggaagggtttgcagagcaggtcctaggtggtcctggagaacctttaaaactatgcagtaacaaacatgtggcttgcctgtggagctaccctctctgctttcgtggtgaaggaggtgctgcagtccaggggcctgaactcctcccaccggagcctgcctactacacactatacaccaccctgcctccaggtgtactcaacttgcttctgtcacttgtgaagctggagacccaccctagaaatgctgccagtcatcacagcccaggaaaattctgtttcaaaccactattaaaatctcatgctactgaatctgagtaggtggagttcagtttgtatctagacccttctctgcagaagagcctgggaagtagaacattagccttaaaacctctgcagcacaggaacacgttaggagagcactgagactctcactgccaattaaccacatccacctagctgacgcagtttcatttttaaatatttatttatttatttatttatttagagatggggtcttgctttgtcacccaggctggagtgcagtggtgcaatctcagctcactacaacttctacctcccaggttcaagcattctcctgcctcagcctcccaagtagctgggtctactggcactagccatcacacctggctggttgtttaatttttttagaaacggggtcttgctgtgttgcccaggccagtctcaaacttttggacttgggtgttcctcccatctcagcgtcccaaaggctggaattacagacatgagccaccatgcccagcctgttgttttaaatgacatgctactatcattgtagaaaatttggcgaacttatagaacaaaataaaattattcataactccagaacccagcaacaaccagtatttacacacacacacacacacacacacacacacacaagttggagtcatgctatgttcatatatttgcatcctgattatttcaacattatttttcgtacaatagggattttccctggtgtgaattttattatcaatattttaatgagtgtaaaacatttcattgtagattgtattctgttttctctcaattttggacatccatgctctttctctttttttcacattttaagtatcagtgttgtgagacatccttaaatataatatttatcttaaaaattgttaaatattcagcaatctttttacttccatggagcagtatttaatgtaaccagatgcccatactttcccataggaaaagccttgatctacatacatatttttagatgaagtgatattcgcatatgatatacttaaatagtaatgtgtaatgaattagtattttgaattttcgttggctttactcttcaaatactaatcttgctgtctgcgttttatgctgtttgtattttagtctgagagctcatatataaatatgattagatggcattttattttcagttataaaaagcctcctcatcttttcaatattcagaaggaaggaaagcatacttgctgcttaggtacaaagcattcaatttatttatttctgttaagcccaggagagcttacctatggtctcatgctttaagatgttataaattcttatgagtctgtagtggttcaggttttctgtataaaattgtagaaataaattagttgtgcattcatagccctctgatttagtgatctctagtggttaaaataagttaacattcttaaataactcatctacatagttaagtggtttatattcttccaagttaaatgagcagagtaaattattttagaataatgttaccaatcaattaaaatcttgtttctaagcaggaaagttgtattctgatatgttagagcaccatcatgtcaaactctctcctttggttcaaaatcacaaacgagaggtggagtcttccttgttgaaatagtggtcataatctcattccactattagcttagtgggcagagtgtacagatgatgatgatactcagttgcttgagggcctgaagaggccgagggtcccataggcttctgaatttcttaaaatatttcatgttttcatttggaagtgagatggagagggtaagggagttgtggcttttttcaaagttatttgaaatactcacctttgtgtccagtattttgtggctgactaccttttccaactgttttagggaacattttgctcatactttgtgtggaaagtttcttgctagaggctgtattttcatttgagagttaacatgtggttaatattttatcctgaggaagagtatttcaatcggtgtgaatacttaaatcatcttgccacctctttggtcttccttattaagtcagtgttgctgtgaataaagaggccagctagtctgtggagagcatgtgatttatcccatcaagaaagatgtaatgagctcttagaagaatctgctttccatgcagtgccggggataaggactgtggactatttcactgtgcagttgctacaagccattgttccttccctctaaataatgagtggcattgtttttgtaaatgatatttccccctaaacaattaacataggtagacttagtataaaaaccaggtccggacaagtttccaaaagagattctcacctgattagggaaaggggaagaaagtaataaagggaacctattgcattggcatcattagcttccttttcttttgattttttaaatggagaccttgcaatgtttcttaccccttgggtttattatttctgtttggtttagttgcttagcatgtttgctatctttccaatacccccgatacacacaaccacttgtaagagatgctttcttagttatgtctttgtcatctcgcttttctttctattagaagggtgagatgttttgtctaagtttaggaaattatttttataaacatttttgaagtatttttcaaggttccccaacccccttttttttccctgatagtaatacagcttgctctttgcatatgtacggtaatgaagggtatatagaagcagggaaatgccatcaggcttctgtgtccatgggttctgcatccacggattcaaccaagattagattgaaaatatttggaacaacaacaaaaaaacaatggttgtgtctgtactgaacacgtagaaacttttctttgtcctaatttcctatataatgcagaataacaactatttacacaaagcattttctttgtaataggtcatataagtcatctagagatcatttaaactatatgggaggatgtgcatgggttatgtgcagtagtccaccattttatgtaagagacttcagcatctatggattttggtatctgcaaggggttctggaaccagtcccccatggatactgagggatgattgtaatttgaaattttgaagatgagtagtaatgacattttgatgtattaacttcaggacttctgtggagcatggctctatacagatgttggctattcttattaccagggggaaccatccaagtatagtttaatttcctgcaatgtttccaatttctgctgtattgagagaattttcctatgcctcataaatatggatagtttacataatgttatattatgtgttgagttcttatagttaatgtttaactttatttgatggttttttctgttgtatgacatttatatttttgccaattttgtttgcttttataagtaacctttagaagtacccttcagagaatgtccttatttatcaatttatgttggcatctctgattattttctttgactagattcctccagtagacttatttggtaaggagatgaacatttttaaagctattagtaattgtttcacataaattctaggctaataaagtatgaagtagttaggatgtataaaatgctctgagaagtcctagataaataggataggagtgaggcttgagggtggtggtgaaggaaacaagcagctggtactattcctgagttccagaacttactgtcttactagatagcttaaaggttctacatgggtgtgcatcagaattacctgtagacttccaagagctgaaacacaggcattactcacaccaacagattcctttacccactccagaaaatttgtgtgcttccttaaagctcttctgtggttttcagggctcggtcttttttttttttttcccgcaggacctcgggtctagctgaaaacaaagtatggttacattttaagggagagcaaataggaatatagtcatgccttgcttaatgacagagatacatcctgagaattgcattgttaggcgatttcatccttgtgtgaacatcatagagtgcacttacacaaacctagatggtgtagcctacaacacacctaggttacatggtatatcctgttcttctaggctggaaacctatatagcatgtagctatactgaatacacagctgggacacaatgcattcatatttagatatttgtgtatccaacatatctaaacatagaagaagtatagtaaaaatacaggattttaatcttatgtgatcaccattatatatgtggtccattgacgttgttatggggtgcatgactgtataatgttttttttgagatatcttttgtttaagcgaatgcagactagaatctagtacatttgctgtatttgggtttgtgacatttcacttcctctcatacttagattgcacaaatttatcattttcaaatgaaaaattaattttgagtcttttaaaagtcctacaactcatttaatattggatgttgactatcaatacaaaaatataactgaaaatatctttctagatagaagccttaatgaaaacaatgtttctgtctactgtttctgtgtgttccttcattcctttcaaaacccctttgtttcttttccttcccttccttttccccttcccctcccctcccctcccctccccttccccttccccttcccattcccattcctttccctttccccttccctttcccctcccctttcttgttctgttccccttcctcttcccccttccccttcctcttccctttcccttcctttccccttccccttccccttttctttcccttcccctttccttccccttctctttcctttcccttttccttcctccccttcccctttcccttccccttctctttcccttttcctttccttttcttccccttcactttcccattcctttcctcttcccttccctttccctccccttcccctcccccttccctttcctccccttcccctcctcgttccctttcctacccttcccctccccattctctttcctccccttccccttccctgcttctcccttccccccttctcttccctctccccttccctcccattccctcccctctcccctcctctccccctttctcctccctttcccttccccttctctttcctcttccctttccgttttccttttccttttcttttgccactgtctggctctgctttattgcccaggctggagttcagtgcatggcttactgcagtttcaactttatgggttcaagtgatcctcccatctcagcccatgaagtagcttggactacaagcatgggccaccccacccagctattttttttttaagagatggggtctcactatgttgcccaggctgatcttgaactcctgggctcaagtgatcctcccatcttggcctcccaatgtgtttggattacaggcctgagccactgcgcctgcaccagtttgacttcttgatttctgcttctcctcattcattctttctaatttacaaggccaactgtcatattagtaaatttgaaaacactattttatttctaaattacgtttttaaaagtttattttatttttttccctttatgttctgttggatttgaagaagattattttaaaccacaaaatacacttgaccagttggctgctgagaagaagttgtttatcgtttggttatttgtgagccaagcatagcttccagcattatggtaaccatccaaaagcttaaaggatgagctgagatagttctttagaatcacatgtcctctgtgacagacctgtagctctctttaattttctgcggcattagtttcaagggagatccagctgagaacagactttaaactattctgctgcaacattttgtatttcctgttagaggtctctataactataaattttacccttctattttgcatattaaaatatcttatttgaatgcagcacattttcgaactttcagtcagtatggttataatcatttctacaataggctgggctcactgagttattgataacctagtctcatctttttctatgctacattaggaatacagtctgccttcatatgctttaaatattttgtgttcaaagtgataaaatcctaaggtgttattgataaaattttggagcttggatgcgatatttttagagttcacaaaccactgcaggagtataaatcctgaataaagtcagaagccttcttgtgtgcccttaaagttacatacatcacagagggaaatgaatatgttatacctgattgtcttgacttaggggagagaaccaggaagtatcattgattaaattatatagaacaaaattttgcgtagtctatatacattgaaaaaatattttaatctcatttgatctcatttcatctttttatttatttatttatttttcttgagatggagtctcactctgtcgcccaggctggaatgcagtggtgtgatctcagctcactgcaacctctgcctcctgggttcaagcgaaactcctgcctcagcccccccagtagctgggattacaggcgcccactaccacacccggctaattttttgtatttttagtagagccagggtttcaccgtgttggccaggctggtctcgaactcctgacttcaggtgatccacccgcctcggcctcccaaagtgctgggattacaggcatcagccaccatgcctggcttcatctttttaagctagtttctatttttaattttttataattcagcttataagcctacctgttttgagttgtgaagttagatctagtcccttcaggtcctgttattaacaagaagagtatcagatggattgctgcaactggagcacctgtttgcattctaaggactttaaacatcctttcttttaattttgcatatattcctgctcctgttatgatctgggctgcctttggagaaatgtgttccagtcagtgtttctcgaaatttggtagtagaagtggtttccatctattttacctataagccaaatctgttttcttggttttaatattttcactaatgataacaaagttgtttttgaatacttgctattcctaggcattatgccatgcttggtatgttacatgttatatatcatttaattatacctataccagaagtgtaggtactgttgctgtacccattttatttttatttttatttttatttttttgagacgagtctggctgtgtcgcccaggccggagtgcagtggtgtgatcttggctcactgcaagctctgcctcccaggttcatgccattctcctgcctcagcctcccgagtagctgggactacaggtgcctgccaccacacccggctaattttttgtatttttagtagagacggggtttcaccgtgttagtcaggatggtctcgatctcctgacctcgttatccacccgcctcggcctcccaaagtgctgggattacaggtgtgagcccccgcgcccggccttgtacctattttattggtgagcaagtagagccctggagagtttaaatagctcacctaatagttcaaccagctgttaaatgttacacctaatagttcaaccagctgttaaatgataaagttgtgatataaatgtgctgaattctcttggctgggtacttgcacttttgtatttaatttttattggggcatcttgttgcaatatctgttttatttcgactttagttagattgtgtttttttggggggaaggggagagtaaggtttcaatagacgttactcaaattccctgaatcacattttctaaaattgtagtttttagccatgaatggaggacagaaatagtttccttgaatattaatatcctttttagagaacatgctttttctgctaatggggtggtagagaggaactcagttctttagaagtttgtgccatccatttctttactctaaatgcttcccatgtggcaatgtaattctccacaaaagtcattacttatgagaaacaatatgtaggataagattatgataaatgaaaataagcactttctacattaagataaaaagtatctgtggagacagtgtacctgaggaggcactttcacaattaaggggaaagctaaggtagactgtacctagggactttcacagaaattacccaattcttctacgcatccatccagtccattggagtttggattgtgggctgaaaaatggaagaaagtggtaattatcttacattgtcagactagttatatgtgatttaaatctcttcattttcaaattgtagtaatttatttaaatatatatgtatatatacattcgtttttaaattcagacgaaaaatatttagataaatataaaatatttatgatgcacatctaaataatgtataagactgtaggtattttggaattaggcaaccactataagtattttactatctctccctttctgtctagcatctgttcccttctttttgtattgtgcatagtattcttgatgcaaaatgctattgttacttataattttagttttggagcatacatatttagagtggagcatttttgaaagaaaatgagggccgggtgtggtggctcacgcctgtaatcccagcactttgggaggccgaggcgggcggatcacgaggtcaggaggttgagaccatcctggctaacacggtgaaaccccgcctctactaaaaatacaaaaaaaaaaattagctgggcatggtggtgggcgcctgtagtcccagctgtgctggaggctgaggctggaggatggcgtgaacccgggatgcggtgcttgcagtgagccgagatcacgccactgcactccagcctgggccacagagcgagactccgtctcaaaaaaaaaagaaagaaaatgaaatgttgttgcgtatttcttgccttcaaagttaagcactttctaaaatgtttttaaattgtttcagtataaatttgtttttcagagttaagcagcttttagtcaaatgttgctcctcatgtttagtgtagtgtaagaaagtgagtcaagatcttcaagatttaattgaacccgaaatatttatttatttattctttcacacactcacccttcttgttttaaggagtataggtcaaaaatggtggtcccgtgttctccattcctgcccactgctgatagtggaatgctggtggctctaggggaattcaggggccatgttggcccttatgaaatactgtgcaggaaagcaagtggaggctgtggttcatgcggctttcctttaggctctgtccttcagttcctcagagtctaagagtggacaacatttttgtaattttttataaacgttaaacttccctcatctatttcctcctcacctctttctgcatgttttcccaggataaagaagataatctaagttatacctggaaagagattttctcttgttttgagagaggatctctctctgttgcccagactggattgcagtggtccagctgttgctcactacagtctcaagctcctggaattaatcagatctttgttttgtaaaataatttgaggctgggcacagtggctcacacctgtaatctcagcactttgggaggccaagatgggaggatttctcgaggccaggagcttgagaccagcctgagcaacatagtaagactcagtctctacaaaaaattaaaaaattagccatgtgtggtgatgtgtgcctatagtctcagctattcggaaggctgaggtgggaggatcacttgagctggggaggttgaggcttcagtgagctatgattgtgcttctgcactccagcctgggtgacagagtgagaccctgtctccccaaaaaataaataaaaaattaaaacaaaattaaaaaattattttaagaatgaaatgagacaattttaaagccaacattttacgtatgattattcgtaacactgtatagtatttcttagtgaaccaaccatctctatgaaaatataatttgtgatcaaatatatcatcattttgaattcaagaactaccttcccatgtgatgggatgcttgtgtagcagtgactagatatcagaaatttttgtcattagccacctaaactatggttccatgttagattaagaatgagaagttggaaattttattactcaggattgagtagaggctaggctggtggtgcatacctataattccatactttgggaggcttaggcaggaggatcttttgaacccaggagtttaagaccagcctcggcaatatagtgagactttgtctctccaaaaagttaaaaaattagctgagtgtgttggcttgcacccgtagtcttaggtacttgggagtctgagatgggaggatcgcttgagcccgggaggtggaggttgcagtgagccaagattgtgccattgctctccaacctggatgacagagtgagaccctgtctcaaaaaaagaaaaaggaaattgagtgagtagaatttgggcattgaggtgggtaggtgtaaccatgagaatgggttgtcatcctcatctccacaatttatttgttatcacttctccagatccctgtttcttctttcagtcagtaagaggttaacctagctgttgtctagcttcttccttccagctttaaaatgctgtatccaaaatttttcatggcttccttctctgtcaaagtggattaggaacagctgagaaaattggttcaaacgagcatcctggatgtggttgagttttgctggtctttctcttctccttggattccctggttggctctctggacagatccagtggcttcagagaaatccgcgcccgttttagtttgatcagacctgcatctccaggagagatttttgaccaatcctttttcatattggatccctttatgttcatagcctgatacagatccatactcctgtgattatttttcttgtttgataagaccgttaacaagatactggccagttacaggttatgacttaaaactaaaatgtcatgcttctgattttgtcagtgtatcaacttgaagggtttgctgccatgacaggaattgtatttggaaacttagttgtaattttcaaattctttctaatatagaaattcttctatattagaattccactgtgaaaattttttggcatattcagaattcttgagttcctcaccaaattaaatgaattttattatctagaagatactgagtatgtatcagaatgactagaaaagatattatcaaatgtgaagaatgatatagttcatttttcaggtcagaatgagttttaagaactatggataatacctttaacatttcaaaggaaaaatcctagtaaaaatttgatatatatgttaggatattttattttgtatattgttaatttgttggatagttaatttgcttggaaaaattattttcaaatttttttacttactcctgttcaaaactttaactcagttgaaaaagaaaattggccaggcacggtggctcacgcctgtaatcctagcactttgggaggccgaggtgagcggatcgcctgaggtcaggagttcaagaccagtctgccgaacatggtgaaaccctgtctctactaaaaatacaaaaaattagccaggcatgatggtgggtgcctgtaatcccagctactcgggaggctgaggcaggagaatcgtttgaaccagggagacggaggttgtggtgagccgagattgagccactgcactccagcctgggccacaagagcaaaacttcgtctcagaaaaaaaagaaaattgacatttaaaaatgaaatattacttaagtaatttgagctaaagaggtgctgcaatacgtcttttggcattcaaaatctctggattctgaccagtgtttctggttgcagactccaccatagtttagcaaactattaattatcactaatgatcccgatgtggttgttttgacaaaaatgtatggatgtttgagtttcctctttgtcttgccatagttctgttataaaaactttataaacacatactctttcatttgtcttttccatacctctcattaatagttattaagaatgtgggggaaacctgttagcaaaaaggaaaagtaagatgtatacatgtaccagtgctgattatgtgctggatactggcttaggaattacagataatataggaacagattacttggcctcagttctacaacattaggcattacacataggaagttggtttgcatggatttcaaatattgctttttagttggttcattatacttaggaatagacatgcacctagggtaaatgataatgaatactgtgtttggaataaaattctgggtttccttatttaaaaaaaagtcttaataggcatttagtttattattccaataggaactgccaaaattttctgccttcatttacaagttggtgattaagcctgcgttttgtgtgtgtgagtcattttatttcacccttatctgtctcttttttctgtttttatttattttttagaagatgaataaataaattgttgccgaggctccagcctcggcaacagagcgagactgtctcaaaaaaaatcattctaagccatcattattaattttacttcagtctcctaatttcagattagatatcctgaaaatagttccctttgttttttgtgtatcatttcctggagaaataattaagcagaacattgaattctcttttaccataattgcagagctgaaaaatgtgggaaatgtaaaatcttaacatcacacgggaatatttgaaaccatatgatgcatagaggttctgaatgaaatgtatatgcattgagtattttgtatttcaaaatatgctatgatttctcataattcttaaaaaaaatgagatttttgcactgaaacgaggtggaaacatagttgggtttcctgtgccaacacagaaatgtttatgacttctataatgcttatgaaaccccagttctgacttctgcaacagagggatatagtcttgccaagaaatctgaccatcagctaaatagctgtttctgggagataaagcttggagttgcagcttagtatgccgggaatgagcctctatctcaaggcattgggtgggctctatatagttttcctgaattgtaataagcttggggagggctaaggtgggagaagacacttactttccttaccctgaaagagattttctccatagccaggataccgctaccagggagcagcaaattaatatgcatttcccagccggagtggctttttgacacctgatgctgtggcagtacatttagatgataaggaagatccctgatcacagcaggaacatctgtttttccctggcaagaaggaaaatttcccacctcgcacaaagctgagcagctatttggggcagcctcataagtggaggattaaagttataatttaaaaacgggagagtaatttcttatggcatttttttttgtataatcttttaaataaagtcataactctaacaaattaatttatgccattagtaagttttataatcattagaattatgtatatttgatttaaaatttttgatttatagttataatttgattcataagtgagcatatatagtcttgaatagattggttacgagtgccatattttaacaattatttatgctaaagcaaatattttcaaattgaaaatagagtgcatgatgtatatttcagtggacagtggtatctagtataaattgtgttgtagaaaatatttaatacattgtatgctgcgatgtttatggatatctttccatcataaatacagatacacagctttacaggcctacagtccttgtatgcacttgatacacattgtatgcagtagacggtgaactagatttgtggccagacttcaggactgggaggaagaaacatgactgaaacgctagtaggacctgcatgatgctgtcaaaaatataacaaatatgttgataggaattaataatgtattttaaaaattcttcaactgattgataataattcaagattgctgtaaataactgcacttttcatacattatacataagtcaatatatggattcatcattgattttacatgaattaggaaaattcctttgttatgagagtgaacgttagttttagttttattatccatgaactcaaagttgattccacaaatataaaattgtaaaattcttcaagtgcagtggaaaagtgcagaccttgccatcttcagccattctttctcttagtctgattattgtatgttgctgtgctgcaggtactgcatgtcataattgacttacatggagaaacagtgtactgttttttctatgcatttggaaataatcacatttgccacagacatcatatgctgtaggtgtgacaggaagttgaaataggcatataacagtggtatacatcttttagtataaatctaaaaatacagtgattacatttcactgaaaatacattttactaaagtttatcttaatgcctctttgaagcattccctaaacaatttttaaaacaacttatcaaaatgttcttttaaaattccaggattttgaaaccatgtgaaatagggaacataaaaaatattcatgaaaaagtcatccacattggtgtaagccactgtgctgagtgcttgggtttaaaggtgaatgatgatctgcccaggcttccctgtaagattagaaatagcaatttttaaaattagctaaattataagttagaaccatagttaaagtaaaattagaacagagtggtaacaaaaagcatggcatgattagttctattgagaatcagggaatgcttcttagaaaatagcgtttgaactgggctttgaagaatgttcagtatttctatagaagaaatgatgttggaagtacaggtctcaaaaaaagcaagaatgaaggtgaagaagtttgtgtggtacagtaagcaccattgtctgaaattccctctggtctacctatagtgtttgctggaggtttgatgtgatccaacatatgttttaggaaactcctgtgccagaaagtggtgcagaacattgttagagaggatatggccagagcctgtgtccagttagaaggccactgttaaaatttcaggtaagagacaagttgatcctgaactaggtttatggccgaggaccaaaatcagcaaaaatgttgtatcaataagacttagaagctgtggagatcaaagagggaggaaagagagtaaagctaattctaaatgttttagggaatggtgcctgagtcaaaatagggagctcagtttcgaggtatctttgggacctcttgttggaaactgagatcatgaattcaggaaacagtttcgttttcgtgacttgtgcttaaaagttgtcagggtaggacgtggtgaaattgtgcactttttgagcttgtccagagagataataatcagcagtccatagcgccaacaagaccatttacgggaagaggaaaaatggcatagattcaggaaggagcagaggggtgggtaccagtagcatactggactccagacaccaaaaggtgagagttgtgtggagcctgagctcttcatttcaaaagtagatctttttcttttcaagtgatattttgtcactatgcaaatatccagttatctatcaactcttaacataatagttttagtatgattatctttgcctgaattatttcattaggagttgaaaatggtcatatttctaattctgttattagttctatttccattatttggcattcttctgaaaagacaggtttcccctcatgaactggtactgttgatttctctgaaatacagttcctactgaaaagagagggtagatttttaaaaatacttttgggttaattattcattctctaagtaagcagttggtgtaataatcacctcaaatggtgggaaatgagtatgaaagcctggtccctagtcaatgatagcctcaatttttatttttgacataaaagttatacttgcatttcagtgtactttaattcctccttctctttgtcgacacataaggttctgtcactaataaataaagttctgtcattaacaagtctaccctttatgacttatctgaatttcttattagtataagaaagtcttatcagaataagcttatcaatgtatctatggactatcatatgaaacggtatttcctttccttttttctgaagcttaagttttaaggagagactcttagtatcttgagatacggtgaaccttagtttctagtttgcttccttagttagtttttgtccatgtcttctccttaccatttctattaaaaaaaaaaaaaaaacttgctgctaaagtttcatcttgctactgagtttttaaagattttgtttcttgcaggttaattcttaaagtttatgaagtttcatgtcaaagtttatgttggtaaatgtttatcaatttccttttgtttgaacatatgtcccaatatttacataaacccaatactatcaattcatttttaagttttattccctgatggaactcatgaaggaagagcaaatagtatcctgatctataactaagttttatacattgcaaacctattatattgcacttttttgtttctgtgtttgtattgggtgttcatatagtttagcacatgaagagtaagtatcaatcacacatgtaatacttatagccagattactcttaacagtgttactaaggataatatgccagtacttcttctaacttggtgtactgagttaagtggatccaactgaaggtaatattttactttgttcttataggagatgatttagatttcgtctttgaactaaaaagtttgactcccctagtttatcctagctttctcatttcttttcagaacattgaaatgaggttttacagctcataagccaaaggaagttattataattttttatctgaaagaaatatcacgtagcatttggttgttctggggagtattaaaaacttagttgataaatatttatgtaaagacatcgcttgttatatccatgtcacagtgaacaattacgtatctgttatgtaacaaataatagtgataggccagttttttcccctgatgtttgagttaatgctgactgctatcttgtgaagtaggtaatagaaacagcctgaataatctaaatctcttatccaaaaatcacaaaaccataaggctttgaagaaagggcaaatttattaatcttccttatttttagcatttctgatgaattaagatggtacctcataatttaattatgagactggaaagaagggaaaatgccacagttgagagagagtgaaagtcttgtatagaagtacttttcactttttggtgtacgtacttggtttaggtgattgatttgggtaggagtgcaaagtgtagtgttttgtctgttgtgtgccgtgtgtgtgccacccttcctgctgtaattattagacttgcctgtcctcggcacatggttataattccgaggtctaatctgggtggaatgtcctcaatcagctattttgtataggattggaaagatgttttaaatatgtagaatcatttttctgctacttttgaaaaaccaggtgcattactgatttgcaaggtctggttttttacaagacacctttttgtttctttttgaatagaaagatgaaaactacagaagcctcccgcgggatactagtaactggtctaaccaatttcagagagacaatgctcgctcgtctctgagtgccagtcacccaatggtgggcaagtggctggagaaacaagaacaggtaacatgacaaatccttatatgtgcgtcattgctgtaacatcctgtcccataccccaaagatgtttctcccatctcaatcactggtgatgattaaaagttaattattctaacaaactttagttaagtaccaatctctatgtcagagtttatctaacataaatgcaggatatttctggctggtctctgatcacagatttattgtgagcagttatgaatatttgcagtacattctgaaggttcagggctttagagtttgtaatgctacagaggcacagatgtttggcagtgaatcatgctgttagtgagtagactttcaagactcttctcttctttaataggcagtaagtccaaggatctgaagacgcaaattaaaactttctgttgtacctaacttcactgtatgagagaaatatatcctatggtgttgttttagaatttagattacggtattttgtcatgtttgggcacttatcccttcataaatttcaaggacctattttaggtttatcagtctttagagttatctgtttcactgtgcagtgcagccacctacaattcgtgaaatcagaattgtttaccactcagaaataattgttttctgccttgggaagaatgactatttacaaagttgttgcatcacttagcaaagtcctcctttcatatggaagactcagaatgtatctgatgagttacttttttttttccactttttttttatactttaagttttagggtacatgtgcacaatgtgcagatttgttacatatgtatacatgtgccatgttggtgtgctgcacccattaactcgtcatttagcgttaggtatatctcctaatgctttccctcccccctccccccacctccaatgagttaattatttcagtgttttttttttaatgcttcagttgtttttattgactcacaatgggttttttgtagtagggaatcccagtgttttataattttaattgtgctttcttccagctttattgaagtataattgacagataaaaatagtatatatttaaagggtacagtatgaggtttttatatatgtatatattaatacaatgattaccacaatcaagataatttatctgccgggtgcggtggcccactcctgtaatcccagcactttgggaggctgaggtgggtggatcacgaggtcaggagatcgagaccatcctggctaacatggtgaaaccctgtctcaactaaaaatacaaaaaatagccgggcgtggtggcgggcacctgtagttccagctactggggaggctgaggcaggagaatggcgtgaacccgggaggcagagcttgcagtgagccgagatcacgccactgcactctagcctgggcgacagagtgagactctctctcaaaaaaaaaaaaaaaaaagataatttatccatcacattacatagatataattttgtgtgtatgtgtggtgaaaacacttgagatctattctgttggcaaattttttaaaatttaatttaatttaatttttttgagataaggtcttgctctgtcacccaggctggagtgcagtggtgcaaccatagctcactgcagcctcgaacttctaggctcaagtgttctcttacctcatcctccctggtagctaggactatacatgtacaccaccatgcccagctaattaaaaaaaaatgttttattttgtggagacggtctccctttgctatccaggctagtcttgaactcctggcctcaagcaatcctactgtcttggcctcccaaagtgtcatggttataggcatgagccactgtgcctagcttcttagcaaatttcaagtataaaatatgtttattagactcacctaatgctatacgttaggtctccagagttcattcatcttacaattgaaagtttttaccctatggccaatatttttcctttttccacacccaactccctgtggtaactgccatcgtactctgttagcatgagttcatttttttttttttccaagattccacttataagtaaaatcgtacagattttgtctttctgtgtttggcttatttcttttagcataatgccctttaggttcatccatgttgtcacaaatgtcagaatgtccttttttattaaaggctgaataatattccattttatacatttatgtgtacacacacacacacacacacacacacacacgcagtgtatatcacattttctttatccattcatcggttgcaggtcacttaggttgtttccatatcttggctattgtgaatttatgcttctgtgtacatggaattgcaaatatgtctttgatatagtgattttatttatcatggatatatatgcagaagcagaattgctggatcatatggtagttctatttttttaagtttttgaggagacttcttactgtttcatagaggctgtcctaatttacattaccaccagcagtataccagggtttccttctcttcgcatccttgttatcactttcattttgacttttttttctttctttcttttgagacagagtcttgctgtgtcgctcaagctggagtgcagtggtgcgatctcggttcaccacaacctctgcctcctgggttcaagcaattcccctgcctcagcctcctgggtagctgggattacaggtgcccaccaccacgcccagctaatttttttttgtatttttagtagagacggggtttcatcatgttggtcaaggtggtcttgatctattgacctcatgatctgcccgcctcggcctttcaaagtgctgggattgcaggtgtgagccacagcaactggccctttttttttttttttttttttttttttttttttttttttgagacgcagtcttgctctgttgcccaggctagagtgcagtggcacaatctcagcttactgcagcttctacctcctgggttcaagcagttctgctgtctcagtctccaaagtaactgggattacaggcacacaccaccatgcccagttaattttttgtgtttttagtacagatggggtttcaccatgttggccagggtggcctcaaactgctgacctcaagtgatacacctgcctcagcctcccaaagtgctgatctcaggcgtgagccactctacccggctgtattttgatgttttgataacagccatcctaccagtgtgaggtgatgtcctaccttgcttttgatttacatttccctggtgatgagtgatgctgatcatttttcagtgcttttaataaaaagccacgtgtttgtttagttggtcacttattttctttaaaaagtttatatggatagaaagcaaggtgggtactcagagagggtttagttgctttattaatttttaaaattattaatgattttgttgactaaatgctggaataaattgtttttcaatttagattaatgacagctgtagaaagaaatcataaatgttttacatatttcatctcagcctatgttttatggtataaagatcctaaagtaatttcatggatgtagggtattaaaatatgaaacagcaaaaagggacagcttgccttgcacaccgtgatggcacaggaaatgtcctaattttgtcatatattaagtgttagcatacaaacattgtgtgatggaaataattttaaataataaaacagccatggcagttctatgaaggaaacataattttctcaacataattcggatttttaaactaattgatattagtatcttattattactttgaaataaatgtttttaagatttagatagtttctcatggacccagaagtcagactgactggttactagctgtttaccatatatgagatttgggcacattactctacttgtccatacatcagtttactcatccagcaaatagggataattgtagaccttgtctcaggggttgccgtgtcaagtgatacaatacccgccaaaggcttagaatcagggctggtacctagaaatactcaacgtattaatataataggacaggtaacagacaacctggaatctagaatgaggaaatgtttggcatatatgtagcaggaagtctggagctagggaatatgtgggagttaactctgtagcttagcaacctcactcacattttttcagggagccttcctgaaggccaccttagctctgtgctctagcttgtccttttctttcagagccacatccttgcacagaggaaggggaacagggcctttgtcttctttttgtggctctttgtaaaagcaaatacatttttcctaataacctcctgacagatccctgatcatgtttgttggctggaattgccctactcttctgcccatatcaaaatcaaagggagtaaaagcaccagtataggttttgatggatagagcttgacccctggaactggggctgcggtgggagctcccttctttaccttccctgaaacacagtttcccatcacttcacacagtcagatctgttaagcaagggatatgtgggcagggatggggagtgacgaccagaagttggttgagtaagctaaataggactttttttttttttaaatactgcaaaattggtagaaaaagattggtagcccagagcttctaaaatatgatacagcttaattatatcataaagatataacttttatgattctactgtcattgtagacctgtttttaaggaagtagtatattctttgtaattttgttataaaatagtttctttttaagcaaaagggatggcattgagaagccacacacaccaaagaccgagctttgatttgcttctgttgaagttatttgagttagttgtctatgtggactgagaaggtacctaagtctaaaaacatcttctttggcataagtgtaaaaaaatgatgttccattcctgaaatttgatttgagtgaaactgtatactagaagagtagaagccactgatgttttcacatccagcagaataattgattaaactaaaatctgttgaagaggacaagaaccacagaaacaaaacaaaactccctctcaaattttttcagaagtaagcactattgtttgtgcagaagaggaatcttaggttatgctttatacactagaaatctattccaattattcccatttaattatggatttattctgttaaccattcccggaaagtcatctgactttaatgacctgatgtctcttctgaggctttctttttctctttagtttttgctattaaacatataataaagaggattgcatcatgtacatgaaaaaatattttgtatgcttaaaaaaaaaaatcctctgcctttccaatttgggaacaccagggtagaactgatggccatcttcctttagtcgtgtggtctggagtgaggtcagcagagttctagattttatgtgcctccagtggttttgtttttgctctgttttctacttaatgcttatctctcattatctgtttctgaaggcagttatgaccttatcagcttttccagtgggaataagcagaaggaatggaaaggcaaaagagtgctttaaagtgctaagctagctggcccctctagaagtctggggtgtcttattctttgggtggtattggtcctacttacggggatagtgaatcttctttctataagaatattggttagttttacttcaataagaaaagataggttgtatgtcttattagaagtctgtagcagcaagcacaatatgatttccaaaaagagtagccggggttttcagtgactaatcaccttgttcagaatagcccatagctgaatcctacatcagagtcatctcacaagttatgcttctgaaattttgactctgacactcaagaaacaaacgaacaaaaaacaacagcacttttagttttgatgtttgacagtgttttaagaagttcaaattcctttttaatggtaactgtttccctgactcagcatagaatatagtttgatattggcagataatagatcataagctgactttgttcttatattcccacactttattgcaactaataaattccacagaagaggcagcagggactttgtgatacatgactggaagaatttaggaccagaaggtagagggaccttaaggaaaacataagctaattgggagcctgccattttcacaaccttctcttgttgaataggcctgagcccaattagcagaaacagcagagaggcacaaggcacattccagccactgcttaagctctgttataggggaatgactgccctgacctttagagcaaaatccatgttttttccatgttttagggctctctccatcaagaaaaacatcttttaattggagattatacaaacaggcaaactggagggaaaactgacttaaatgtttgttgatgaagacaaaatgccgatgtctacgtcattttcatacctttggcagctacaaaagaatcccaccatccagtgtcaagtctcaaagtctcagaggccagagttttgggagcaatgatgataccttttttcctttttattttatatacctttgtcactttctgcagctgtgatgctttttctttatacttttcagaatatttatgcattataaacaatattcacatgatacatgttgtggtttggctgtgtccccacccaaatctcatcttgaattgtaactcccacaatttccacgtattgtgggagggtcctggtgggaggtaattgaatcatgggggcaggcaggtctttcccatgctgttctcatgatagtaagtctcatgaactctgatgattttaaaaatgggaatttccctgctcgagctctttctttgcctgccgccatccatgtaagatgtgactttctcctccctgccttccacaatgattgtgaggcctccctagccgcatggaactgtaacatgtccattaaacctcttccttttgtaaattgcccagtctcgggtatgtatttatcagcagcatgagaacggactaatacaatacacaatatataagttatattcaaaaattatttgagaaggtaagtttctatgagtttaattttttgttttcattataatttacagccaaattcttgaagattgagggcaaaagtaaatttaaaaactagtgaagaaacatttttcagcatatccaggttttatggaggcagttttttaaaaatgtgtttttctccaggctagtcaatataattgtggacgcaagttttgcctaggttttagcttgttcttataaaatggtgggtgtctgggatgatcaacctgtggttcctgtgtccacacgacttaccagagttgttttttttccactgatctgcctacatagaagaaaatccccttccttgcccaagtgcttactagccttttctaagtgaaaaaaaaaaatctcatttccctgagatctagaactatccagatgacataaagaagatgttttctggagtatgaaatgataatgttttcttatcttttttctgttttaatctttaagaggctgggttcttgctctgttgcccagactggggtgcagtggtgcagtcatagctcacttcagcttcaaacttctgtgctcaagcaatcgtcctgctttagccttctgagcagctgggactactgatgcacaccatcactcctggctaattaaaaaaatttttttgtacaggtggggtcccgctatgtttcccagactggtctcaaactcctggcttcaagtgattctcctgctttagcctcccgaagtactgggattacaggtgtgagccatgatgcctgtattttctttctttctttttttttaacgaatgtgaggccttttaaatgttgcccaggttggcctcgaatgcgtagcctcgcctccttgtgcgccaggacaaccggcctgagccaccggggctcccctcagtgcctatattttcttaattacaataggaggtggtttattcagcaatctgattacaacaacttcagatcggtcagggaaatgactgaggggtcacagcattaaaccgtggaagagctatagaaagtctgatataggaatagatagggcttcatggtatctgccatcattggtgagacttaaggatagattctgatgctgccagatagtagttaagatgtgggttttttgggtttgttaattctgtagcgtgaagtcaatgaggatccaaatgactgttcatattatttggttaaaaataaactaagccctttgcctccaaattctaaaagttctgtggaaaggaagggatttattattatttaccagttggcaaaccttcataaaatttgtagagaagcaaaatagtcgtgtttatctctagcaacaccaaatgtagaaactaaaaacatcaagattgttttaaaattaaacttacttttcattataaaataccagaacttctattttataagataaatctgttatgtccccaataacacccaaaataaaaccaaaacaaccttttaagagacttgttacctggatatattaacgccagtagcagattattttgttgtgctttgataatagaatccctggtattctaacacgtgttaaaattattttttaaaaaaacaatgatcaaaacaccctatatgtatgggacacattattttccatgatccctacatattttctgcttttattatccaagaattctggactagaaaccacagtggaagcacaggaccggagtgtggggctctggtggacgttcttcttagaaggacacacacattttctggggagcttccagtcatgtgcagggttacttttaggagtaccagatggcattctacttttccatatatttaacaacaaaagacatagtgaatctgggaagcatgtttcagggttggaaacctgtccctccaatgagtgtgtcctgtttctgacccctaagactggttatatagaaataaagaaagataaactatgcaaacttcattttcattgtatacaaaatggggaaaatcatacccatttggcagatgttaactttgtgggcaaagctgaagtgacacagcacacattccagtgcagacccagtttcttgtatattaaagacactcataagatgttttctttcatatctttttaggtaacattaggtttattggttatacctcaacaactccctcaagtattgggtatctcgttttcttaaattttgtttttctccttgcatattggaagtaccattaggtatgctggggtggtttattttcatccctggtgtatttctaatgcccccatcgtcatttcgcaatttgatttttgcttccgtggcatcttctcagaattagaataaaatttaaccttttaaaatcatctctggttcttttctgaagaacataatctgacacaaaaatgacatcagtgttaatctctatgtctgcttccattccttatattctcttttgtttttggcgggcgtgtgtagttttaataagattaaatgtaaggataccattaagaatgctaagtatcttcatgagagcttctgcttgaccacttgctaggcatctgggtcccttcgtgatatgaatggagtttggagggcacagcatcactcatttgcttttggacctggggtgtgcagttgaatgggggtactcatcaatttctcctttaaaacaaattttacaactgtctttatttattgcttctttggcctatggagctaaaagcctgcaagcagcggggaagtaagttagaaattttactgagtgaaaaatctttggtggtgtgtggattaaccttcaggggaagtctgttaggagctgatggttttcttacctgtgaatactactgctagaactagacatttagagcttgcactacggagaaagatacattttcatttttaactttgaccttcaggtgcctttgcatattttcattgcaggcagtcttaaagatttttgttgtgagctgtgtgattaaatacgacaatggaaggaatacatgctttatactataactctctttattcccacccatctgtacgtcatttgcttttgaaattttgttctttatttctacgttccatctatgttccatgagctgtgcaactgctattctttaaaaaatactggttatgaaattgcattaacattttcatcctacaatgtgtttttttcactgcctgtgtcctacaagcctgcttttagaaattgaatcacttttataagtcatttttaattttgaaattttatgatctagctatttaatctatttctatccaggactttcccagttaccttcaacatggtcttgaaatggccctaaaaaattcccgtcttcagtgttcaaacattttgcccggtggttgtatgttttcttcccaccgctgaggcctgggtatatgtgccctatagtatttttgtgacttctgtagatatatgagccatgtttttcctttatttttgaatttttttttcctgtgctctaatggcggtaggagattgtggattatctttttaaatagctgaacaaattataaagaaattaaagtacggtattgcggtagggttggcgtaggcttttgggtctcatttcatgtgtcagtattattactgtcctttatagtaggcacgtaatacttttgacatgttattatttttagtaatctcagcactttgggaggctgaggcaggtggattacttgaggtcaggcgtttgagaccagccttgccaacatgatgaaaccctgtctctactaaaaataaaaaaattagctgggtgtggtggcacacgcagtaatcccaactactcagatggctgaggcaggataatcatttgaacgtgggaggcagaggttgcagtaagccaagattgcaccactgcactccagcctgggcaacagagtgaaactctctcaagaaaagaaaaaaaaattaaaaaatgtttttatttttaatacataacttcacaaggttggaagactgagcttttttttttttctgcaagttactgtcatttccaaattgtaagatggaattgcagtcttgatatgtgttggaattaagtttaaccctttgagaagcaccacctcttttcctacctttagtaagccctttaattctccgaagtaattcattaactcttctgacctagctttttattccattgaaaaaatgaaagcctggttcccaccaccatttttacagccctgcccttcctcgcatgcagaagcttccctgacctctcaaacaccaaagttttcactctcatcctgtctcccaacccttcccagtattaggacgttgcttttgtattaatctcctgtctacggagtcatgcacataatctcctgtcttcacagtcgtgaatgtctcttgtttttctctctctcttctagaactttcctatcagcagatagactcaaccaaccccagtcctccctggcaaacccctgtctcattgtggcaccagcctggcttgcactccctcacagttcacacacttggttcccacttagctttcatgcagtcacctgtcttcccctcagggactttcctccatccccccatttgatggcgggtgatatccctgcagccttctgttattgtctctttgctcaccatccttttctctgtgatatttatgaatctaaatttgtcttttgtttcttttttattttttatctttctgtctgttttgctgtcctaaaatggcccaggcattgtcttgtttactatagctcctagtgaacccttatatacttttgggtaaatagtctttcaataaattgaaaggaaaaagttcataatgtccctactttttctgatatcatgtattatgggtggatctttgttgggtgaactatattgactcttttataatgccatataatgtgatatggtgattttcattaattatgggctataaactgtagattataggtaaataaatgaaaacttgatgaagacatgtacatttgtaaacctcataaatagttgtactattttgatgacattattgcttataacttagcatctgcatatgacaaaaagaaaaaaatgattataaactaaaggaccaagaaatggagggaaatgtaagttctctcaaagtaatgcaatgttcctatttttttaaatcttgatatgatggagagcacagcctttcttgtgcataagtttaatcgtttgtgaactttcttcaagaatgtcttgtagttgaacatggattcagtgttagaagataagcccgctcagtctgtccccgctggcctgtatccagtggtgtctgctgtatcaccgctgatcacactagccgtgggaaagccacctggctctccagaggctttgtagagggagtgagggggcagagggtaagagctgctatgagctacttatgtgagatttttgtgggacaaaaggaaaagccaaaaaagtgttcttataggcccaagatagttgtcaactctattagctctaaaagtatttaattaaatatttaagatgtttaattatcaggaaatattaaataactcttcatgtttatataactaaagtgacataagttttctgttaaattggaaaaacaatatttgaacaaaccatttgattatattgaataatttataagcaattgatttgaacataacatagttaaatattccctccataaaatattacgtattttacttgtttgcgagctgattttagctgtttaaaatttttttctttagagagtccaggggtttttcatttttattcaaatgaaaataaattatactgttaatttaagaccccaaactggcaaattttttttcttggagatgaatttttttcttattctaggaacaatggatgtttgcttacatgttcaatatataaaacatggatgttacaaattctgatctaccattaatatgtaatacctagtatatagcttttggggagtattttcctcagttctctgagtaaagctttttttgtacatggatatttggtagaaattgacatttgatatgagaattattttgagttttggaaatcattttcaaatacagaggaaatattcttcattatggtattgcataaaaagtttcttagtcactggagtgtatcctggtttgaggataccccatacaggctatagaggattttttgtttttttgagttgatgatgataggtgtcccaattccttattatcattagggttcattagacttctgtatgagacacaggattctaatcttccctgttcccatgggatacagtataactcttcagactatagggggattaatttgataacattctttaatttttaaaatatttatttgaattttgcaaaggtgatacattcatagttctaaaatcaaacgttatacatggagatgcaaaatagtagtctccctcccccaactctctattagctagctctcctccccgtattcagccacagttatttgtttcttgtggctcctttcaaatggtaccatgcttttatgagcaaatacggaaacatattctcttttcacctttttatataaatactactacagtatcctgtgctttgattttttttttcttaatatagcttggcaatccttatagactgacacataaaaggtgtccatttttgaaacactttgataattttcctttgtatagctgggccagtgtttattgatgggcattaaggttatttactatcctttgctgttgcataaatatactgcagtaaataacctgttatagataagtcattttgtattgagtttctcacagaagtatgcctaaaaatgaaattgtatgtttacacattgtacaggaatattacatacatttgtaactttgatagatgttgtcaacctgacctcagtagacatcgtaccatgttgcactccactagcaatgcccaagagaccctgttcactctatcacctcacattgtgacatgatgttgtatgcagtctattaaactgacttgatcagttatacctttaaaatatctccctttacacattctctaaagcagaaggctgttgatggagttggccaacatacaggctgcaagtgggcttcctatactgtttaggagcacagaccattcaaaaccttcccctttcctccaacaaataaacaacagttaaggaaaaggacgtcttggggtgagagttgggttcttcttgctctgttagagcattgagttcaattctttagcatttgctcagatgtcagtcactctgaaatgcacataaatcaaatgagactttctgaaagttcttacctttggcataacttgtgtattcttttcatattctaaatttcgtatttgattcatatttttatattttcaactggaattgagttattacccctgagcattcctatctcctatttgatagttgttgtttttgcatactttgccagaatgaaaatgagtagaatgacggggacagaaaaaggacaagattttctttttttaagatgggtagttcactaagtgcttcttgaaaagtaagagttttatgctgtgttctcaacagtaacttttgcccataaattctgtctgaacagaatcaatagtgttttcttcccttagtatatcccaaagcggggtgctttgtaatttacttctgtgttaacttttttcctgttatgtcttagactgtatgttatatgatagtatagaagccacctatgtgaaatatttaaacttttgtgaatgaatgtggtcttcttgccaaacgtaaacatactatgtttttctcgattgctcgggttcactgaagaaagcacaccttcttaagatacaagatttctgttgatgggattggtctatttgggggcttagtcaacagatattagtgtctcatttgtaacctttctcataccatgaaaggttgttggcaatttgtattctcattatcttactacctatttggatctggcagtctttctctttctttcattgttccatcatttattggcttaaatgagtatttggaagtcctggctggtaagaattctgtgtctttggatatattgattcgttgactctaggaagcaactgattttagattgttcttgatgtttccaaacttttccctttctgatgtttaagaagttgagatgatgaagtgttgccatctgcaattacaacaaaagtaccagagatagccacagtgacttcctttttttttcctgttatttgtaatatcaaaatgtaaaccagaaacagctatgcacacatatacacaggataaataagtattaaattaatattagatatcaaatgtggaatttctgaaattgcatgtaagtgtttagaatgacagaatgtttaaatgtcttttaccgttccctgatacctttatttattttggttttctatctcttatatgtcaacttgtcctaattaattaaattaattttatgcttgatcaaaataaatacagaatttgtgcagctcatagcaaagcctcgtgtgaatgtgaatatgtgctggtgtgtgaatgtgatagttatgatgttattttgaggctattttcactaaggaaaagacagtccaggatcctgatattgcaccttttatcagccattgatatttagagtgttctttactttttcctcctcttttctgtatgcctctaatcttggcaattgtatttttaaattcattcatccctctgcatcttcattactacttccaaagtccaagctgtcaacagctctcacctgggtcactacacaacactgcagccctcctccctgtttacatctctttgtccactgtggctagactgatgtgtggtcaggagcactgcttgacacactctggggctctgaccatacccaggaacaccgtgggtgaagtggttaacagctgcttgaagttgcagcaacctggattggaattgcacagcatgtcttatgctgaccaagctgctgaactttctaagtgtcagagcaagcttcataatctattgtgatatatttcagaggattgtgaggatgagataagatgagtcatggaaagctcttaagacagtagctaaaacacatgaaatactctaagtgtgagggctgatattggtgtttttgtcctttttgagtcttcctgatgttccttcaccatgtggatcgcagctgcttccagggtgcattcccaggttaggcagccctgctgaactcactctagtctccagatctaccctgttcttgcatctctgggtctttgaacatgctggccaactcttccctttttcctgcctaggatctgctgttctgatctcctgccacctgcctccttcagctcattattcttagccatacccgatccctgccaaaaccaatgtgaggcacacataatagtgtcttattctttcccatccttgcactttccaaatttcattttaattatgtctttctttttaaagagggcaggacccatatctgttcctctgagtttttaatttgctttgttttcgagggaggcatgactcaatgtgtggaggcattgggtctctgtcacatacgtttgcagcctagcgtaaccatgcttttattgaatacatttgttattataaagggctttctgcttgtaatttgtatatctggaaatgttcttctcttaaaacatttttacagcaaccattttgataaaaaaatcttattccatagatagtatatattttcttacattgaatgattaacttttcaagaatctcctctagattaaattggagaaagtttgaggggagggcaaggaatgttagtttgattatatcagcagaaatctgggctttttgaattactcatattttaagtcccttgggggactaattttcctgagaactttgtattataatcataaacagatccagttcagtaatactttcataaacttctggctgagactttggtattaatgtcctgaactcttagaaagagaaacatatttttgtaggttggccaagaaaaataggtcttgattcaaataaaataatgtatttgttatttttaaaaggtttttccattgagcaatctgtgaaactttttggtaatttagttgtctaatattggacatgacttaggcagtgacttggtgtattttctgtggctcaatataatgactatttgaatttttaagtttttgcttttgacttgggagtaagttatgttagattacacattattacagaacagttaactgttactcctttggttgtagattttaataaaaggtagaatcctgtgtcttagttccttaaatatatttgaaatggtaaaatatgcagagaaattttttattgaaagtaaacattttatttaaggtactttaaatgtactttaaggtacatgtgcagttttccccctgctgttagtaaatggctgaaatagcactttggatctgtggcaccctggagaagctttcctcttcactcctctgacattctgtttctaagctcattcatattatttatagaaatttcttctttttgctctacctccctgagtgctggtcatttctctggatgggtttttacatgctcttccttggtgaacttttatgttactttagttcctcttcctgttccttcagacttgtgcttacctgcaaggatgggctggtcactactgtctagatatctttttgatcactcagattcaacatgggtgaaggtaaaccatctttatgttttccctgagatgggaagtggtccctaataaaaagggcaatgtgacttgaaactgccagttctgaacctcattgtccatggatctgggccatatatagcaacctatgtgttcagaattaccttacccctgtgaaatcatgagtagttaatttctggtgtttcctacgcccagaaaattctatgattggccattcttttcttgtttcttttaattttgctctgtgtctcccaggcttcaaacttactctcttattatcttctctctaattttttatgtcttacctagtgccaggtactatatattatacctttactcctctgtgtgtgtgtgtgtgtgtgtgtgtgtgtgtgtgtgtgtatgtgcacgtgtatatctttctattttcacagcacctgttctcatttcagccatattccttttgactagacctatgtaatatttgtctccctctccatctgtttgtttttaaaatcaattctgcgttttcctatttgcttagtcttccaaattgccacttggatttcctcacctgcaagtttaaaagcatgcaaaacactccctactgtattttgatttaagttaaatcaaatttattatcttgatattctgggttctctgcattcttttttttttttttttttttttttttttttgagacagagtctcactctgtagcccaggctagagtgcagtggcgtgatctcggctcactgcaagctctgcctctcaggttcacgccattctcctgcctcagcctcccgagtagctgggactacaggtgcccgccaccacgcccagctaatttttttagtagatacggggtttcaccgtgttagccaggatggtctcgatcttctgacctaatgatccacccgcctcggcctcccaaactgctgggattacaggcatgagccaccatacccggcatttttttttttttttttttttttttttgagacagagttttgctcctgtcacccaagctggagtgcagtggtgtgatcttggctcactgcaacttctgcctcccaggttcaagcaattctgttgcctcagcctcccaagtagctgggattacaggcacacaccaccatgcctagctaattttgtatttttagaagagacagggtttcaccatgttggccagactggtcttgaactcctgacatcaggtgatcacccgccttggcctcccaaagtgctgggattacaggcgtgagccccttgcacccagcctgagctaccacacccggcacaaatttctatttaacttttttaggcatcatctcctaccatgatctcatgcatattttgtgctctggtggactgctgtgccttcctttaaaatcaattctgttccttctgacttcagatattcctacaatgctagactccccctactttctgaatcagcattgtgtcattcattgtttaattctgtctttgatcatgtgtattgatgctcacattaagatgacactctgcttgaaaatgaaggggtagcatcaggggtgttattcatgtgcagagccaagatggatctcagcatcatacttattaactgcaatctggagtaagctacttaatctgtagtttccttgagaggcctcaacctgggctaaaatggtcacttaatgaaaactgatatccaaaaaagaaagtgtgtggtagaattttgtggaaatccaaatcatttatttcagttaatgatctgtctagaaaacgccaatcagtttttatcacatgacctacatgttcctcttcatttctgtggagtaaaagatgttgcggtgctccctctgtgtcacaccctgtgaggaagtggtgtaatatgcccacaatcagatggcctagatttgactttctgaggcattcattagcctgacccctgtgatcctccatttcctcatctggataattggggaaattgcctctttcttccttatgcagttgttcagaagctttaataccatagcggacagcttatggtcttgacccagaaaaagctaaaatttctgtttcttttagttgtgtgactttggcaatattgattgtttcctattttagttttcttatttgcaaaatggtagatgatagaaccgatttcatggacttcagtaaagataatgtaaaataatatggttcaatattaatcagtgttagttattttagttaccgtatgctagttcatgcaagcctaatataaaatttatttttcttctcgctgcttatccaatcctagtgattgctacaaatttttgatagtcatattctatcattaggaagtcaacttgctgcttaaaatggaaagccttgttagaataatataagtaaattacgtacaatagtctattctattctaagatattctaggttaggatttttaaaatgtagaaaaaatttggagtgtatgatcagtattatctttatatttctcatatgtgttagatggttatgtttttcatgtagtcatacatatggttaaaatcctttgataacaaaagaaaaaataccatatagccaataattcaagaacatgccagttggcatattctcagattgtactcaaatggtaaacactttcaataaggtgtttcttaatatcttactaagaagtactagcattatggctaagctgctttttgtaaataaaacagatttttatagccaggtgcagtgactcattcctataatcttagcactttgggagaccaaatcaggaggattgcttgggcctaggagttcgagatcagcctgggcagcataatgagaatccatctctacaaaaaaaattaaaaataactgggttaggctgggtgcagtggctcacgcctgtaatcccagcactttgggaggccgaggcgggcggatcacaaggtcaggagtttgagatcaacctggccaatatagtgaaaccgtgtctctactaaaaatacaaaaaattagctgggcatgttgatgggcatctgtaatcccagctactagggaggctgaggcaggagaattgcttgaacccgggaggcggaggttgtggtgaactgagatcacatcattgcactccagcgcgggcaacagtgcaagactccgttttaaaacaaaacaaaacaaaacaaaacaaaacaaaacaaaacaaaacaaaactgagttagagtggggctgtattcttagctacccagaaggctgaggcaggattatcccttgagcccaggaagtggaggctgtagtaacctattatcatgccacttgtactccagcctgggtgacacagtgagaccctgtctcaaaaaaaggaaaaaaaaaaaaaagatttttatttacttgtggttctaatgcttctcatctaggttaagttttgcttaaattcaaagaggtgtctagacagaagtaactttgtcactaaaaccttcattcatgactatataatatatatatacaatgaaatatcatttcatttcatgaatattttatccagcatacatgggatataaaaattcattttccgagtttctgagattttattttctttttcttctcatagaaactaagtctttttcaagttctgcactgtacctacttttggctttaaaatataaaaggaattaatttgtatgatgttttcaatgtgaattcatttacaacctgaatttataagcgttctactctgactatgacttctaaaaaatttccatatgcatactgtggttttaaaaataattgtttattgtttattcttttctttactacctccagtctgagcaagagttctttctttctttggtgcaccattttgcattgctaacaaattttccttgactgattcgtacttctattttggatgtgtgtatatatttgtgtgtttgtgcaagcttacataaaatttagcgttagtgtttctgcatgatttcctttagtttataatgtaggaaaaaaatagttcttacagtctctcaccccaccagtgatttgatttagcaaaaccactggctttataatccttcctggcccttttgtcccattggcagggctctaacctctttactccagagaaaacacagctgttgtcgtcttctttctgaacagtgaagggggctacatcattttcaactgtattttgaagaattaatttgtgcactaatataaatgagttttctaaatttaaatgtttgaaataaagacaatttatataattttaggcctcttttttcttttagagatgggatctcactatgaggcccagactgggtttgagtttctgggctcaaatgatcttgctgcctcagcctcccaactagctggaactgcaggcacacaccaccacacctggcttaagacatttttagcaataaagcaatttttggtaggtatttgtgagtagatgaagagcttttagttatgttgggctctttgcattgtctcttacgactaggcttattcataagaatcctataagtcatactgctttaaaatttttattatcactagagtcaggggaattgggagagattcttcctcagttagttgttctatcttgaagattggggaaatgctggaggtttgttgatcgggagagattcttcctcagttagttgtcctattttgaagatgggggaagtgctggaggtttgttgtgggatgatgtcgttttttgggagttgctcaccttgcaagagccttggtctaccggccttctctctcaggtagcatttgcccattgccatcacatattccacttcactgtccagctcccccattcctctacatggtgatatggtgtgtttgtgtctttgtgtctgtgctatgtagttgccacttccccctaccccttcatcgcctccacatatcgggggaacctgtccccgataattcaacgtagtttcttttatattttccctaagtgtcagccagtctgagaaataaagagaaagagtacaaaagagagaaattttaaagctgggggagacatcacatgtcggcaggttccgtgatgccccctgagcggtaaagccagcaagtttttattagcaattttcaaaggggagggagtgtaggaatagggtgtgggtcacagagatcacatgctttaagggcaacaaaagatcgcaaggcaggaggtcagggcgaggtcacaaggtcagggcgaaactagaatcactaatgaacttccatgtcccgctgtgcatgcattgtcattgataaacatcttaacagggttcaagagcagagaaccggtctgactagaattcgccaggctggaatttcctaatcctagcaagcctaggggcactgcaggagactagggagtgtttcatccctacctacgtctgcataaggcagacactcccagggtggccatttgagaggccccgcctgggaatgcattcttttctcagagctgttaattattaatattccttactggggaaagaattccgcaatatttctcttacccgttttcggtaataagagaaatatgcccggcccacaggcagccagactttcaggttatctcccttgttccctgaaaatcgctgttatcctgttcttaaggtgcccagatttcatattgttcaaacacacatgctctacaatcaatttgtgcagttaacgcaatcatcacagggtcctgaggcgacatacatcctcagcttacaaagatgacaggattaagagattaaagtaaagtcaggcataggaaatcacaagagtattgattggggaagtgataaatgtccatgaaatcttcacaatttatgttcggagattgcagtaaagacaggtgtaagaaattataaaagtattaatttggggaactaataaatgtccatgaaatcttcacaatttatgttcttctgccatggcttcagctggtccctccgtttggggtccctgacttcccgtaacatccacacgcctgggattctgggattgctcttcttctacttccttttctggttgtgactcatcttttaactgtaacttattgaaggtctcctacatttttaacactgaggtacttgtgaagaaaaaggacattcatttgaacaaatatttgccactagatattagtcttaaacttaagccgatatggtactattatttagaaatattttaacaagtaaattttttgaaataatcatgtaattactcattcttaagttgcctatcttactttttaattatagaagtggattctatagcactgtaactattttggttctcttttccttatctcttttctacaaaaaaataccattctccaaaaggacattttagcgtgaagtaagccaccaagcacatgcaaaaagtggatggattctgtttactgtgttttcagttgtttaacatttatattgaaaatgctatgagtaacgaggaaactcagtttgctgaatgttcaccatgtaccaaggtttgtgctaaatatcagtgttcatgatcttgtaggtaaagcaggcattactattgccatttaaaggtaagaaaactcatccttttactaaactgtttgcatgttacctacctagtaagtgatagagatacaatttaaaaaccagttgattctggtttttaaacctattacttgtacggttgaaaatataatactatatttgccattttgtttttgctcagttaaatatttctttagtattgactctaggctttggtgttcagtattgattaaaaaaaattcaactctgtcctcagatacctgatagtttattgggtccacagaagattggaatcattgttgtgtttatgatgaagtaatataggtggatgtaaagcatctgtgaacgtttcagtgactttgacagttgaatagaaatttgggtactctgcccaaaacactaaagctgctttgggtgaataaatagtattgactttaggctttgaagcacaagtaagagttaaactagaaggggattaaaatccttggcaaaaagtcagagtttaggtgaaaatggattacagtagcatgtccccatgcccagcgccacctattttcacagggacatgcgcctgtaatcccagcactttgggaggccaaggcagcaggatcatttgagcccaggagttcaagacaagcctcagcaacctagggagacccccatctctacaaagagtaaaaaagttagccagacatagtggtgcacacctgtagtcccagctgctaggaaggctgaagtgagaggatcccttgagcccaggagttcgaggctgcagtgagctatgattgtgccacagagcgagaccctatctccaaaaaagaaaagaaaagcaaattggtggaattttcgtttgtgagtaatctgatgtgttgagagttgtttgttagtggccggggtgcatagaacttagattgggttctggttgtgaaagtatccaaatgtataacgttaagaggcaatgttggtgaaagaaggggtctagagtgtcacattgcttccaaatgaatgtttcattcattaaagtataatgaaaatggatttgagaagagagagacaaaagagagaacgcttaggagggtgagcaaaaatattctaaatgcaggctattccagtagagatggaaaaaaattggaagataggaggtggaataaaaaaaaaagtggtcttggtcatgattaagatgtaattttcatatgattgagacattaaaaatggctcacagcaatgtcagtagaatggagggacacgccccaggtttctaggaggctgtgaagaaaatgggaggtataaaatgtggaatgctaagagaaatagaggaatcttctttgttttaattttttaaatagtaaaggagatttttgcccagttgcctgctgataggagagagccattgctcatgtaataggtctttttgctcaaaatttaaagttaggccaggcatggtggctcacccctgtaatcccagcactttaggaggctgaggtgggtggatcacctgaggtcaggagtttgagaccagcctgggcaacatgacgaaaccccgtctctactaaaaatacaaaaattagtccggcgtggtggtgcgcgcctgtagtcccagcctctgctgaggctgagaaatgagaatctcttgaacccgggagacagaggttgcagtgagctgagaccatgccattgcactccagcctgggtgacagagcaagactctgtctcaaaataaataaataaataaataaaaaatgtaaagttagaatcttgattacttgaattactaagcccagtttcatcatgctgcatatttgattagttccttctggagtctttcaaagactttctggtttctacttacctaaacggttttctgttactcgaatacatcttgttgcctatttcttccaacagattattatgaatgtattaaataacattggtcttgattcttatcccaggggattctgctactaaaatctctgttcatcctaagaaactctttatgtttgtttgttagagaaaatgatgactggtgattttatttttcatcccctgcatgcattgctgtatgtaagaaaagaatggaagtgttcatcaatttttagctgctctttgacttttctattatgtttgtattatattatattaggtaagatgttaatatacaataacaacacttgcaaatatagaaatatttatgaccttaaaaataaaagggaatttaagggttaatcttcaatctgtggtgagttgctttttgctggaataatattgcttggggacttcctatgaataagtagataaaaattggaccagagtttcatgatttcttttcaattccccatgtgattataagtttgccagtttgttaatatttgaactttaataacggttctgtgagttgaaaaacaccattatgattttaaggtggtctggaaaacctaggtagttgttgcataatttgacgtaactacttgaaactctggttctcttaaaaacaattttgataatagtaataacattactagctttttttaaacatgcccaaattcagttgtgtatgtatttgtgtatatgtgaatcagtgtgctgtatttagggtaatttttggttaataacagtaattacaagaattattccttttcaaattttataaaatgttttaattgacaaaaatgtatatattgtgcacgacttgatttgaaatatatacattatggaatggctaaattgagctaattaagacatgtaatacctcacgtacttcgtttattttgtgtggtgagaacacttaaaacatgttttcttagcagttttcaagtatacagtatattgttattaactacagtgactatgttgtacagtagatctcttgaactttttcctcctaatggaaattttgtatacttttaccaacacatccccacccaccatccccctaaccccaggtaaccacaattccactctctactttgatgagttcagtgtttttagattccacaataagtgagatcatacagtatttgtctttctgtccctggcctatttcacttaacataatgtcctccactatcattcatgttgccacagtgatagatttctttctttttaaaggcagagtagtattttgttgtgtgtgtgtgtttgtgtatgtatgtatctgtgtattacacatttttcttattcagggtctattgataaacactgttgataaacaacaagataggttgattccatgtcttcgctaatgtaaatagtgctgtaataaacatgtgagtacagctatctcttcaacatactgattgcattttctttggatacatgcccagtggtgggattgctaggtcatataatagcactatttttaactttttgaagaacccctataccctttttcataatagccgtactaatttatattcacaccaacagaatgcaagggttccctttgtccacatcctctttagtacgttatcgttcatttttttgatagtagccattgtaacaggtggaaggtgatatgtcattctggttttaatttgcaattccctgatgattagtaatcttaagcatttttcatatacctgttggctacttgtatgtcttcttttgagaaatgtctattcagattatttgcccatttttaaatcgagttatttgttttctttttgttaagttgcttgagttttttttttgtatttattttggatattaatctcttaccagatatataatttccaaatatttcttctattccatacattgtgtttttactctgttgattgtttccttggctatgcggaagctttttagtttagtttgatgcaatcttgtttgcctatttttgcttttgttacctgtgctttgggttcatatctgacaagaactagcatgtcttgaattttaccctgctaagttttttatatacgttattcttaaacagatcctatggggtagacgttagcattattacgtcagttttctggttgaggaacctgagttatgaatgccatattatttgctaaaggtcacacagtaaatataccttggctttaaatctcagcctttctaactttaaaatccatgatattatctactaaattataactgcatagacaaaggtggattattcataaactgagattcctaggggtgagagtgggtgtccctggatgtgctgtgggaagtctgtgaaatctgttccttccttagggcccttggtctggtcctctgcctggaaattgctttacccagatatcttcttgcttaattctcctgggtccttcaagtcttcacttgaatttcacctcctcactgagaccttctctgacctctgtttacaactttatcttgctgcctctgcaacgtccccacctctccaaatttctgtattcccaggtctccttaccttactcatttttaatagcactagcatacatacaattctttacatttattgtgtattttctttccctgcctattaaaatatgagtttcagaagggcagaaatcttttccgttttgttcactcatctgttttaagcacctgggatggcacttagcatatcataggcattcaataattgaataaataagtgaatgattcagggtgggaattctctctgaattcacaaataagatttattgtttaatgagcttgcagctaggaaaagagttcatggcttttagcagattttcactttaacagaccggacccaaagtttacttcaagcggtagtgattcctgtgcttttaagttgaatgaaaaaaaaacatggatgctcatttttagttgtatatgatgcatagaaatgtataatctaatgtagattaatgtaataactagtataattattaataactaatataactaattacaaattataattaaatacttttatattttatatttactttaaatattataatttattacttaaataactagttataataattattaataagtagtacaataacttatatatgttaataactagtaaatgctagttcagtttgcagttttccttgggatcattttggaaagataaattatactttgcatttcatttttgttttgttttgagatgtgatcttgctttgttgccaaggctggagtgcagtggaatgatcatggctcactgcagccttgaccacccaggctcaagcagttccacctcagcctcttgagtagctggaaccatgggtgcacaccaccatgcttggctgattttttttatttgtagagatgaggccttgcaatgttgcctgggctggtctcaaactcctgggctcaagcaatccccccgaccttggcctcccaaagtgttgggattacagacatgagtcactactcctggcctgttttgcagtttaaaattacagattgaagattattaaattttgttctgaacatgttaacatgcatatatttttgaatgtcaccatttgagaaaagaaaccgaactgtgggatttaatgcttacatatttgttataaatacacagtacggattgccatcgtagtctttgtcttctatttgtgcatgcaagtgatgtgtttttattaatttctacaagaattattgtacatgtacatgtaaaatatgtaacaaagttgattaggcagtgaccatcaagagagaggactcctgtcatcagtcaattaaatagttgcccataaagctgcacattcagtaaacttaaaagcaggaacacttgtgtggatgcaaacatagtgaggcgcattgaattccaggatcatgatctctgagttatttgtttaactgtttcatcctctttaagatcatacacccttatcttgggcatctgtctcctatgtataaactgactgttaaaagtttgaatgttgttgatcagagtgaataatttactaaaacaagtaggaataaagaaatccctcttcacgtatctacagaaatatttgcacgtgaataaggatgctaattgtagcagtaaaaacagggtgctagaaacaggcttaagtgtccattaatggaggagtgactaaatcaatgattttatatttgcactgtggggatactctgcagctattaaaaaattgatttagcctgggcaatatagtgagcctttatctctgcaaaaattttaaaaatatcagacgagtgtggtggcatgcatctgtagtactagctactctggaggctgaggtggaagaatcacttgagcccagaaggcagacgctgcagtatgccaagattgtgccattgcactccagcctggctgacagagctaagcaagactctgtctcaatcaatcaattaatcagtcaatacagttgaggtaaaaataaattcctaggtattgaaatatttgcaagtcatgttgttaagtaaaaagaacaagttttacgtaatttgtatgttttaattcttgtgaaaaattgcacttgagtgtatggatatgtcctatgtataaaataatagagaattgttttccaaattgtaatgatggttaattctttctgaagggagagttggaatagaaatgtagggtgaaatattgtattttatatactttaccactaattaaatattttatgaaactacttaataatggcgaaatactgcctagtaactacctaacatttaaaacattttctaaatagacatacatacactccaaactgaaatggattggttttccttgccttaaataatgtttctttgcacattacttcttttcttttctttttttttgagacggagtcttgctctgtcacctaggctggagtgcagtggcacaatctctgctcactgaaacctccgcctgctgggttcaagcaattctcctgtctcagcctccaaagtagctgcgactacaggcacatgccaccatgcctggttaatttttgtatttttagtagaggcggggtttcaccatattggtcaggctggtcttgaactcctgacctcaggtgatcgcctgcctcagcttaccaaagtgctgggattacaggcatgagccaccgcacctggcctgtttctttgcattacttcttatccattctcccctcaacactgaacctttgctcttatttataatttacttgatgacaaattttaagattttaatattcaacagttattctgttttttaaatttaattttatgaacacatgtcttttattaaaaattctaggctaggtgcagtggttcctgcctgtaatcccagcactttgggaggcttaggtagttggattgcttgagcccaggagttcgagacctgcctgggctgggcagcatagtgagaccttttccctgcagaaaatacaaaaattagcctgttatggtgacatgtgcctgtagttccagctattcaggaggcagaggcaggaagattgcttgagcccaagaggtggaggctgcagtgagctgtgattatgccactgcactccagtctgagtgacagagaaagaccctgtctccaaaaaatacagaaattctaaagctctctcaggggacaaggttggagttacttgccctctgaaaatggaacacactagacaaatgtttttatgtcaactacagtgatttgaagttagtcactcaataaagactagtgagttaaacatttctgaaacagatttaggtaattttctaaagattaataatcatgaatattgaagtagacctgtagtttatttgctcatgtttgtgagataaaagattaaggcttgcagagtaacagttatttcacattcccattggaaatgtggtaaatgtgcaaaataaagaatatatgctgggtgcggtgactcacacctgtagtcccagcactttgggaggcctacgtgggcagattgcttgagtctaggagttcaagactagtctgggcaacatggagaaaccccatctctagaaaaatataagaattagccaggtgtggtggtgagtgcctgcactctcagctacttaggaggctgaggtgggaggatcacttgaacccaggaggtcgagtatgcattgagctaagatcaagccactgcactccagtcgggcgatagaacaagaccacgcctcaaacagtaaatatctaaaaataaaaaatatataatataatcatccatggcactttactgtcttgaaaagttaaatgatagacacttaaaatttactttttaaatttcgaagttcactattcttgcttctagagtatagaattacactcctttttcagagttaggacaaattattgaaaatgaatagctctgaaatagatttatttttatgaacttaagtttttatgaatatgcttttactgaaaaaagatgttgtatatttaatttctaaaattttattttagacttgtcttgctactttctccagactctgaaagaggaactttattttttctggatgggtcattggtcatttttactcagtggaaattttttataaaatcacattggtaatttggttaaggaagggtatttctctttgtaccacattgaaaagtacctgtggaatttaggctcagcctattttctcctttttgtggtgaaaagtcagaaaagctgaacagtagtaaatgcagttggtaattgaaaaccattaagataaatgcactcattatttcctttcaaaaatttcctcaagttcaaaataaacccaaacaatcgaaattattttctttattttgaaaataattaatccattaccttcaaatcacctttaagaatttctattgcaacttaatcataatgattcaaaaataagaaaaaatcattagagaggagacacaatgttggtggttcataggtgaaggggatataatgttgagcatattctttcaattttcttgaggtttgaagttttcccaaataaaaattttgatcataggaaattcagtgtaatccatgttcttttctgtggctttttaaaactgcaaagtgaattcattcttacctgaatactgtaattgcctgatggattcttccttcccgctgcacagacaaaatcagtccgccgagaccacagcattacagtagagaaagtttaattgacacaatgctggttcatgctgaagaactggagttataacttaagtcagtctccccaaaggcttgaagcttagggtttttatgtacaatttggtgggcagagggctggggaattggtgctactgattgggtggggatgaaatcataggggtgtgggaaccattcctcatgcctctgggtgggaccacaggatctgttgagttatgagtaaggggtcccctgttatcatccttgctgtaaggttaaactgtaaactaaattcctcccaaagttagcttggcctatggccaggaatgatgaaggacagcttggagtttagaagcaagatgaagtcaagtatgtcagattcctattgttacaattttgcaaagacatttcaatctggccattacagttcatgttgtgatacaatcttttttaaaggtatttaaagtcacaaaattcatacattattttatttgcagccacctctatttgttcatagtctcactttccatattctatctctagcaaatggatgtcagtgttaatactgggcagtgtctggctaggttttcattttcattttacatcaggttgttctcttagtaatccagcgcattctggacaactaaacactagagtcagggactgagctagatgctgtaggtgcaaagatgcctgagggaagcctggccctgataggtgcttaatgaagatctgagtttgctcactgttactgtagaacctctcatctctgcaggctgccttcttctgacatagtctcattttgagcaggaaactcatgtttgttgttagtgatgttctctgcaaagtcccccctgccctccttatgttggtgtgaagtgtcactgaaatgagccactctcctggacgtcttttaagagtgcatctagtctagttatgtctgctcaaagcatagctgactgtgacatgacaagatttgggttattgtggggctctctctgctccttccctacctgtgacaccttccccagtaaactctatttcccatttacatcttgtgattttggcactgtggattttgcactctgtttacaagcggtgtgtcctattattaagtagctctcttttgaggagggtagacctacatacacgtagacttcgtggattgatagcacagacaggagatggattacctaactactctgagcagcagttctctattcctagaataggaacagcgtgtgtatagtgcctggcagattcatgaaggcttttaaatctatgaccactcagttaatgccttctgtcctcctactcatctttaccctctgagggtaccctccatgtaaagttgtttttagtatttaagtataatatccataagataaactgctttctccagacagtatgtatgcacttaataggtatacttgtaaaacaccaaatagcaattctatgttcaggaccactttgttgatgggtagatttgggggtgcaatgccacctatacactgcaccccaagctgtgtcccctccaagtgtctcctttccttaatcccactgaggtgccataccggtgagcagaggcactatggtgtttaatccctttctactggtcttttatgcaattcaggttcctttttagataagaatcgttctttgctgtttgactggtttgctataaattcattgattgatagcatttcatttgttggttcaagtaacatttaaacatgtgatatatgaataggctttctagaatgtaaaacaatacatataaaagcaataatctggccaactatgagtatcattcagagtgttgatactttatattattgattttgcttatttattgatcttctgcgaactctttcttttctttctaatggtactcaagtactacttcattcacttggctgacttctcccttcccctgagccgactgtgcatgtgtcttcccaactctgtgttcagtgacactatattggttgccagggtgggagtgtttgtgcaacaggtatcaacaaacactacatatacggcttccccacctcctgaccctttttttttgtttgtggagattctattagatgtttattagcacgctcctggctctctgatttcttcataccagttcttgcacattggtggttattcctccagaagttggtggttcttcttcctgatcatggctttaacagtctgttccttgcattgatttttgtctttcacctgtaagatcaaacttctggttactgcagatgaatctgcatgtctgcatctgcttgtctggtctgcccacccccattcctctctccatgagtccctggaagagttatggtatagaggcacttgggaggtcttttcagtttccttttcccagtacttacttagtgacgttgctttttaattttttttatttgttttctaaatatataatacttatacatgtgatattttgttatatccatagaacatataatgatcagagtactgggcatgtctatcaccttgggtatgtttcgagtcctctctgctttctattttgaaatatataatagattgtttatttttttcttttaatttttttttttatagagactgggtctcgctgtgttgcccaggctggtcttgaactcctgggctcaagtgattggcccatcttggcctcccaaaatgctgggattacaggtgtgagcccacgcccagccagattgttgttaactgtggtcagtagattcagcttttatagaaaccttagggttttgacccgaggatgtgatttaaaactgatcctttccaacttctcagtcctatccaagttgcaaggccgactgagtgttcctttaggatgttttatggctagcaatgtcatgggtttttaagtgccttgagaaaacagctgagccatagcagtgctcttcttaggcatgtgggtacagtagacatgcttctattttttaaatatgatttgtactttgtaccttgatgatatttgtttctcccccctccctttttttttttaagagcgagggtcttgctctgtcacccaggctggagtcgctctgtcacccaagctggagtgcagcggcatgaatatagctcactgcagtgttgacctctggggctcaagtgatcctcccacctcagcctcctgagtcgctgagactataggcacgtgttaccactcccagccagtttttgtgtgtgtgtttctttgttgtaaagacaaggtctcactgtgttgcccgggctagatgggatttcttttactgtcagaagaaatgagatcgttaactattaatctctttgaccttgtcaattatttaactcaactactttgacatttgcaatgttattactagtgtcacaagttttctcatggtttaatgattcttttagggtagaattttactaatatctgacttgctactctaaagaacgtttatagtcatcaacttgttccccctttcccttgcaattccaattttttaaaaaatcctcatatataggggtgattttcagaatgatagagaacagagccaaaatgatttggccacgtaaggagtgggtttcctacttaatgtccaagggacagacctaagcctgcgaaactcagcgtggtgatagagacctgtgaggcaggtaactcgggacccttagagataaagaagaatctggataaaagggctatgagacttattttagaaattgcctaatgacagattcagggttttgaataggaaatagtatctggtagtcaaaaggtttctcaaataagtggaaaaaaaaaaaaaaaggtagagctggcccttgaaatgctaatctgaataacaaaagaccgagctgactttccaggaaaagtgtgaaaggcttctgaacccactttccttgtctttgtctttgtgtgactgtactgcccattgttcctacacacaattaaacacatccatgctctggagtcaggtattaatgcataggtgttatggtttttaaaaatatacctaccgtcctattttttaaaattgactttagtttcttatcagttacaaagtcttatatatatgtgtgtgtgtgtgtgtgtgtgtgtgtgtgtgtgtgtatatatatctgaagtactgcctaatgttttttcaagagagaaaatttctgttagtagtaacccacttcaccctagtctattatttggagaacaaataagcagtcatcttgatcctgttttatcttaacattttaagagtaaacgtttcaagagtaaaacagttctgatcccccagtgtgacctcaacaaatatttcaaatcttttatttttgtaaatgaaagtaatgtcttctgtattttctatttcttatttggcctatgtatcatttgtttaatcatttttctaaaaattgtaatgtctctttctctgaaggcatctctttctggtaaatattgatatgaaaatgtttcatataaaaggagctgaagttcttttagtccatttgcaaatcatgaatcccggatttaattatatcgcaagggaagaacctgaggaaatcaaaagtactaacataattgggccaaactgtgtaatcaaaagcaaatgatatggttattaaatctaatgaaacgatttcccagcatttaattcatttctcggattcaagatattttagtaataaatacatctgttgaaatggacattctgtgttgtcaccacttttaaacagttcttttctcaagaccatttctggtaagaaatatttctaaaggttacaccttaatgcagatagtggatgtctgctagggctgggagaaaaggaaggtggaatgggaggtaaagtgtgggtccttattaaagcggaaggagaggaatgaagagagtacatcgctttttaaaaaatgttattctcttgtatcagcatcttcattttacataaaatgaaaacatgccattgcttggtaaaatatatatgatatctacgggattaatggctagtttggctggggctggggttcatgcctgtattcctagcactttgagaggccaaggtgggaagatcgcttgaggccaggagttagagaccaaaatgggcagcatactgagacccagtctgtacaaatatttaaaaaattggccaggtgcgatgatgcacacctttagtcctagccactcaggaggctgaggcaggaggattgcttgagcccaggagtttgaggctgcagtaagctgtgattataccactgtactccagcctaggtgacagaatgaaaccctgtctcttaaaaaaggaggaaatacacacacacacacacacacacacacacacacacacacacacacgactagcttataaagattttgttaaaatacatagaaaaaaaactcctgataaacttgcaaagagtatatgtaatcattccacaaatatgattgtattagggtttttcagagaaacagaactggtagaatggagattctgtctatctatctatctatctatctatctatctatctatctatctatctagatatgtatgtctttagatatatacacacatataacatttactataaggaattggctcatgtgattatgaagtctgaaaagtcccaagatctgcagtcaccaagcaggacccccaggagaaccaatggtgtaaggatcagcccaaatgcctgcagctctagtcccccagaagatctgatacttcagtccaaaggcaagaaaagaccagtatctcagctcagcagtcagacaggactcctcttcctcagcctttttgttctattcaggtctccaaatgattggatgatgctcacccacattagggaggacactgggcttttctcaatttcctgatttaaatgttaatctctttcaaaaacaccctggcagacacacccagaataatgttgggccaaatgtctggatgtcatgggaccccgtcaagttgacatatatacttcactttcactatgatatctttaatctcacttgcaattttaaattccagctagaatggcagcaagactttttgctgatagattaaggggaataaggggtatgtgtgtctttttgtctgtctccctatctccctcctcccccatctctgtctgttagagcagctgtctaagaactgagaaggatctaagattttatcctacttgcaagctaacaagttagcctgcctcagtttcatggttgctgacagaagacctgaggctcctaggtcagagatgagaaattgtattactcttagcacaacatgcaacataagcatcagcatatttggttcagttctccttactccctagacctatggaagtgatgcccttgggcccagatggatgcctgcatgctctatgggtaatgttacaggacaggactctgagctgatgaatcttttataatggcagtaagcaagactcactccccttggccctggagggagacactgtctctgtctcccacagcttatctctgtagaggtatctttgaaaagcaagtccagaacagaagcaatcagtgcctctgtttataagacatgcagatttgcaagagacaaatggagaattgtgtcccaacacagaaaataaaagttgtgaaatgaacagtttaataagaggctggtaatgatatcaattggctcggtcattttagaaagtagtttgatactggctaccttaaaatgatcatgccatttgaaacattatgttatagacttcctccaaagaagtgaatcctaaatattgaaatgtttttatttagaaatctgtcagttactggagttgaagtgttctttgatgagtgaattgtgaaatgatgatatgtttacccgatagaatattgaatcattaaaaattgtttctttaatgattgcaataaaatgatacattaaatatttatattttattattactatgtaagaaaagaaaaacctatatgatctaaaaaaaaaactgaaagtaaacaccaaaggtaagaggaaaagacagaaatcatctcacatcagtacaacagtgtcctggagagcctggtgttctttaatcactctaactgaacttttgtgccatagaagatgaaggacacttattttttaaaacaaatatgttaccaaattcccattttctttttaaaatttatctagagggtggtgttgagcacctagttagcccttaatagttacaagacagttttctgagtacttcaattagctcatttgatttttgtggaaactctgagatagatactattatttcccacagtttataaatgagtaaactgaggcacagagaagttaagtaacttgtcaaaatgattctgcatgcaaaatccgtgttttttattactgtgctcagctgccatatcaaatataacatgtttaatactttaaattattgtatttgtttaatatcttaatttttgtttcacatttgtatcatatactgggaattaaggacaatgcaacaaatacatagctaatgagttttattttcaaaagaaaaataagtgttactctggtaagcaagccacttctgaaaagagattgattagtctgaataaaatcgtgtcaactagagggtggccacttggtcactagtgtgtggtgggagaaccctaagcagtgcagacgcccttcgtgcaaaacaagcggtgccagtgttcctggcatggtggtatctgcttgagtggtcatctgggataaatatgtataggaatgcggcagatgatggcaggtaaggtgctgggactagttattagattcagtgatttttagtaagcatcaatatgtaaatcttcctgtgtgaatcattgatgacaggcaaaatggaagaagaatgtgaagacaaattgcagtgtacttttggatgctggactaaatatcttccaagaagattcctccatgctctggaatcctaataatcaatgagaagacttacatattggaactgaattttaagattccattatgcatggaactggtgcagagatacatactttttgttgttctctgtggttagatagctttcataaatcagcaccatctgttcttttgcctttggttgtatggagtcatgttgtatatgtatcaagacgggaggcatttcatttctctgggaaatggaaatttcatggactgtgttaaatactacatttgatcagtactagcttgagataagaatagtaggaatctggttgaggggatggcgcttatatacagtgattacatcacaggcgctgaataattcttcatagaatcctaaataatttgatgttgagctttgttcagtagagcatagtttatattataaggaactggactttgtctaaaactgtaacagctgttaatttccctctacaagggaatatttttaattttaaaatatcttatttttgctatatattattatattattatatcttatctaatattgtcttttctaaaaagtatttgcatttttttcatgaatgtttttattctggcagaatataatgatcatgaattaaaattgtattacacatttcctgattttatttctttggaaggttgctatagatttatcattttgtattgtgaagcccctctctcctacagatgttttcaattgttttccatatatgatgggaaattactttttcctggtgtttcggccagttaatcaagtagttgggacattaacacgaatgccttctgcaatcctatttgtgatacctaggagacttggaaacagattccctttggaattatttttcatcaaatgtaatccaaagaaaaagtgctttaattcactctgtcaacatcctaataaatattttctctaggataccatagctcactaatagttaacatgtctctcattaagttaggaaaatcttggagggattctaaaaagtatgaaaaagaacatttagttgagtgtttttttagcaatatatttgaactcattaaaatattttatttactgttatgaataattttttttaaaaacacttgacagaaaatattgtaaattgtaccatgagaattttcattttttttttgtgctttctaaacacaaaaatcaaagatagatattttggaaatttaagtagagaagtataactttaagtttttataaaacattttaaaaattataaatataggcttttctttcaagtgataaatatccaaaatatttacttcttggacctcagaatttgaatgtagatatacagatgactggtttctagattaagttttatagtgttcctctgaattagacagtatggtttatatttcttgttttgtaaacatttgtgttcctgttttctgtggtgagagatggaggcaggattctagtctcaagtgttctagttacaagtcctgtactttttttgtggtaggatcacttaagtttttggattttttttttcttttttttttaggcataaggactcactctgttgcccaggctggaatgcagtggtatgaacataactcactgcagccttgaactccctgggctcaagtgatccccctgtctcagtctcccaagtagctgagactacaggcgcacgccaccatgcctggctcttttccaatttctgcatgagaagttaaactttagttatgttttggccccccttttctggaatcctaataaaggtagtatgtcgactgcctttttaggcaaaagtaaccactgattggtaaatcgtattgagacttgaaaaactataaatatctgaggagcagcagcttacgactatggcattgttccaagagacactggcttctctggggcatgaggcttttcagccatggtagctcttgcaacttcctgatgtgagtcaacacgcctgcgctgtctgctagagaccccaagagaatggctcctgcacagctgtgaggactgctgggtgcacactcctctggaaaacaaggcatgatacagccttgctggcaagtggggtctcctgccttacaccctgcactgtcaatccaatgccaggcagtctgtgggggccttgacagtctgcatgttagttagaccggagaagcccctccacccccttggcaggcatttcagaataaaaataaagacataatgctaaaagacttatcataaaaatgaacagcctctctgtgccactgttcccgtctttctccctaaatgtctgctctgatatttacttccatgtttctaaataatatatttatgttgctctttcctgattaccagttactgacatctgttgacttgccatatggaagataagagttgttccttttatactgcttctggtttcttgttcccatcctttcaatgctgttacatccaaagtctaatttcagtcaatagccagtgtcacagcacatggcaatgtgacaattgctcactgcataaccaaatggatactctgaatatatttcctcttctacagattttttttctcctggggcaattttttttttttcatgttgctttgttttctctgtatatatttttgattttccccttgcattctgtgtcaggtctgtcaagatgccttttatttttcaaatattcaaaagtatcagacctgagcccagggaggaggtgcaaacttgtagttgcagctatttgggaggcctaggctggagtattgtttgagcctaggagtctgaggtcagaactgggcaacatagcaagaccccgtgtcaaaaaaagagaaaaactaaaggggaatgaaagaacttttagaacgatatcagaccaattattagtttctttttttctcatggagatgtacttactagacctctccatcctcctgctcttatctgaactggtttctgcttccttaaactgccatttctcccgtgttctaggacttcccttgggttctgactgatttcttactgtgttttctggattttgctggagcacttccaaaaagagctttatataagaaagtgttcatgtgaaggagataaagatctctttgcaagtctcaaaatttcttttatctttcatgcttgatctttttgagcatgtagttttacactgaattgttttttcagtgtagaagatatgacttttagtagaatttaatatcgctattcagaaggcattgttatcatagatcatttgttaataatattcctagttttagtctgctagcaatcatccacatcatttgtcaatcctttgattaaactctgcagtttggagataactcctcattgttctcttggcattttgtacagatgactcatctaagaggaggaggttgtatatgtatatatacacacacagaacagaagtcttcattgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggtattgtaaaaatcctagacccctcctactttttttacatctactttctctctgaaaatgtcttcaaccaccaccccacaaagttttcttcttcttgccatgtacttgattgtatatagcatttatttatcttttttttggtttctttactcatcctaaagacattctacattgaaaatattttgtatatagcaaagcacagtaaatatcaggtgtcagcaagtttctaaattataaataatatgttttttatttgatcgagtgggtaatatgtttcatattaaattgttttgcaaggcacagtgtatgaatagatgaatacatgtatatactcttaaaatgtcgtatatttgtacataattgccctaaaagatttatcgaggtttgttttctgtattatgtgttatctatttctgtcttcaataatgtttataaaataaccatttgttgggtaagtactatgtgtcaggcaccatgtaatgcttgtgatatggaggattttcgtactgattctttcagtactaagaggaagagtttttaaagtgtgtgtgtgtgtgtgtgtgtgtgtgtgtgtgtgtgtttgtgtttgtgatggggtctcactctgtcacccaggctggagtgcagtggcatgcatggtcatagcttactgcagccttgaactcctgggctcaagcttcttgcttcagccttcccagtagttgggactacaggcacgcactatctcacctggttttttgtagagactgagtcttgctacgttgcccaggctggtcttgaactcctggtgttaagccattctctgcctcagccttctaaagtgctgtggttacaggtgtgagccactaagcccagccaaggaagatgtttttattgttcacgttttatagaagaagggatagaaacatggaaaggtacataacttgcataaggttataaaattggcaaatgatagaattgctattcacgcccaggtctgtttaaatcttgaacccaagctcttaatgtctgtactctgctatgaaatggagagtagggaaaggaaaaagaaaaaaaaaacaaatggctgtattgtctcatatctgaaagttctttggcacagtttagtttaaattgatactatatagttctatttttttcttactttaagaaaaaaatagaggcgggatctcaccatgttgcccacactggtcttgaaatcctgggttcaagtggtcctcccacctcagcctctgaaaatgctgggattacaggcgtaagccacctcacccggccagtactgtatagttcttaaatattgatttgacatacataataacagctttgtttactgtagttataatggaattcagtgtatagttcttgctaaaagtaactacattcagtcacagcttgaaagaaaaagtaccagacaacagaataaaaccatacaggagctgataatttacacatccaaatattgggaaaatctaagttgaggttccacagcaactgcagctcagcctcagggcagtgaatgttgccatccaaactggacactgtatgtagcttcatgaaataatattctccatgctctttggtgcctgataatggccactgtgggaacaatgtgtgaattatcagtgactgttttatcactgtagtttggggcatttcatttatgtggctgtttcacagtgcaacataggtgtttcaagtggtgatacatcttggtggcatttcagtagtccttaaattattaatgaatcctgaaaaaaagatctgtaatgtgtaagattatttttgtgtcctacatctggtttataaacaaatcacatttgctctccttcctgcacccactcccattggaaaagcatgattttgggagttcgtgtttacattccaagtgcagttctcaggcacgttcaagatgttggttaacctttgaaatgtattatgtgctggtgcttaaaggagatagatgactaagaagtacatattagagcctctcaagacacagcatcatcaatcaaatagcctggcttcatgcagagctccaccatccacaaagcacagagcacagctacgactcacagaaaagtttggtgcccttagtttctacttctcatagattcgcaaaggaaatgtcagttgggccttactgcctgctttgccgtctcttactatctcttcaatgatttaatatattgtttgacattgtatcttgaacctataactcttgcttatctgttgttcctattgatggcatacacgtttctactgtgagtctctggaataacatgattgaaaatataaaatttttctccagtgttggacttcctgtcctaatatagatggcttggtaaattcccaatgtgtgcacctatgaattatgttgaaaaaagttcacaataaaatcaccattgtcaaatttatgtaatagaaaagatcaacctaacaaattatatgtatacataaattatacatataaacctctaagaaacagattaaatacattttacttagttgcatttggggaacatattaccacagagattcctaggcatgattttactttaattagcaaaacatttacagagcttctagtaggtgccaaagactatgcctccatcattgtgtttggagaatctgaggatctcttaactgttctaatctggctaataagtccattgatctcagtcaggtatctttatcgttattcaaatgattttgaaaagccaacttttaactattaataatagtgaactctttaatgaaaagacagtggccgagattataaatgaaggtagattcttgggtggcttttcatttatttttgtgaactaccacgtttattccacatgcacctttttgaatactgattatcccatttgaacacctatctaatcattggtttgtaagctgagaatagtataacttcactaaactgacatgtgtaaacaccagcaaacttattgaatttctgcaacacattggagcaatttgtacaaaatattgcctttgtcaaaggaagcataggaggatgggggctgagtactttgttactttagcttgtccttttgtttggtccttcatgcacagaagtaaacaaaagtggtccattatggctaagaccttaatacctttacagatacctctaaataatcagtcgattggcttagggtaactttatgtgaaattttacgggatgaagcctgtaaaatctggaactataccactgcctgttccttttgacaagctgtgttagcaggaatcaagaactgagaaacatgactttgaagcttttggtaatggttatggtttataatcgttgtaactgttttgagtaggaagctgttttcagacatgcatttccaatgtcatgtatatttgtttatcaatacattgtaacaatggagtaatatgtaattacttcctaaaatatacatgaaaagaaatgaaaaatgaccagataagaaaattagcataaagataagttttttctttgtttttttgttttctttccttatcacagtagtatatcttattcaccttctgggatacactatctcatgagactcttgttttcaattttagctttttacaacacacactgatcctgtcattaaaggtcatccttcttagaggaaacagttaccaagatcataatgcctattagacttccattttatccagtttcctttcacattgtagcaagaaacctaacacagagtgtacttttctttgtgttggctgcctctaggatgaggatgggacagaagaggataacagtcgtgttgaacctgttggacatgctgacacgggtttggagcatatacccaacttttctctggagtaagttactgatggtttcaactaagtttgcagtatacatgtagcatcattaattgcagcaagtattctgaaagcatatggcatgaggaatgtttgtgcttagttaaaaacatgccgtgcattgatttgtttttctaaagaacatctttcatctcttgagttaattatgtaatgtaagcagtatagcatggaagttcatgtgtaccagtcctgagtttcatgccctggcaaatactattgaattataatataaaatagtatttgattgaagatttttgtcatgttaacaacactgtaaacaccgtaactcttttcagattgctttgtgtgtcaatattttgatcatgtgtttgttcttcactttgctaaattaaaaaaatttgcagacatacttgaaaaactagttagatcatgttagcattaattattatagtgcatgtaaatatatgtatttattgttgtttgaagaaatagaatctttcaagatatttaatgaaaaagggaggtcctaggttagggaccttgaaaatgattttaagtgtaaaaggacaaagaaaaatttcctgtttgttccacagtgttctgattattttaaatattgacatgtgtaaatggtaggcattctcaggacttctttccttggtagcttagagcagggagggcagtcattctggatttttttctttgactttgggcaaaagttggggatatagacattgacatttatgtacttaattctgtcttttcttggtcttccaagagaagtgagattaagcaggcactagagtcagatgctgtttgaatgtatggcagccagcacgctgagtatttacatttagtaaagtacttgccatgccatagttctgtttagactgtgggataaaatcagtttattgaagttatgctattcttagcttacaaaccaatgattagataggtgttcaaatgggataatcagtatccaaaatagaattttatgaaatttggtaaaaaaaaaaaagtaataaaaaatccatttaaccatttggcagtatggcagaatttttatgttgtcttaattagtgcatgtgattaaatctgtgcacatattttcaattttgatttgcttgatattcctgtctttatgcaggacattcatagtacataggataacttcaggtttttatattagaaacataattgaaaaattggcattttccatcacataaaattatattgtgatctttgtgaaattcattggtaataattgattgttttccagctggcttaaaatagatgtttaattgaagtactgtttccaaatattggttgttaggtaaatactgcttagacctctgatgttatatgtatatatgaaaaaatctacaaagaaagaaaaatctcatttaaatagtttagaaaattacattgtctatacaaattttcattaaactcaggctttattttattaatagtaaagattcatagacttgacaaatccatacattatgtaacgttatgttccttatgcagaatagttttgtaatagaagtaacttcatgttatgtcatataatataaatagcttcatagctgtagtcccagctactcagaatactggggcgaaaagattgcttgagcacaagagttctaggccagcctgagcaacacagcaagactccctttctaaaaagaaaattaatttcgagcaattttatgaaaattatttgatttgcagtagatgcctgttggctttgagaaaggagttttgtaagctgcacttgtagcactcttatagcggtttaggaaatagtgactttgaattgtcatgaagtagtgagcagtaaggacaatggtgatctcccttggactgtcacttacaggagtgaaaactttggtctcattggattattggaaggattaatgatgtgacatataaaagagcactttgtaaattagaaagtgttctgtagctgcaacatctttattcagttaatctttagagtccttggtagctgcaacatctttgttcagttaatctttagagtccttgacgtgagtgttgggatggaagagtttcagtgtaagtctaaagattttacttgaaagacataaacttgtattacacagaagaatagggtcggtccaagagaaatgttctgtgtcattttaatgtagttatctctgatgattgctctccctccatgccatcagactagtgttcaggtatgtagtgtttaatgttgccttcatcaccatgcttatattccagaatatgtatatatatgcctatgcacttggtgggatttttgttctgttctcttttgttgtttattgtgtgtctgtgttgttgcagttttttgttttgttttgttttggttttggtttgtttacagtacacgttcatgctccctcattcatcattgtctcacagtgatatggtaaagctcgtagaagtccccaacgatggagggcctctgggaatccacgtagtgcctttcagtgctcgaggcggcaggtaacgtatcttggaggtttttaattgaatcataatgtagagtgttttatcttcatttatgctcagatagagagtggtgttgacttagcatatgcttaataggaaacattctcatttggaggcaactgctccttcattcctatatatatgtcataatcacagaaagcacttagcctgatgaagagaggttttgcaggaacgtgaagaaactgcatttgaattatcctaataaatttattgttcatcacactcaagcaaacattttactttgctgtaaattgatgatggactttcaagtcagaactccagatgaatttgcaacgttaaggagagcttaaaagcactttttttgggaaagcttaatgcaataaaaattatctagatgacttaaatttgatttaagctttaaatttgtgtttagttcttcaattttatgagtttttttattgttaaaaacctttaatatgaaattttaaaaaattaggcaagccatagatttctgaaccttgagtctaaaaatcatgtactgtttgttaatctcaacttcattactttacagaacatgcatccttaaaaacttcaaatgttatgtcagtttccttgattctgttcctttttatgtgtgaaaggactgttgtgatatttttggttttaatgtattcaaatagtatgaattgattttccaacaaaggcttggcagacctctgtcacagacaagtgaggtgcaccgcatcctttcccatgagtctgaacttgtgcatgtttaacttgtttaatttaattgcatcttctcttacttgctctctaatgacctattttggctttttaatttttaacttatttcttttattgctatcaccttattttttttctttttattttaactttctttacatggtgcgaaaaagtggggaagttggagggtagacttatagcagtgactgagaccgtagaacatagtttaaactgttgtcaagtaattacaggcatctagggtgttgtagaagatagatgtgtgggattaaactatgcattttatttttttaaatgagtatttgaacaatggtagtactttcttgttacttgtaagtaactgtggtgagttcagatttcatctctcatggttcatgcaatgttctaaagctgaaacttgacttagaactctgctggagtatgaatgaggcttgaatggtagtgttacataacaaggtataacattcaccttgaattttcaagtggtgttatattcatagagttgtggctgcttttactttttaattctctttaaaattctttttttaactttagagaagcattaaaatttcttcaaataacttatagttaaacaatattattttcaacatggccttgcctttatttcgtgtaagaaattgagttctaaattacctcaaaagttaaattttgttttcatttctttccggagtaggaaaaaaaagataaggtaaaatgcatggattatagcttcccgatatgcatatgtcttaaaatgcctgtgaaacataactcatcacaaatgagatttaattgtgtctgtaccagctttgagccagcatttcaattacatgttactatattttctgtcgtttattgtgtattttctacctcactgtgaaaggatattagggtaaagtgaacagatgaaaagcctaaagcaaatggagagtaagatggaaaaataaacttactatctagattaagtcaaaggaaggcatttcacaaaatccaccacagtttctggttaccatggcatttagttttgatacaccaaacagattcaagaaaacaagtatgtctttgcagaactagaagttcttttatagctgagtcatttttaagccctattagtttggcacttaatgaagaaagtcgtgcacagagattttcaaagagacaaagagatttaagaaaaacagattctttataacctcttcttaggcatcaccaattttcatatggaagcagaacagaaatagtttgtgattccccaatacctgtgttgcatggttaagcttctttgtggaattgatagtcatggttcctcacagatggttaacaatgggagagaaaaagtaggtggtctgttcagattgacagatacaaatctccaagaacccagagatccccaccttcctcattctcagaaatgctcggaaatggattcctgttacttcataagaaacctttccaagcatttctgttgtgacaatccctgtgttaggtgctaggaaacaaagatgaacggaatatgttcttcctccagagatttgcagtctagacggagtgatagccaagaaatcacacaattataattatgtgataaatgttgatatagttatataataggtgctctgtgagctgataggggaagaatagtctgaattaggcaactgaaaatggcttgttgcggaagatgattttaaatgtgatgatagcttgtaaaggtagctgtgtcaacttcatggtggcttgtgcaagagtaaattaagcaatgtagtatagcaggaaggaagaaattaagtgaagttaagaaattgcacatatatctagtaggactacaataatatatattcatgatatgtaagtagaaatttccaagataacttcccttatataaaactccagtcattcttgggccttctcaattttggaggataactaattgaataacagttactgaatacttacttttataaaagtgacaaatacatgtcaatattgctttctcatttagattttcaaagtcagagcatctaacgaataatgcagaataccaattgtatattttgaagagaaggaacacaacccagaccacctcaaatatcaaatgtcattaaggaaaatagtaatgtaagcttgtgaagttaacgttagagagttttttacagccatgtagatcttattgtgacctgatgtgtgatgaagttttttttgttgttgttggtttttttgtgtttgttttttggttttttttgagatggagtctcactctgtcacacaggctggagatcctggctcactgcaacctccgcttcccgggttcaagcaattctcctgcatcagccttcctagaagctgggactacaggcatatgctaccatgcctggctagtttttgaatttttagcagagacagggtttcaccacgttggccaggttgatctggaacacttgatctcaagtgatccgccggcctcagcctcccaaagtgctgggattacaggtgtgagccaccatggctggcttaagttttttaaaataagaatcttgcactgcttactttcaaagctattttttagactaggttgaatgtttttcaatcaggggcattaatgacaattagctcgtcctccaacccctgtcttagttgactacctgctgatatgtagaaatagagacaaataggtagagagacaatattatcttccccatgatgatgtttttcttttttttttttttttttttttttgagacggagtctcgctctgtcgcccaggttggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgatgatgtttttcttgagttatttccttgtatatgttattcaaaaataaagttaactgatcctcatctatattcgttcacggtttcattactttggtgatttctttttttaaattattttcttagtagaaaaacatttacctaaaacgtttcattaccttggaatcaatttttatttcatccatatcatttcatttcctcctgatttaaatgagaaccatcggctgggcgcagtggctcacgcctgtaatcctagcactttgggaggtctaggcaggtggagcacttcaggtcaagagttcaagaccagcctggccaacatgatgaaaccctgtctctatgaaaaatacaaaaattagctgggcattgtggcaggtgcctgtaatcccagctacatgggaggcggaggcacaagaattgcttgaacccaggagatagagtttgcagtgagccaagatcacgccactgcactccagcctaggtgacagagtgagactctgtctcaaaaacaaataggaaagataatctctttatttaaaccacaaatgccactattttcaggaaggttatgccaaataattgtgattacctttggcagaagaaccttgcttttttttttttcttttttaatatttctagaacctggttgtaggtattggtctacaggaccataggtactgcttagtgaagcgtaatcagcacaggagcaaatgaacccatgactatccatattagatatggtgttactatattaacaaagaaacggtaatgatacatcctggcctggatggtggttaagaagtatttctgacactttctcatgaaatagatatatgattatgatataatgttaagtatataaaaagcaacatataaaattgtgtgctaaaatagggactggacctatgaaatgataagattttgtgtttgaggctggacatgatggctcattcatgtaatcccagtacttttggaggctgaagtggaaggatcacttgaagccaggagttcaagtccagtcttggcaacatggcaaaaccttgtctctgcaaaaaatacaaaagttagccgagtgtgctggcatacacctatggtcccagccacttgggaggctgaggtgggaggatcacttgaatctgggagtgtggggctgcagtgagccatgatcatgccactgtactccagcttggcatggcagagtgagaacctgtcttaaacaaaaacaaaataaggccgggcatggtggctcatgcctgtaatcccagacctttgggaggccaaggtgggcagatcacctgaggtcaggagtgcgagaccagcgtggccaacatggtgaaaccctatgtatactaaaaatacaaacattagccaggtgtggtgatgggtacctgtagtcccacctactctggaggctgaggcataggccaggcgcggtggctcacaccttaatcctagcactttgggaggctgaggcgggcggatcatgaagtcaagagatcgagtccatcctggccaacatggtgaagccccatctctactaaaaatacaaaaattagctgggcgtggtgatgtgcgcctgtaatcccagccactcagaaggctgaggcaggagaattgcttgaacccaggaggtggaggttgcagtgagctgagatcgcgccactgcactctagcccaggtgacagagcaagactctgtctcaaaaaaaaaaaaaaaaaaattactactattcttacttgggcttcataatctaacttaaagtagatactctaaatcttttcccctatggaaaacaattatggctaaaacattttaaattaattaattaagtagaaactgggtcttgctttgttgcctaggctggtctcaaactcttggcctcaagtgatcctgctaccctggcctcccatagtgctgggattacaggtgtgagcggctgtacctggcctaaagttttcttctctggatcttttttttttttccttttgagatagcttctcactctgttgcccgggctggagagtagtggctcactgcagcttcaacctgccgggcttaggtgatttttccacctcagcctcccaagcagctgggactacaggcaagtgcctccatgcccggctaattttttatattttttgtggacatgaggtttcccaatgttgcccagtctcgtctcaaactcttgggctcaagtgatctgccagctttgtcctcccaaagtgcatggattacgggcatgagccaccttgcctggcctggatcttttctataatggacatttctcacttatttacatctacctttattcttaagtctgtggcacttaaatttgtttcacattacttttccttgtgaaaatagtaattgtatgttggtgtttatatacactttttttttttttttaagatctagtatctactagttagcatttttggtgcctttgatatctcagatcaaagattcacaaactttctgtaaagggtcagataatcagtattttaggcatcatggcccagaaaatctgccattgtagcatgaaagcaaccattgacaagatataaacaaagcttcatttacaaaaacatattgctggctgaattgactcataggctgcagttgtcagcccttgccctagggaaccaaacaaataaaaatggctgccatgatggttttacattctagtatttttcatgtctaaaacttcttcacctctgttttctattcatatctttgggggacaagagtgtacaggattttgatttccacttactgtttgataagaaagcctcttttgttgtaactacatattaattcccagcagtgcatgtccttgattctcaggaagaagggaagttgaaaaaaaccatataagcccatttaccatactctcattagtagtatgtactcacagaacaatccttcttaacatctacttgtcaatcataagacttaaggaaaaatctaaagtttcacagttagaaaatcaggccctgtgaagatggtggtgagggaaatgaagggactctgggtgtgggtctggctttctgctactgactcatgttggcagatatcttatttattaatttattctcaacttactttttacagatttgccatcatttgatttgtctgattaactttgatttttatcccaaataatttttttcatctgtttatcttcaatacaatattcagaatatcaggtgaagtgtcaacatcctttggaaaaagcttcttcaatttctgtgttaaagtttatttttatgacttttcccctctttatttatttgcttagttacattattgtccataaattccatcatgaagctgaaaaatgaaatcacatctctaagagaatattttttatttttaaaattgatttattcttttttttactttctttctttctttatattttttgagacagggtctcactctgtcacccaggctggagtacggtggcaggatctccaggctcaagtgatcctcccacctcagcctccctagtagctgcgaccacaggcacacaccactatgcctggctaattttttgtatttttggtaaaggtggggtctccccatgttgcctaggctgatctggaactcctgagctcaagtgatccacccacctcggcctcccgaagtgctgggattacaggtgtgagccatcacttctggccactaggagaatatttttaatgttttgcgtttttgagttgaaataaaagtgaccctgttggaaaatatgtatttcataagtattattatttgcattctatttaaacctgaatatagattaattagaaggtggttaaaataatctatatgcagattgtattttgtaattaatctatattcagaaaatcactgaaatataaaagtttgttttttacatcctgcattcatgtcttgaataatttccccctcaaatataaactgatgtttctctgtctacaagactagtagtcaaacatctttggatggtcttgagacataccatactcatccatttaattcagcagaatctgagcttcactctcccctcaactaagatttacatgattataattatattgtttgtcatttttatcccttcctgtctgaacaaaaactgtatggaatcaacaccaccgagctctgtgggaaaaaagaaaaaccttctcccttcgctctgctggaagctggagggcgctaggcccctgtgcagtagtgcatagaattctagcttttttcctcctttctctgtatattgggctcagagagtacactgtgtctctatgtgaatatggacagttagcatttaccaacatgtatctgtctactttctcttgtttaaaagaagaaaaaaaaaactaaaaaaaaaatgaggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctgtcctaatgatgacttgagccctgccactcaatgggggagtcagcagaacctgtaggatcttatttggaattgacattctctattgtaattttgttcctgtatatttttaaattttctttttgtttcgctggaaaggaaagatgatgctcagttttaaacgttaaaagtgtacaagttgctttgttacaataaaactaaatgtgtacacacacaaaaaaaactatattgtttgttatacccttttgttcatctaagatattctttatcattttttgctctattatgtattgaaaacgcaatttattttccccagatttggagttgggaattttgtattacctctctgtgtcagtcagtgactgacttgaccttatgttgtcctcgttttattggcacggggattgtcaggactggggaaggataccttgctcagtattttttacgtagtgtggccttgggcaagttagcctcacttagccctactccttacatatgaaggataggaatcatgacttttgtatggtttaaataagaaaatatatgtaaatcatttagcaaggtccttggcagtggcagctaataagaatgatcaaatcatgagaagagattttatactcaatttatcttttgttatgtgccttgaaattccctccagtggtgcttggtattctggtgcttggtattctaggtaggtagtgattagtctacccaatcagagaaagtgatcattttcctcttatatcatgaatctgggagaaaatttactattatgtcgtaaaattgagaatcccaatacacatttgtttagttaattgggtacatatgctaatgaagaattacagtcaatttgagcttcacaaactagctgagaataaatatgctcttgaacttttgagtactcaattttaatttaataacttttgaaaaaaacgcaatttaactttatttgctgaatcaatagtcttttgtctgaaagttttcaattgtgcattctcagccgcagactcatttgttataataaagaactataacatacgcattggttttagagagacaagttgcagtttacacttacatgaatcatgtctctttatatatagcaatatgacatctgtgatttctgctgtaatctaaaggaattttccatttttatttacctttttggcctgatttatctcattcattgaagtttttctaaaaaaaaaattaagatttaaagttttaacttggcattcctttaaactttctccttttggtgtccatgctttcagtggcagtactttctgggctcatgtaggtagttgctggccccccatgggctgtactcagggagctgagcggttcttgttgatgagaccctattctgcccactcatattctgccttccctaccgttgtgatgtttatactgtgtcaacctttattaagatgaattataatcatttccatacagctgggtggcagttgtggtagtttacattatcaacgcaaaactcagacttactcagccaatttggatgtcaataaaacatttgttacttattttcagttttatcattggttgtaatttatacttagaattgaaaatgttaacatgtgtgactgcgtttgttttaattaagtgtataattaggctaatgaaccttgtaaaaatgtagtggtgcaatccttaatataatctaagtagttaaattctaattatgcatccaaaatcatgtacaaagaagcagcatttcaatggctcgctttgtgctactgtaccctagcttgtcttttttttttttttttttttttttttaagaaacattgttcaaaaacgaagtcttgaaagaaatatgcatgtaacatacttttgtattaggaaaattattcagaagtgatatttgtatgcagcggatctagtgttttcttcttttcaaattttgaagaaaatataggagactagaagaggaatagatttggggatgtttcagctccatcaggaaaaatccatttgcttgaaaagcataaagccaagtagggtttatcttagattcataaggaaggtagaggaggttctgtttcacataaccctaaaccctataatcatttcttcttaaatctgcgccaccccactaataaatgcccaactcttttctcttatgtcttttgtcctagcataacaaatctggggttgttctgctcttggaaccattccccaaacagagcttactccaatgcctcctttcctgacacctacctcttttattttttgcaaagtggtttcttcttaggatggaacatggttgacccaataaggaattctggtattagctgccaagaaggaacactgttctctctaccagcacactgacgtgccaaaatgtttagaacttcatttgctttgattactttctctaataaaactgttgcagcagccataccataggcagttggttctttattactttagaacaaattctgatttctagttgagtttgcaaaatatatccctaaaatttgtttttaattatattgtttgatacagctttaagttgcaaatgagggctatggaaatgtatctgctcgcgagcacacatttttcaggaaagtgtctcttcttactacttttgatttccttcggaggttcttttcattctcagtctagctgttatcagttggattttcttgtgacttttttttcttttgatagttcattcccattcctttgcaatcattttcacctagtggagtaaatgagataattttgcagattgtaccactttccttttaaattaatccattctttttgagagaatgattctaatagtgtggttaagtacttagaaatcagcaggctactaacttcaccttaattcagtctgttcccttgattccctcatctcttgctgtgtcagtcagggtgatgttctttctcttctgcagtcttcttccaccctctatctcccagccccccatcaggtctcttgtactgagtaaaaggaatctgagatctgagattttcatgacttataacaatgttggttgctaaagcctcagttaataaatttccattatagtttctatacgtgtgtggtgtatttatgatttgtagaatttctactgtatgttaggattgctaatgcatttggccattgatgaggacttatttagaaagacaaccattcaagaaatggaacattacatgcttttctactttggattattagtctagaatgattaccagaaaaaaaacacataggtttaaaactgaaaaattatgagatgaatataaatctgttcatctacttatctgaaaaaaattattgatgttacttctagaattaaagagcagatttcagctggcacagtggctcaagcctgtaatcccaatacttttgggaggccaagtccaggagttcaagaccagcctgggcaacatagtaagaacccaagtctacaaaacaaacaaacaaactagccaggggtcgtggcacacacctctaatcccagctactcaggaggctgaggcaggaggattgcttgagccccggggtttgagcttgcagggagctgtgattgagcccagtatacctccagcctgggtgacagagcaagattctgtctcaaaaaaaattaaagtgaaaggatttataagttacactgttttaagttgtcataaatactgaaaggatgtatccaagatagtttcataaatttaaataaatgatcggtgctaattaactgctaagtaatttccattgaagaccgtttatatatatattttttgtaaaaattttctatggactattttagattacacaaaatataatacataaaaacatactaattgttagtcacttacatttgcagtaatattgtagtcatattgggaaatcgcttatgatttcaccaattaaaaactcattaactggagtgagtcttggtagggcatatttttattgcaaggactgaaagcatacacattccaaagtgtgtctggtttatagtggtggcttttaactacagctgtggcacctcacatgtggttctgttatgattacctgtgggtgactgagacatcgtttccttcaagatgttctttgaaactgaagtggtcagatatcttctgcatgttctagtggtaccagtaactgtgatttaatttaatttcttgtattaatcttcctcattcatcggaatcatagatatatcttaataattcttttttttttttttttggacggagttttgcgttgcccaggctggagtgcagtggcgcgatctcggctcaccgcaacctctgcctcctgggttcaagcgattctcctgcctcagcctcccaagtagctgggattacaggtgcccgccaccatgccaagctaattttatacttttagtagagagggggtttctccatattggtcagtctggtattgaactcctgacctcaggtgatctgcctgcctcagccttccaaagtgctgggattacaggcgtgaaccactgtgcccagccaataattcctttgattcctatgatagaacactttgttcagttgcagatagaaacaaacaatagggaatcctagggagataaattatggacatgatcacatttaaacaataacttcatttttggtttggcatattatggaatctctttctcccaaatatgaactgagagttaagttgctcctgaagataaatcagtgtactttattcttacctttgagttgagataattttatgtctttatatagctgcaataaatgataataagtaactaaatattatctacataatattgtttttactagtcactaatatttttagactcatacactagtaggtgctgattctcaacgctaaaattacaattcttgcaagctgataggcttcactctagtataatgccaccttattatatttattaataaaagttagaatgaaattaatcgttgaccttactaatatcgtaaaaatgttaaactgcaaaattacaagtgaaataggacttttgtctgagtttaatttatttcagtttcatcatatctttagtagaaatgatactttcatgaagaaagaatctgaatctaaattctattcacttgtattctattttgcaaaaagcttatagaaatagacttgtttgcctcagctaacctcaatcatgccttcattcagttgtcatttatcaagaccttactactagttcagtgcttgaactgctgaatcttatgttctctgtctgctaggagcttatagtccactaatagagataaggtatgtatataagagaagaatatgataaatgcccatggaacagatacaacaattactggaaaagtatagaagcagcagctatctattttggtatatttctactggaaaacatacacagatgactgcaagttgtaattctcttggaaatcatttagacattatttgaaaattagggtgtcttcaattttaatttatactggattctcaattttagtgcctgtgtaggcatttttgtctctttattaggattatgaaagaaaatacaaattttggaagtaaaaagactaagttcatataaaaattttaatatcatgatacaaaatttatgccagccatcaagtaattaacagtggctcatgcctgtaatcccagcactttgggaggctgaggcgggtggattacctgaggtcaggagtttgagaccagcctagccaacatggtgaaaccccagctctactaaaaatacaaaaaaattagctgggcatggtggcgcatgcctgtgatcccagctactcaggaggctgaggcaggagaatcgcttgaacccaggtggtggaggttgcaatgaaccaagatcatgctattgcactacagcctggacgacaagaacgaaactccatctcaaaaaagaataaaataagactaaaaaaataaaaataacagcaatcagagctaggttaagacccctgttgcttatactgtgatttaaagaagtatttcttatttgtcccagtctgtatagaatgtcctgtcagttatgaagttagtgttctagagcaagtagggggtctctcaaaggtcattcacacttttctttcaacctgagtgagtacatatgtggaagagatgaatggtgattggcattatttgaacctctcactgacgtttttctgttgggtcatttgtttttccaaatgggaatattgacaataaatgacttacttttgggagacctgacaggttttgaaattcacaatactaagcactatcaaattcaaatgcaaagcatggaaactcctttattcctgaaatctttcctattatcattctcaaacctgcagtgcaatgaggttagcttttcctcattacctttactttcacagaaagatgggagttgcagtcgtcttttaagctagcgtgccagctggcttaaaacagaaaattgcccaagccattcaaaaatacatgcttatccatcctccacactgcaatacccactcaaccattaggcgggctctgtttggggcatttgtaaacagagagagtgttatagcttgttctagaaacataatactgaccagccagaaactgattttttacatttatggaagggatgcatttttacatgtcattttaacgttgtggtttttgtctgtcatttaaaaatgtatgaatagtcattttaacatgctcctttgtaaggacatctttgtaaatataataacagcattaaagtggtaaggcagtgtgcatggtggagatattacatgtgtaatcatttgcattcttaatgttccagaaccctggggttattagtaaaacgattggagaaaggtggtaaagctgaacatgaaaatctttttcgtgagaatgattgcattgtcaggattaatgatggcgaccttcgaaatagaagatttgaacagtaagtgtgtgctcgctgcacttctgttcttacttgcattaggcatgacagagtgcagtcagttgaaatgcttcaaacatgtctgtgatctcagtctgtatactggagaggaatattttctgccattagcttttaaaaatttaaacatactcagtaattaataccattagactatatttcaaaatgtcctctgatggatatagctcttcttaagtattatggcccccatttcaactttacaattttgctggttcctctccttttggaaaattgacagtgtgcccatttttatcatactttaactcacccgtccacctttgctgcacacagtttctctagatacaaacaagcagataaagctgtttgtatctgcttgaggttgtattcagatacactttatcttgggttgtattcagatacaatattgggttgtattcagatacactttatcttgattcaggcccttagtcaatgaaaaacataacagttggccagttcttataaaacaaggcaggagcaaacagaactcttaagaacttgaggtcctgaccagggaaccagcatgagaaagagctgcttcccaggctggttgtatgggtgcactgtgacccacagctgtcaacattttgaattattgagcctggattgctgttcttgagatttttacatataccaacttaataaataattaatagttactttctatagtcttctaagtgtgtgtgtgtgtgtgtgtgtattttaaaaattttaaatacacatctaacccaatccaatattctaaatataattataaagctctgtctttctttgaaaacttaaattgaagtattttgtaatgtctacaagttgtattagacaatgttgtagagagaatgttccatttggtttctattattgaaattataatacttgttatacttaaaacatgtttaatgatttacagttgagaggacagaattttatctgtagttgtagataatttttctatttttattgagagaatgagaaatttatatttgaagaaacagctattgatagatcagagctgcaaacttgattgataaatgggttattagaattttgcttttcaatttcaacagcctgtcagttcttattgcttaattagtaaacttaattaagctcataatatcttctagtctgccagtcttaatttgctaattttctattctttctcaaacccagagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacgacctatcctgtttttgttttgtggaatttcttttcttagcagcaacacacaagggtagaaatggaatttattttaaaagtcaacctactaacccaaagcaccctgagtcttatctaattattttgtgaaagaactgatagattttttaaagttacttaccttttaacatatttcaaattgtatttcttatatgtctcaggtttattttgctctgtagaaattaaaatgtaaaagtgcagagaataagactatgtctatgagaagaagatagcagttactgtagtaaaatttttgattgtgaaagaaaatggcttcaggacattaatatcaaatgcagaacaatagtaaggatttgaccattttgactgccccatttgctgtataagtccagccctcaaggaggactttagaggtagtgcacgtcaatctcagtatttgatgtggggagggaccaatttgtttgaggctgccaggagtttatagtaggttgctgagaagccaggccattgactcttgtcttttgttttcttgtattattgcattacttccctttcttttttttcttttcttttcctctcttttctttttctttctttttttttttttttttttttttttttttgagacagggcctttctttgttgcccaggctacagtgcagtggtgcagtcatagctcaccgtagcccgcaacaccccatgtcagccttccaagtgctgtgactagaggcacatgccgccatgcccatctcatttacaaattttttgttgtgttggagtcttgccatgttgcccaggttgatctggaactcctggcctcaagtagtccttctacctcggcttcccaaagtgctgggattatggaagtgagccaccatgtccaggcctgcttctctttcttatggtgatgtggaagtcatgatgtcgattgccgattcttcatacatcttccatccattatgtattttagtacccttcctgtatacagtggatctctgtatagagagcatgttcttgcagtttgcctccttcaaagttgagtgcaaactattggacttgactttatgattttcacccaatgtttcgtccaggcaccaagatacacttttactgttcctgatccattttagctgagcattttgatatatttttaaatcatgtctttcaaaatggtattattataaagaatatttttttttataggctcaaccatcaactcttatagttggatggaaatgattccaagagaggttcattatttcctcaggtcatgtggctgttggccacagattcttactagtatgttttccatatccggatattcagaccattcttctttacatttggggtagcatttacaaggttgtaaactctgagactgctgtttcctttctaactcatattctttcagtgaactttatgtgaacctcaagtttcttatttctggttactggtttttaagctctaaatacttggttgacatgatcaggagttgacagcttgcctcgttgcaaacacagagtcatatcaacagaaacccctttagctctgtcaattcctaaatgagagaaatatcacatcctctttcctccttttgctctacttaaatgacaggcccttgtttttaaccaaaaacatatcaagaactacaaatagaatcgtataaaaaataaaattctgcttgatatctctaaacaaaggtacagtattttgcttcaccattgtcataaagatactggttcataaatatcttttcctttttacactgatacagcaatattcatttagttaattatggtttttcaaaaattaggatatttgacaaatcatgatataacatgaactttttaaatgaggtgatttgccattaaaagtaccattgttttgctaatgaaagaatgagaaatacaaaggaaatctgaagtgagaagataaaggtaaagtattaaacagaatacagattctccaaaaaaaggaaaataatgagtatatctaatttttatgttatagtaagtctgaagtgataaataaatcaaattgatacattttacttacaaaactggtaccattgttttgaatacagatattattttaatagcatttaatgaaaaatatgattgcatttacacaagctaatttagaaagactatgcttaatcactgaaaggagaaacaatggttttaagtgtttttcagaccttgagtaatcttaatgatatagagtcccatagatctatcttgattttaatttaccaactgtgagaatgtatgacaaaaagcacatgctgcttgtgcatgctgccaatacttacaaatattttatataaaaattatgtttactataaatgtggggaagaatgctgattatctttgattaggactaaatgcatatattttaataataatgaatgtaggagaattgaacaggctttccttgtagctagcagatttttttcttacaagttattacatttattagtgaagtacattaaaaacatagggtgtgtcagtgttaaacttcagattcagttcaaagtgagctaatgtgctttgagtggcagcagttcttcaaaaactggaatcaactcttagtacaaaaaaagatgtcagtataattattctttggcctaattttggagctatgttatataacatgacaacagaatagcctcagtgtacttgcttccataattatgatttcttaatatttattgccattttggtattctcaaatacccagctcttttgtagaaattagctttttaataaagtcagaggagaaggtcagtaatctgtttcagtcagtgcagaatgttttgttggctttgttaaatgaaaattgatatctacttatctttccttgaaaggtcattgcctgaacttttagcttacagatttaggggttgttgctgatattttaatagtattgaggttcctacaacagtcagcattcatagttcaaaaaagttagtattgcaaaaggagagtaattaagaattctttcttaataaatgttattgcaagtcattagagtttcatgaaagcagagacatatggaaaaatctccccagagcaataacaaacatttcatatagacagtatgccattcaggtgttcagcatggaagacatcagaaatattaatagtccaagcaccctaaagtgacttcagactaaagtaaatgaatgctttgtttgatgttgagaataactatggtaggttttgctacaggaataactatggagtgttttctttatttctcctttaatgtttctttaatctacatttttattcacccttttttgttcacttatattttatacttttcattacagttttatactgagtgatgtatcagattaatgtgctcttttctagatttttcacctttacagatctctttattcttcccataatgagcaagcatttgccttaacaatattttaactgaaatggaaactaatatcttaagaagtaactttttaaaaaagcttaggtagaaatcattattgtaaaaatgttgtgattcattacaaatgtatcattatctccccagtttttcctgggcacgtgttggcttcttgcgtcttgattctagtgacatataaacacttttctgctttgtattgagcatgtaagactgtctgtcaagaaagctgccaaagaaatgagaatttaaattctgtgaatcatcagagtaatttataaatgcatcattaatttagtacctttaagcataatatgatccccagatttggtagccatgatctgagatggagtcttcactgagtaatttgccttgtttgggagtggggggtggtgaaggaaatatacatggtaagatttaggtgaattagaagtgaactaggcaaagataatttggtttatggtttatcctcttagtaaactgctttgaataattatgattttgggaggttccattacctctatctagagatacctctcatttcactgttcttttccatctccctggacatttttgtttcccttgctcatacctcctacccttaaaatttggatgtcattattgcacaataatacttgagttttgaggtactgtgggtcttaacagaagtttttttctttcttcatgtagtgaatttcctattcaaagatttacattgatttaaaaacttttagcagtcatatttacatattaactttcatctgtctttgagaagattgctgtttcttcttagattaataactgttgatatgtaaaccatttaaaccttccacaatttagtctattttgaaaaatttattacaacttttaaagtagtagaagaaatgtggaccattgtgaaagttacaaaatgtcaagttgaggttgagtatactggtgcaatacacctgtaaaattcaagatatctcattttatttacttttcttctccttcacatacctaggtacagaaggtttgggattcagcatcacttccagagatgtaacaataggtggctcagctccaatctatgtgaaaaacattctcccccggggggcggccattcaggatggccgacttaaggcaggagacagacttatagaggtaagtgacttccccagcaggatgttccctgattcttgaaatgttccatttccaggagccaacttttaaaaacattttcataaaatatgaaattcagttatatacattttagcggaagtatgcgtcacaaaatgtgtttctgttttatgtttagattttccatgttattttttatatatatttttttaattgttaaaatttttgtagaggcagagtcttgctatgttgccccagctggtcttgaattgctggcctcaggcgatcctcttgcctcccagtgtgctgggattacaggtgtgagccatcgtgcccagctcttttttccatgttatctgatgagaaattatctttccatttatttatttatttttttttatgagatggagtctcgctctgtcgcccaggctggagtgcagtggcacaatctcagcttactgcagcctccaccttctgggttcaagtgattctcctgcctcagcccccctggtagctgggactacaggcgtgcaccaccatgcctggctaatttttgtatttttcatagagacagggtttcaccacattggccaggctggccttgaactcctgccttggcctcccaaaatgctgggattacagacgttagccctcatgcccagccccatttagtttagttataaatttttagttactcagacatttggtttatgaggtaacattttgtcatataaaatgtctgtaaggttacgtttctaaatggctttatatttatgtctggcaatgtggaaatgtattcagaacagagacagatgaaataaatgaaaacagtgttccttgataagaggagcaaggaaatcttgaaatggcagcatggagaataaattgagtcataagagtcaaatgtcaggaaagaaaagaaaaatcgtttttgaattttttttctatgtcttatgagtttgggttcattggtatttgaagctgccttggaaatagattaacatacataatttgtgtttgtgtgatggtttgcacataaaagagaaaattgaaaaatatgttttaaaccatttttcttagttttttttaaagaaaatatagtctgtatttttattagcagatactgcatttcctaattaactagtattcaaatattaatgctaaggtaaacttttaccacactatccttttttcttatagtttcatatatggtttctatctctccagattgagttctcctaaagaatttttgtaaagtaggggaggagagggataccgtctgtatttttttccatgtctacatttggagcctagatcccttaaattttattcccactgttttggtcctgtgcatgtgacaacgtatgttaaataggcactgttagaagctaaataacagatgtttgagtacaaattatgttagggtcctgcttcctgaaaaagccacttgtcctggggttataaattgagtggtacgttagcccacgtctgcagtcgtagcttgttttatttgtaagagtctctgctgggacttgaattcagtcctcctgtcttctgagtccaaaaaaatatctgtccttttctggctctctccgtctttctttctaaagataattgctttattattgagtcacttttttcttttatcacataatcgctttactttcaacatatcagaaaaacctttttattttaaagcagtgagaaagacctgcaacctgcatgtctttcgagttaggctttatttccatagctgtcatctttgtcttaaaatggaaacttcatttttgcatgctttaagcccaaccttctagtatctacagttgtagctatacaatattgatacttacgtgcattttctctgagtgtctagataattagaatcatacaaagaaaaaaggatcaagtgacttaattgtctagattttttttcactttcttttgtttgagtacaaattatgtttagggttctgcttcctgaaaaggccgcttgtccttggggtataaattgagtggtatattagcccatgtgtgcagtcgtagcttgttttattttgtaagagtctccactggaacttgaattcagtccttctgtctgcaattccttaatagtagtaccttgaggtatatgaggttgatttttttcagaaggggaaatgttctgaaatatattttaactacaggaaaattttgatactgtaatttaagttataaacttatttgccttggacaaaatgtcttttttgtctaaaaagaaaaatgtagaataccttttaaaggaaacatatgctctcatttctgtggagtatatagtgctttctgataatgatgttatacttcctgttagataaaagattccctaagaacaagttgttttaaatttttttcctgcttgaattctctcataacattgaaaaaatttcagctgaaatattgcttccctgctaaaaaatattgttttgtagtttctttaatgtttaccttttagaggtaaagtgttttatttatatttatcagtaaaatttcatttaaagtgaaaatactgtaccaaaatatttttggtgtgtttttattaccctttataagagcaacacctttttattttggtgtaagaaaacctatgatgcacaaggctatcaaaatatctctgttctaagccagtaagttttgtgttaacttgacatttttgaaatatttattgcttggtacttgtcaatgccctggtgattgtcactttgggtttaatgatgaacactaaaagattgaccacttcctctcttctagatatctggtcttagtttctttattagtcacaaaaccttagtggttcccagatcatggcagaattgtgcatgaaatgagttatgttccatagcagatatggctagtcctagagtgtgtgtgtgtgtgtgtgtgtgtgtgtgtgtgtgtgtgtgttttcctgttgtttccacaggattacagctgaaaacttttgttttgttttaggtaaatggagtagatttagtgggcaaatcccaagaggaagttgtttcgctgttgagaagcaccaagatggaaggaactgtgagccttctggtctttcgccaggaagacgccttccacccaagggaactggtgtgtaaatttagagtagatgaaagatttctgatatgcagcagccaggggtctgggttagttgcctgatggcaaatgtttattgagacattttctgaggagtttctagatcttatatttctttcagccctcactgaatacaaacattcttttctctaatactcccttagtttcagaaatggatatcctcagtaatgaatggaggggtacttaaacatcagactgtagggatattttcaagggcatcaaatgttcatcactgtacaccctcagatggactgactgaatacagagacgccgattatttcagaactgtcactccacagactgtcgctgaaagcttgccatcttccacactgcatatgacaaattttcatatttcacattttcatagtacatgtcagtaagccaaatagatgcttgcttccttactgttgtatgaaaaggaatacctttttaaaaaaattattattaaaaataaaaagacctaagtggcaataagcctcatggctattaattatacaaatataggtcatgttacttaggatgacataaatgaaggaaatgaaaaggcatttacaacttttgcaacctatctccttcactttccatacatacattaatacatctgagtatttacatggtattggtgtgaatgaaataagtgtcttaaatgtacatagttctgagtggttttctgcaaaagtgctaggtttcatttatatataaaaatgacataattggaggagttgcctttgtcttttgatgtggtaagaaaattgttttatttcaagtacaagtggtattttaaatatttcaaaacagattctacttggatcattttggaatacatccttttcatctagctcttagtgctaaacaaaaattaatttgtataatctagagtgacaaggttttagaaacgaggtttccaaatttatcatatagcccaaattctcttgtgtcttcaagtatggatgtgttatgataaaaataactatattttattctctatataaactatttctataaatattataaatgaaaaaattttagtcataatatcttatcccctggttacacacaggtcttaaaacttaatgtggattttgtggaaatttcagacagtgatagggttgaaaagtgaacacttttgttttaagtagattttgaataaattatgaaaacttctttatatttaaaaatgtttaatgcattatttctcaatttaaattcagtttttcgttttccccccactgttatccaattttgtgcttaaaatgccacctgatcctaaatctggagatgtctctattaaattgtaaatgagcacttaaaaaaaaaaaacaactagctttccatgtgatttgccgaagctttaattcttcctcagtgtctcggagtgcactagttagcattattagattgccaaagcttagacactgctcttaagcagccttttccagagttagtgccagcatatagccagcttaaggttattcaggttcttcttgtccaattttgatcttccaggcttctgtttttcccttctgctacctactttttttttttcttggttatgtaatttattgcttgtgagcttttcattaaggagtacgccagtaggccgtcagtctattatgcatgttgcagctgcttctcaaaatttaagagaataaaatcctgaaaatttaaagggaggggacatttaaaaataatcttgaatccagtagacgtaactattttcctctgtttggggtgtctgtgtttaaattctgtgtgtctaaatctaaatacttttatcaatcggtgcctttttttaataaatcatccttgtaagttcctaggtaattaaggcaaatcaacattataggaaaaaaaaatcatgtttatttcctgtgcaacattttaaagtataaagctgtggttcagactgtggttcaaactgttattatctggtctagttatcaaatgattctataccttaaaactttgatttgattgggaaaattttaaagcaaaattagaaacagtgccatgattaggaaagcagtttggtgagacttgttttcctccagataataaattcatgatgtactgtgaatgagcaagtaaaaatgtatatctagaaaaatttcttaaaacacacacataaacacacacatcagcaaaattttggaagacagagcattatgtcagccatcatataattaccctttatatattttgtggattttaagaatcaacaaaattttctttaaaataaatcattgtgtccctgtgtgttgaagatggctttggtcagtctgtatttatgtttttcttcaattcttctagaatgcagagccaagccagatgcagattccaaaagaaacggtaagagctttgtcttttgaaggatgcagagatgttggaaagatacatggaactaacttcttactaatttaatacgaagttacttgtcctgccttttcctggctcgtaatatttaatacatgggtttattaaatgccaaagtggtcttattttaaggtgacttactgttaccaccccaaatggagtatattttgtgattaattttggtcagatagacgcaaaaaagagagagacttcctattcacttgcaaagtgaggaccaaagcttagttgtttggcatatatgcaaagtatttcatgagttgtgaaatgctaaattataagtggccacaaaatggaaagaaaagttaaaaaacttgattcaatcatggaaaaaaagggagggctaagagaatacagtaaaaaaagtatacacaggaaaattaaagtgacgtgtcagtattaggctaagcatagttgttagaataactataaaagagataatttaacaaaagttaaggactcacagctcacattaaaatgcaaacatagttgcatcctgttaagaaaacaagtcctgagacagactggggataaaagagtaagcttagttccagcaggcagaactaacacaataaaaggaaggattgctctatcagtctctgtgatgatgcgctatatgggagtaaaaagggcattttatattgacatggtagaaattctaacaatcaggatcttttttcctttttacatcaaacaacatagcacaaaaacattcattctcaaactatcgtaaatggaaaatttagcaaagtcatttccatagtaggtaatgtcaatatgtccctttccaaaaatttttacattgttgactaaagaaaaaatataatgaatttaaataacataataaacaggtttcattttctgtacagctttataaacaggcaactttgaactaatgttatttttcaaatattccttcgttgttttttttttttttttttttttttttttttttttttttttttttttgagtctagaatctcaccatatttcatggctcactgcagccttgacctcctgagctcaagtgatcctcctataaatattccacaattctaaaaacaggtgacaaattacatcttggaggaaaatcagtaaacaaccttgagaatattccacattaataagtgtgtgttgtagacaattcctagctttaatttttggcttataaaataaatagggcaattatatctaatcaaaatcacactgatatttatgtgttggggtaggttagataaggggaaattggacaaattgattctaaataataaaatggggtacaatagcaatttatactactctttgaaaagacaataattgtggcagagtatatataatataaagctacaatacctaaaacagcatggcattgttatagggttaaacaaatagatcatttaaacagattaagggttacagaaactgacatgatgtgcataggtatgtgcatgtgtgttaaagatggcacttcaaattagtagctttaaaaggatagtttacgtagtgtttataacaattgcccatttatttagaaaagttagctttttctcaccatatctcaaaataaatggaaaagatctataaaacaaaatagatccacagtcatttacacacacacacacacacacacacacacacacacacacaccccatttgtatctgtaccatgaaatagttatagaataaatgcaaaaggaggaagtatttacaatgtgatccttaggggaagagctattcctttatggtttaggataagtatcatagaatattttggaaaactcaatgactttgcacacaaactccatctattaatgtctgagacaatctgagatggaaaatgatgctttaagtagtaaagatagggatgttctttcgaaacatgtagtcagggccaggtgcagtggctcacacctgtaatcctagcactttgggaggatcacttgagcccaggagattaagaccagtctgggcaacacagcgagacctcatctctaccaaaaagttaaaaataaacaacaataaaaaacatgtagtcagtcgtgttgaggaaactgatgatcggctgtgaattcctcagtcaccagagggaaagaagcatcttttgatgtggtattctgttaagaaatgcaagctgcatttcagttcacaacctgtgtgtttatggtagcatgacatggtgactgggagtcaccttaaaaaaggaagtcatatatacttttacatgtgtctgacttctagttacgcttggacttttttttctaatacgagtttcccaaacaaagttaaaagtatagtttagtttgaaatattatttgtttcttaattttttatgcgtgctctcacatctgtgcctctctttgtgctccaggtatgcggtatcattttgagttgtaaaaggcttaatattaacatgataatttaagaaattgacaggggcacagtctctgcctttctaccttttgatggccaaggatctgttttaggctttttgaatattgctagttcttggcacatagtattgctcaaggaaaactccgtgataggcttttgctctttttattagtgtttcttaatgacttgttttaggttctaggtctgtgaaatctttgattatctattttgtcaatgcctagaaatggggaggaggggagcactaatgatttcaccacaaatccaagtccaatgctcactttcattttgggctttctcagggttgattttggagcaaaccatggtatatcaactttaaaccacaggaatggtaactgtgcatacagttatgattctttttcttttcctgcaggagatatattacttctgtcaggaactatatgtgatttatacaggcttacaaaaaatagaagacagtttctttcacctctaatgcttaacattgcttataacgttgcagtcctatctatgactggcatttattcatcagttattgtgtgaaactctttatgtggattatcttatttaatctttacaatgtccatgacttagttcaggcacgtccaatatcttggcttccctgggccacactggaagaagaattgtcttgggccacacataaaatacactaacactaacgatagcagataagccaataaataaataaataaataaataaataaataaacaaataaataaataaatcacaaaaatctcataatgttttcagaaagcttaggtaggaatttgtgttgggccacattcaaagccatcctggaccacatgcggcccacagatctcaggttggacaagcttgacttagttggtgatattatcctattgaaaggggaggaacaaagaattaaccttaggacactccaaatcttggagccagccataaactcaggttgtctgacaccagaatctgcagggcagattttatttctccttaatgtgacttagtatgttgaggggggaaaaaaaaaagctaagctacatatatagtttcaggtaatacagtatgagttccatgttggaggctgataaactatgactgaattttttttaaataaacaagtaataaagaaatccagggttagatgccatctcattagtcaagatagtgggaagagatcttgttgattttttttttttttttttttttacattgctcatggattgatacataggctttcctagaacacgcgtttagtaccattgatttccattaactactgcatggacacttctgtcctttcccagcccagtgaccagttttgcaaatactttctcctgacttgggctgctcccaccttcttctttttttttgtttgagatggagtctcgctctgtcttccaggctggagtgcaatggtgcgatcttggctcactgcaagctccaccccccgggttcacactattctcctgcctcagcctcctgagtagctgggactacaggtgcccgccaccatgcctggctaattttttgtatttttagtagagacagggtttcaccgtgttagccaggatggtctcaatctcctgacctcatgatccacctgcctcggcctcccaaagtgctggaattacacgcgtgagccaccgcgcccggcctgctctcaccttctttgcctgtccatacggacgccaacttctaatcctactgacttctacctatctcatgaggcttaccctaaccggaactagtgttctctcccattttgtagttctttatcatatttgtctttgttcgtttttatttgtagaatgcatttgtcttgctttattaacaaagttcactgatgtcggctcactggagcctccgcctcctgggttcaagcgattctttttctcagccttttgagtagttgcaattacaggcatgcgccaccaagcctggctaattgtttgtatttttagtagaacggggtttcgccatgttggccaggctggtctcgagctgaccttcagcaatccacccaccatggccttccaaagtgctgagactacaggtttgagccactgcgcccagccacatgcttaactttcaagaattcaaaatgcattctagaaagttagtgggctttccctacagaaaccacagggatacattggggattctttaggaacttttttgaaggtcagaagccatcttgataggctaacttcagaaaggttagagtctcaagttagaaatttaatgagctagaaattaagcatgggccttattaggtttattttgctaacacttaatagatcaagtgtaggctgccatattgtttgtgtgtgtgtatgtgtgtgtgtgaccaagtctcactctgttgcccaggctggagtgcagtggctcgatctcggctcactgcaaccttctcgcccaggctcaagcaattctcctgccttagcctcccgagtagctgggattacaggcacgtgccaacacacacagctaatttttgtatttttagtagagacggggtttcaccatgttggccaggatggtcttgatctcttgacctcgtgatctgcccgcctctgcctcccaaagtgccgggattacaggcgtgagccactgcgcctggccagaaggaggacattttcttatataactgtgttatagttacgaaaatgattaaatcgattgtattatcagttgtcccaattaatgttctttatatcataaatgaatgagagaatgaatgaaatacaagtatgaatagaatttggtcctgtttccaattcaggatcatgtatggcagtaagttctcatggctctttaatctcctttaacctattacgtttgttaatattttctcaagaacaaattactccaggcaaatttttaatttttgaaggggcagattactttgagaatgtccctcaatttgagtttgtctgatgtttctttgattgggtgagtattttgggagttaacattagagattaataattgtgcaaaacattttttcctcagcattattttaccaagcaaaaaatttaaaagtctttcaaaatgtatttggcatctaccattcgaattagaaaaggcattataaagccagatatgacatttgaactttactgataagaataatgaactttataatatcaacacaaataacatacagaaatgttcatctcacatacgggataaattaaaatggggaacttaaggaaattttggagtctctttggagggttattcttttattaagaggtttatcatggttcttaaatttaagaaaaatttaagaaaaattttaaaaccatgataatttctccatttaaaaaatctttctcttagttaaaaatataaatggttgttcatattgtctcagatacctacctgcatattatttaatctctgtttgttgaataagtatattctctctttaatgtctatgaaaatttctattctgcgtgacgctatgatggtctgctgtcatggcatggttttttttagagctgtcctaaggtgctcattcatagcccatctttgtcccaagcaacagcccctgcccatcatatccaggtgcccctcaatttatgatggggttacttccccataaatttgtcagtaaacccactctatgttgaaaatattgttatgatgaaaatgcatttatacacctaacctacaacgctgtaacccagcctaccctacctcatgtgctcagaaggtttaccttagccttcagttgggcaaaataattaacacaaagttattttacaataaagtgttgaatatcttatctaatttatgggataccgtactgaaagtgaacaacagaatggtttcatgggcaccatcaaaagtggaaaaatcattaagtcgaaacattgtaagttgtggaccatctgtataaccctctatcaatttctcctcccccatgcagtgtttttttgaggaagcagaattaaagaagtggtatacaatggattttttgtattgtaaaaataatgcatatcaactgtagaaaattcagtcatgtgtagaagaaaattaaaatcacttgtaattctgtgacttcagtatcatcattttaatgtattttttcatatatatatttgtgtctgtgagcctagccaaagataatgtatttttttaaatgattttcttgttctggcttggtggctcatgcctgtcatcccagcactttgggaggccaaggtgggcgggtcacctgaggtcaggagtttcagaccagcctgaccaacatggcgaaaccctgtctctactaaaaacataaaaattagccaggtgtagtggctcacgcctttagtcccaactgcttgggaggctgaggcaggacaattgcttgaacccaggaagcgagattgcagtgagttgagatcataccactgcacttcagcctgggcaacagagcgagactccatctcagaaaaaataaataagtaaaaagatgttcttgtctacctatttaactaatatgtatcatgtcccagccacatatcctattattgttaataaatgtcatgccccaggcacgagtgaagactgacataaattcctaccttgtgaagcttctagtgatctttgaaggcagacattaattcataaaaatatgttatggaggtttttgatgggtgtactggaagttatggaagtccaaagggtaaaactcaatttcttagtcacaaatactttcttgtcttacatattattttgctaagacactttattagctgaatggcattccattgtgtagatagatcttaattttcctgactttcatacatgtcaatttttagctattgtaattaaaacaatatcctcacagttaaaacttggtacatgatcacaactatttttgtaggccatatcactaaaagtaatatttctagcttaagaaaatggcaaactgtagaaggtttaggtaagcattgtcaaattggtttccataaatattgtaccatttttttacattcaccagcagtgcaagaacatgcgcatttcaccacaccagtattaaatatcattatttttatttattttttagtgttctatggcaaagcagtatttgttggatatcattaatttgaagaaaatatatggagcaatttgataacctttgattgatttgcgagtaagattgaaccttgtacttggaggttgatttattggtttgctcatctttctttagtgaatggcttgtttacatccttttcctgtttgatgcagactgcttatctttttgttattaatttactagggatttttgcattaatttactagctatttgctaataactcagctgggcatggtggctcttgcctataatcccagcatattgggaggccaaggtgggaggattgcttgagcccaggagtttgagaccagcatgggcaacatatcaagaccctgtctctacaaaaaagagaaaaagttagtcaggcttggtggtgtgcctggggtcccagctagctacttgggaggctgagggcgggataatcacttgagtccaggagttcaaggttatggagagctatgatcatgccactgcactccagcctggatgacagagcaagaccctgtctttaaaaaaaaaaaagataattctgtagataagggcagatcttgagagagagaaattaatgatttatagtggagtgatgaaacttttgctgagtcacgtattttgttacaaagccaaaaatcggctattgagctcactcctataattttatggtcttctatcatttgtgcacattccatgtttcttttgcctctcttcacaatattttgtacattctcatccaaattttcgtttgttgcggctcagagattacccttcccatgattgtttttctgctgcttgacacaatcaactcttatttccttttttatagataacacctttgctgcagattaactgtggatttgggcctataggccagctctattctcagttttttggactgtgatttcgggaagaaggaaaagggggccatgatggtgcccacttgtgactctttgtctcactgcagatagaaatgtacatcttttctgctgttctctggagggtgggatagtaagtagctttcacaatacccattcagcaggttccttagcaaaggtgcccttttattctgggcatttaaagacaacaaatggtaatggagaaatgggcaaaggaagaactgacaggctttgttgctgaaaacaatcacttgaggtatacacacatgtatgtgcgtgaggcaggtgtgcttgagtgacatgactgtgcccagatgacatgaggagtgagttaaagaaaagacattttttgcgtttctgtagaaagatcttaattcgagaaacagttgataaggtgcagaatttggatggaatagcaaggtgatagaaagttagtttctattttacatcagaatatggagattcctatactatctgactttatgaacattctcagtaatatagcatttcaaatgatttttgaagagcacaatttttaaaaaacatttttctgccagagaactaagttctaaaagctggcattaatttctgtctatgtcaaaagccaaatggattaatagtggaatatcacatgaaacatacaatgtttcacatcagtgttcttaatgataataatgacttaagacttggtaagaaagctgaaaaagattattcccattctgcagttgttataataaataaactatcccctggagaatatgctcttctttaaaacaggttcagagttcagcaatcagaaaatattgcaacttgattaaaatttttcttcatatatgcagccagctccttatcctgatctttcaagtaggaaaaatatgagaattgtaagccttggtaaaatgttatggaaatgtaaaactcagtaaacactgaaaaggcaactgaagattcaaatcagaaagtaacaattaagaaccttccagagttgaagcaagtaagcatagtgagtgatgagacttaggtgtgtccatagaaagaatattcttgttttccattttttcaaatgtagcttttccatgcttataagtactgattgacagaataattttttatttcagcaacctccaaatttaaagtcaaggggaactatgatgtgtattgatgttgttttgtattttaaacatcaaaatttaccgtactttatattcttgtaacagattttatattgaggtagtgcagttcattcacacatagtcattatttcgtactctgtaaatgtttcaaggggctgggcacgtaagcccaatactttgggaagccaaagtgcgtggattgcttgagcccaggagtctgaaaccagcctggccaacatggtgaaaccccatctctaaagaaatacaaaaatttgcccggtttgttgacatgttcctgtagtcccagctactctggaggctgcagtgggaggatcacctgagcctggggaggtcaaaggtgtagtgagtagtgattgtaccaccgcattccaccttgggtgacagagtgagactgtctcaaaaaaacaaacaacaaaaacacttgttttgagctacatggaccaaaataaaaagtatattgaatattcatgtttatagagcaaagcatgtatataaagatacttttgtatcaaagtatttgatatatttgatctttttttgcccacaatacattggttttatttgagctaaaattgttctctgggaatattttattttattttattttttgttatgggacagagtcttgctctgtcgcccaggctggagtgcagtggcatggtctccactcactgcaaggtccacctcctaggttcacgccattctcctgcctcagcctcccaagtagctgggactacaggtgcccgccaccacgcctggctaattttttgtatttttagtagagatggggtttcaccatgttagctaggatggtctcgatctcctgacctcgtgatccacctgcttcgacctcgtgatccacctgcgtcggcctcccaaagtgctgggattatgggcgtgagccaccacgcccagcctgggaatattttaaatctagtttttatgatgagcaggcttaaggctttatttggactttgatcataaatgtatttactttgcatagttaacatgactattactctgtattttttcagattcttattttgagttcttcattatataagttttaattttttttttaacccattagcaagtttattgtaattgaagtgttacttgtctttaaaaactatcaggccatcctttgagatagcacaaagatgtcctaccataaaatgttaactttacatatttgtaaattagaaacatcacattactatgggtctaaagatttataaatagcatattgcttattttatgatgatctaaaaaattcacttacagatagtgtactctcaaaatgtattttatctaattgagacatctgagattgcatgtttatgccccaaattccttgcattccaaatttccttgaattccaaattccttgggttgatttttattcttattaggacattttaaaaatttggtaggatgcagtcacctactttttttgtgttattgaacattctgtaaaagcacaatctgtttaaagtatatattcctacatatctgtgtaccactgtatttcttattcttcaattataatttgataagtcaagcttgaatgactaaacagatgctggagaaatatttcaaacgtgggaaaagaggaggagaaataggttgtaggactagatgtgccattcagtttttacttgaagagcctgtgccacgtgtctgttatgtggttggagcaagagtttgtgcttgaacaagcatcctagccttactgatttggacatgaccagtatagagatggtggaaatcttggtcatgggcgggattgctgaggaggaggagctcagaaggctgagtgcttcctcttctggagtgtaggctttcttaatgataggctgtcatcttaatgcattttattcagttctacattaagctttcatttcttcctctgttttaagggaggtgaacaataatttgtatatcctaaatgttttttattttaaaaagtcttccttctatgcttggtgactatgaagttaaatcttaactaattaaacaagattacctgaataatatttaccagctatattatgtatgctacaatattgtggaaaagttttctgtgatgttgtatatctctactttgtctcacagatgttgatgttagaattctttagaggctctctgaacccatatacctttttctgctgattttgtatgatcaggatttgttattttttgtgaataaacaccattagtgaacattaaatatattgataacttcagaatttcctcataaaaagggagataaatgaattatatttatttatttttactcccattgttactgtttttcttgtcgtttagaatatatgattacaccaaaaaaatcccgaactctagaaatctactagtctttagtccttccactacattttccctctatctttctcaaatctgatttaagtttggttcaatattgaataattgctacataaaaatattaacagctggttccaagaatcttctggagtgggtgcagatgtagtgttttcatggatcttgctgtggaaccttcatggaaatattttgcctcttatgattaaggaactgctcattagcagtctttaaaaataactttgagaaagaaacattggactataatgtgctgtgcaattttgttccctattagaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagtgagtgtcaactttatcatgcgtatgcctattaacaaaaattttaatttcaaccctgttcctattttggaaacatatacagttaacagaagttttctcatttctttatggtacccacattcacatttaaacaactaggtgtatcagtgatgtgtcacgtggggatggagtccataacttcaacctttcattttttctctcacagaacatacaacccattgacatgctagttaaatgaagttaatcaatgcaaagacttggcataggtcctgtcacagaatgggcgtatagtagacgttaatctttcccctcccctcccctgtttgtgggtcacttactctatttctcagcctagagaaaatttcctggccatttgttaaggggacagttctctgcaactgtctaatagccttgagcttttacatgtcttggtttctaaataacctctatgggtgtttctggaagcaagaaagtaatcactttgtgtcctttgaattagtatgctattttggtaaacagattatgataatgacttgatttacaaatgtataaatgattgaaatagacacaggctacaatagctgcttagacgttattatgccagcgttcaattgggcataatccattaggattaaagctccccactttttttttttttgctttgtttttattttatttattaactaaaggaaaagctacttcttttatagcagtctgtttaatagcacttatttttacctgttttcttcccaggatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgaggtaagaaatgcaaaaaagtgctagtatctaaaattgtaaataaactacatttctgtcctaattttgggcaaagggtattaggttccaggaccttacatcaaaagaccataaattatctttgcttattgtagttttattattttgtaggtggattgtggtttgtgttcttaattcttgtgatcaacatattcctaagtggacattaatactcctattgccaactcagcaggaaacactgggatctcaaaagcccctttagctgaattttttcttgaaatcagggtcacatcttccttctcagagccaacagtttctcttctagttggcagagttatacctgggaggtgaatcatgcagagaaacagttgcttattcatttatttaaaatgggatgcctcttacaaagcccctagtagggaacagtctttccttccctgtcctttcttttttatttgagacaggatctcactgtgttgaccatgctggagttcagtgttgtggtcacagctcgctgcagcctccatcttctgggctcaagggattctcctgcctcagtctgccaaagtcctgggattacaggcacgcgccatagcacctggcccacagtctggctttcttagatgatggtgttctcttgtgagattatcaatagcatatacctccctctctttcctcagtccccattttctctttctctatgggattgagtctgttctcttagaatgcctcctttttcagtgatctgtattgtattatactctgcttgttctaaatgtatgttgcagtttggaattaggggtgaggaggacacagggcatcctctcttgaaaggtaggatcatctattttcccaaatatggaaaaacatactttgttgtataataggacatttgaaagttaaaaataaattatatgttgccttgataatattggagcttgaaaaaagctaaatttcatggatccattataaattatgtgccaactgtagaaaataggtcagacttgcccatgtgcaaaatgagctgttgaaaatgtgaagtttttcttaaatcaatgttcagattcccacattttaagatcaaatcaactaagataaaatgattagcaaataatacaaactgaaaattatacctaagttgtttaagagtttttcttaatttttaaacttctgtttaataaacacataaagcaccgttttcaggttgcagtgaccactcatctgaacctatgatacaagcatattttacagagaaaatatactctcgagctcagttggtagtcaatatagaggtgacgtattctgaaagatcactgaccactgaattattttgttgtttttatttgccaaatgtagaatgagttaacagtaatcaacaaattaattgcgatatcaagagaacaacataaccttaactaaaaaatctcagagtggagaagagtgggacatacaaacattcatttatgtaagataaatataaaagctaatccctcacagtaggatgctggactgatatttttttctcttttccgtccctcctggactgattgaatagtagtttttactcattgcaaaatcattagctgatcttttaacttaagtcccacaaagcactatatgaaaacatctcaactgtaagtttacaaaacatatcattctcttttaggcctttttattttggccacctgaatactttcccattacacaggacagttttcattccacagatatttattgagcatcttatgtgtatcagaaaatgtgttagatcctgaggacatagcagtgaataagacagatggcatgcattctactggacaacgtatcaccttagtcttttagagaccaattaaaatttttaacaccttctcaatgttttccttcacagaaaacattgaatgctacaggaggacttaaaatgcagaaatgaactgaagatcagtgttctgcttttatctgattcagattattccctattgttccccccaaatagtgacaaagtaaacctgtacctgcctgaaaatgttttgataaaagcactgattttattccctgtaagagatgtgaaattggaatccccctgaaatatctctgtgttttattcacttctccatatgaatttttgtgaatgaatatgatttaagtaaggaaacagctgcagtagacagtaatagactttaatattcaatattccttatggtatcattttcatacattgctggttattactatttcttaggacagcataagcttataaagcaattatatcaaaaaatcttatgagtgctgtgctatctttgtaatactagcaagaacccttttgtactgatagggtttaactaaagaattacatgaagacagaagatctcaattcagcttccagtaaggtataagacatgatttttcagctgttgtacttatgcattaccttaggaaaaccttctcctttgcacactgggagggtatgtgtaaattatgttatagtaaatattgatataagcacagggcatcctgctgtcctgaacaaatctcaagccaaaataatgtgctgagttttctttctaggtcttttaatcagctgtatagtccagtctttgccaatcagaaaactgtattttgctatctcatctttaaatccaaggtttgcatatttaatttctagttagggaaggtaagaatgtgtaaaagaaaatcttttgttctttgtcacatttttctttctcttatacatggaagtgctgtgtattatcttaatatgtcttctttatttttcatttttgtagagacacggtcttgctatgttgtccaggctgttctccaactcctggcctcagcttgccaaagtgctgagatttcaggcatgagccacctcacctggtccaatgtgttttctttaaatttatttgtcagctcccttcactaggtattatgttaaagccctgtatttccctaacattagtcgcgacagggcacattggagacattctctgggagctatttcttagcctattttgcttagccttccaggaatctgcaggcactatgtcattctcaaagtgtctcctatgtactctctctagttttctgctaccctactccgggtcttctctaagggttcctcttttctgcctgttctttcattattcctgtctctcaaagttcctctgggtctgttgtctgtttttttgtttggttttgttttgttttttttttttttttttttttgagacggagtgtcactctgttgcctaggctggagtgcagtggcgtgatcttggctcactgcaacctccgcctcccgggttcaagtgattctccagcctcagcctcgtgagtagctgagattacaggtgtgcgccatgcccagctaattttttgtatttttggtagagatggggtttcaccatgttggtcaggctggtctcaaactcctgaccttgtgatctgcccacattggcctcccaaagtgctggaattacaggcgtgagccactgcgccccaccaggtctgtttgtttttactctgctcttgctccctagctgatctccactcccttgctgcctgaaaccacttgttaggatgaatactatcatcctctttccagctcacaggtccactctggcaccagatccctctgtccacctgcctagggaaatatttcctggtatgtcttatgggcacctaattcacaaggcaccacattctttctgttgtagaaggcagagatctggggtcacccttgacctctcaaatgctgtccctatccctgttgcctgttgcttctacctctagaatttccctcttttcttttttggagacagcgtcttgctctctcgctctgttgcctaggctagagtgcagtggtatagtccccggctcactgtagcctcgacttcccatgctcaagcaatcctgccacctgtctccctagtagctgggaccacaggcatgcaccaccacacccaactaatttttctttaaagatgggatctcactatgttgcccaggttggttttaaactcctgggctcaagtaatcctttggcctcagcttcctaaagtgctggaattacgcctgtgagccactgcgcctggcctagaatctctcttcctttagccgctcccctctttcccctctcccactgcctgagttcagacctcatcctctcaccaggcgcactgctgcagctccctgagggttttctctgcaatcaggctttctccctcaatccattctctgcactgcagtcaggcaaatttttctacagaacacattaatcacgtcagtccctgctgaaatcccttcagaggctttccatgtctccaggatcaaccagtctccatcatggggaccactgggacatgcctgattgtcatcggtgccctacagcccctgcagcacctctgctctagccactcagtgtttctggtaatttctcagacatgggatgctcttttacacctctaggtcttccacttgagtctatctgcccctcatcctagcaaagacttaacgcagtctttcattttccattttctcttccaaaggattttcatagccccgtgtactccccttcacccagcagctgtcacactatcatggtttcctctttgattttcttttgctggaatgtggattctgagactgccagggcttggtccatctaccactttcctgtgtatcctttgctggtatccaacccaggcctgacacatcagcacaggctgaatgacgaagagcaaccctggagagtctggcttttttttttttttgagacagagtctcgctgtgttgctcaggctggagtgcagtggcgtgatctcagctcactgcaagctccgcctcccgggttcacgccattctcctgcctcagcctcccaagtagctgggactacaggtgcccaccaccacgcccagctaattttttgtattttttagtagagatggagtttcaccgtgttagccagggactgcaagtgcctgctaccatctggcgttttttttttgttttttttttttgaagaaagacaggtcttgttagtattagaaactgaaattccagagtcaccctcagacaaggcaaacaaagtgattttgagggcagtaatttttatttcctttgctttccttcttttcttagatctaatggttttatctaactacacttaaaaacattgtataaaccatcattgtttgttttcttttttctttcttcaaagaaaaagagatggcttcccattgtttaaagcccttaaaggatgatttcacttttttagagaaaaactgagtccctgcattcttttccatcgtttcagttttggaatacacaaagtaagaagagaaaaattgttttcacttacctcaaaggacacatttgttgaagacttttattttttattttatttatttatttatttatttttttatttatttatttattgatcattcttgggtgtttctcggagagggggatttggcagggtcataggacaatagtggatggaaggtcagcagataaacatgtgaacaagggtctctggttttcctaggcagaggaccctgcggccttccgcagtgtttgtgtccctgggtacttgagattagggagtggtgatgacttttaaagagcttgctgccttcaagcctctgtttaacaaagcacatcttgcaccgcccttaatccatttaaccctgagtggacacagcacatgtttcagagagcacggggttgggggtaaggttatagattaacagcatcccaaggcagaagaatttttcttggtacagaacaaaatggagtctcctatgtctacttctttctacacagacacagtaaaaatctgatctctctttcttttccccacatttcccccttttctactcgacaaaactgctatcgtcatcatggcccgttctcaatgagctgttgggtccacctcccggacggggtggcgcccaggcagacgcgccccccacctccctcccggacggggcggctggccgggcgggggctgccccccacttcccagacggggcggctgctgggcggaggggctcctcacttcccagacagggcagctgcggggcggaggggctcctcacttctcagacggggcggccgggcagagacgctcctcacctcccagacggggtggcggtccggcagagacactcctcacatcccagatggggcggcggggcagaggcgctccccacatctcagacgatgggcggccgggcagagacgctcctcacttcctagatgggatggcggctgggaagaggcgctcctcacttcccagactgggcagccgggcagaggggctcgtcacatcccagacgatgggcgaccaggcagagaggctcctcacttcccagatggggtcgcggccgggcagaggctgcaatctcggcactttgggaggccaaggcaggcggctgcgaggtggagattgtagcgagctgagatcacgccactgcactccagcctgggcaagattgagcactgagtgagcgagactccgtctgcaatcccggcacctcgggaggcccaggtgggcagatcactcgcggtcaggagctggagaccagccccgccaacatggcgaaaccctgtctccaccaaaaaatacaaaaaccagtcaggcgtggcggcgcgtgcctgcaatcccaggcactctgcaggctgaggcaggagaatcaggcagggaggttgcagtgagccgagatggcagcagtacagtccagcctcggctcggcatcagagggagaccatggaaagtggagggagaggggagaggggagaggggagcaaaaaagagtaactttacagtggagaaagctgttgacactctgttgaagatttttaaacgagactggagtggaatggaagtaaatgccaggcatcattccttgagtgttgaaaatagcctctatatgagaattatgctgagttttaaatattttaaagacattaatatttgtagaaattactgtaatttaacatagcttccaggcattttattatatccatgttagaagtgattttatgtaaagctttttcttagtgccagtagagaatatcgccaggtgagctttctgtcttagacctcatattgggggatttagtcatcaaggacttctttaaaatgaattttttctctaggcttaaccctcttagaatgagaaaggtatattagaataggaaaggggcctaaggtatcatttatgaatctcttcattttctgtattaagaaataaatgcaaagaggtcaaatgatttgctttaatggctgcaaggccaacataggtggcaaagtaatttagaagcaaaatgtctgtttctcttacacaagtgagtggatctaattgactgtgattgtgttgttcaggcactttatatcccagttgcgttgggaagtagtgtacaataaaagcatgggctttcgaatctgatgtaatcggagaaattctggttctgccatgtgctgacttgaggagctcacctcacatttctggttcttgccattgccctcatggggatgtgaaggaaaataaatgtggtcctgtttgaaaagagaatgtgaaactgtgctctaaatcttccttcactctcctccaaaactaaaatctgtgttttcattagttgctttatgttcacctgtcctctggaagctaatattttccagaatgtatatttgtaatctaggttaaatgtcttttaatatcaacatcatggcgtgtcctcagttttaacagcctatttccacataatgtagtgtgttttaaggaaattatgactcactcacttttaggaatgaatttactaatctaattattccaccagtgcctgctctacgctaggcattggggataaaatacaatatgctaaaaaaaaactgaaatattgaataatatgatcttgccaatcaccagtgagaatccagttttaggtttgttgaagggggtttaaggccattccaatacgaacttttcagtgtttgtagtggagatagtgggatacattttctttaggtgaaagacactatttggcttgctaatgcatactcacaacaaacggagattttattaaaccccacagataaattcacatgaattttcattattcacttagcttattatttcctttgggatagtgaccacaacatgaaataaaggcctgttcaaagagttaaaaataagatttttttttgccctgtggtaatatatttccaagttactgtagcaaaagactgtatcactttacactcctaccgagtgtgggttatcttgccgcaacctaaagctatttttgttctttaataggtagaaagactttccttgggatggaactgaggggctaaacagccactgctacaggggactgtatttagttggagtcaagaaaatttttgcacattaaaccacaaatagacaacaaaatgaaaatcgcagttgtgcttactttggtttcttcttctaatgaagcttaattctaccaccccccctccccccccgccaagatggagtctctctgttagccaggctggagtgcagtggcgtgatctcggctcactgcaacctctgcctcctgggttcaagcaattctctgcctcagcctcccgagtagctggaattacaggtgcccgccaccacacctggctaatttttgtatttttagtatatttggtgtttcaccatgttggtcttgaactcctgacctcatgatccacccgcctcggccttccaaagtgctgggattacaggcgtgagccactgtgcccaaccgaagcttaattttaataaggttttaatataaggagcctgcaagggggtgatagcaggcctgggggagcagaggccagccattctcccaggaccactggggttgcctctcttcctcagtgccgctggtgccccctctgacacatttctatttcctaagctggtgttcttgcaacaacaaaaaatcatcaaaagatttaaaacaaaactgtaaccccaatcagtttttttaaaagaaattaaaagccattgtatcttctgttaaatatttatgtagtcaactattgatgtcttcatttaaatctgtcttttgagatgcaaattaaatatgggtagagaggtaggggaggtggagaatctttcctatgaaaatgttcaagtgcttggtttttttctgaacagacgtcttactgtttttctctagaaaacctgcatgtactcctttttaatggaatttttatttggctttataaaattttaaaatagccttttgggatatttagggatttctcaagaagaagttttataaaggttttatcatgtagaaaattgcagcattatacagttcaattaaatacatttttcaggcaaccttgaggatatgttgtctgtcttttgataaattattgtatagtaaacagaatttgtttatagagtcttgtatagcaagtctttatgtaggtatactttttagtgtgtgtgttaatttaaaaaccatacttgttcttaatggtatagagtattcgttttattagctttttttttttttttttttttttttttttactttcccagagtctcttggaatttaggcattacattcttttagaaactgttcttttatttctttacatcagagaccttgaatatttaatttacttttcagtaaagctgtcagttgtaatctacaattttaaaaaaaacaaatgaaacaaatcctcgtttcacaatttaaaccttattgagtctaattcactagagctgcaagtttattattctcctgcagtttgatgtgcctccaattgtaattgtgttgacccttcaatgcattaaatctccccagtgcttatcaaactgggagagataagtctacaattcgaaacttcattaaatatctcatttatattaaacagatgatagcttctaacggaaataataatttgttcagctgaaggaagtgcgacagttgtggtttcatgtgtgagaggagcgccttctctcccgctgtgctgtgtgatgctgccctcctgcccactcccccacattggcccttcctgtctgtctaacatcaaagcatcatgagataccagtccttgtggtgaacctcacagtctgcgttatgaggattgtagttaaatgttctttcattaaaacagatttgtttgaaggccttactaacatgaatttcttactcatattatttttatgtaaaatatgacttattagacacagctagctgttttaagaaatgcccgatacattttaatttattgtcatcgaaattgacatacattcattgcttatttattagattgtatatgtttttgaaatcctcctatcttggtgtgctttattagaatatttggtcccgattttcatattgttctgtacactactgaagtgattattgcagctactatcttgtacttaaacattacagtaaagataataccatgattattcttaatttctagcaggaggaatttaaaatcagtgtgttgttcaagacatctgagctgatatctttaggtcttgtagagtaggtaataattccaccagcacacatggaaaaatgtgtgctaattgttagatgtatttacataccataagtttaagacctatagctaaattgcagcttccattctgatcaagcacgccttttatagagtaacatctagtaaagaattctgaattacactgtaacttaaattgacttaaacagacactaacggtcaaattggaaaaataaacaacaagctctgattttaaaaaagccttaaatatacatatttttcctccagcggttgaaatctgacagaacttcatgggaggcatggtataaagtggcacagaaagttggtcattaggcagagctgtcatcacaaattattttggtacagggtgaaaagttctagttcatttggtacccagttggatacaggcctcgggcaagttgttataattctcccatgctgctaattggcctccaggtactgatttttctttgcccccatacccgttactctgtagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtgagtcaggtaaaactctgtttatcacatcttattttgatgctttcattggtttactgagaggttattggtgtaatattaatgtactattagtgtaatattaatgtaaataaaaatattaatgttttcaagacaaaagagaacaggtttattaaaatcattcaggaagtgttcatgtgaagaggtaaatcaatccattgatttaagtgacttttagatcctgtaacatgacgaagcaaccaaaaagaaagggatcatatggaaatgttttctagtgatcaagatattctttacttacttgagataatatgtgaagctatgtttaaaaagaaatcaaaatttaatggcttgtggcaaaaaggattcaaaagttacatatcattcacagtggcactgcctggagggggagaaaaaatatttatatacagatatatgcacacatatataaaatattcacatgtatctggtttgtatttaataggatgttactgtattttaattgtattttacttttctgaagctttagttttaaaatcgcgaaactagtcttctgcatcctttgtttggattcagtaccatcctatctgcatggcccccagtgggtaatgaggttattagcacttgctttgcagcagttcagctttctactaacagatccagttcataaattcttgctttgccacaggagtggttggatttactgagctgctcatcttgcgattagcttgtgagagttttcaaatttaaaacacaagaagccattttgattaaaataacacctgacataaaacacttttattactggtatattttgcaaggctctcatttaaagtaaaaccctaaatttaactccattttgagtacatttaatgcagatttaatacaattcaagtttccattatggagcctcattgaaacagtaatttattcatcagtgggtgtttatggaaagcatgctattggcaagacattgtgtatatactgttgctgtagatacaaagatgagtaagaagcaatctctgccttcaaagaactttctactgggcatgatcaaaaacatacataaacatgtctagtagaattgtctgtttttcttcctctaatctctctagctttctagtttagaaaaattgctgaatatgtaatttcttatcttgttacatgtggaacttagacaagccagctttctggtgttactttgtcaacatttttctttttacatgcttggcgtaagtgaatgtcagggaagagtgccacacctgttgggttgaacacctgtcaggtgaaaggctttgtacatagtttatcactttcaaatctttgcttattacttaccactctcttcactgctgttggattttctgtactttcttggctttggtataaatctttatctttgttaaattatttttttgttgatgaaatttcagtccccttgagagagagagagtgtgcatgtgtccctagatatttgtgcacacaaagtgatatgctgtaatttcccctttattataggaacataggacttgccatactgaatcagaccattggtccaccagttcctgtaacctgcgtcctgcctccaatccctgatgcttcagaggaaggcgaaaaactaaaactaaaactcaaaccaaaaaaatccctaaattcagctagtgaccttttgaaatgctgtatatatgagttgaagagtcattcattttcttcctagtctgttgccccgattttgttagctacagcttcattagtcctcttcggtttgcattatagttgacattgtttcctcttccttctgctagatatgtactgaactcttaaaactccagatgcttccccagggcagtaacttctctcccagttctgtgttttgtgatgtgtatgcccttttaccactttgggctgggggtgacaaatgcgttactatttaagggtaggctaaattgatgtttttatgatttggatattttcttaagataatttttacaatttgtaacggaaactagggattctaaatagttttaccctgacaagtatatatgcatattttgattcatcttgtgttttgcaaatttgaaaattcctcactttttgtcagtccttattctagtatctttggccgtaagaatcaaatgcaatttgtgaaattagttaccacttaaagttagaaatcctgttcaagacgttaccttgcaagagaatgcccaaacaaggcattaggagaggtatggggcaaaaaaattaggaaacttgacaaatcacaccgtttctgaaccaaaattcggatttatgtttttctgagtcatgaattccatagttccaaagacattaggactttggatttccattcgcctaaaccaataacaacagtgtttattgatttgcacagtatctaggcgcatagatattcctcagactgtttggttaatgattgtcttctatatgtttggaatcactcctttgtagacattagtggaggttgaggtatttacttcatgatctgctatgatacaaaaggaactttgtattgaaattctggctgattaccttagggagttattaattttatgttaacaggttgaattttcatatggagtaatcccctatgtaggactctaggctaaacggagctttgaggctttgtgatgcattcctatgtgaacacatccctggcgaaaggcttttaaaagatacaccccaaaaggaagagcctttagagttgaaaggatgtcagatgtcatcagtcacactttcccatttaacagatgaggaactaagtcctgatatcccatgatgttttttgttttactttgtttttggctatttcctttttctaaaaatagccctctctggggaatgctgagatcttcattctttattagtatcaatttataattatctacatctgtaagcagttattcgaaagtctccagatcttattctatcctggcacccatggtgactaaaaaaatcaaagacgttaaatctttgaaagcagccttcaaaccacatactccagccaacttaccttatatgtcggggagttatggagcaaatacattaattaacttgacagaagttgcacactttctgtacttctgaaccaaaatttggatgcatgtttttctttatcatgagtcacacctgattaggatttccttagcttttgttggggtcagacaggattgtgaccaaaggcaagatttctctgtcatctcttttgacagaatttccacaatcatggattttgtaatagtcctggacattcatcagaaagtaacctgtagtggggctgcctacataggattcttcctttgaaaagccttaaacatttttctaatggttggtctctcttaactaacaataaaaaacagcaacaatgcagctgggcacagtggcttatgcctgtaatcccagcactttgggaggcccaggcaggtggatcaactgaggtcaggagtttaagaccagcctggccaacatgtgaaaccctgtctctacgaaaaatacaaaaattagccggatgttgtgttgcacacccgtagtcccacctactggggaggctgaggcaggagaattgcttaaacccaggaggcagagcttgcattgagctgaaatcgtaccacagcactccagcctgggcaacagagtgagactccatatccaaaaaaaaaaaaaaaaaaacaaaaacaaacaaacaaacaaaaaaaccagcaacagggatagtcagcataactaatttaaccagcacatccatttcgtaaaagacatcacacattgtcatttgtaagcctgggactttaactatttctcaacttttttagctgaataatttttctttttaaaacaaaactgaaatctgttgtatccattttagaatttatctcagtagtttgtatattcatatatatgtggtgagtttaagaagacgtatttagaacatttttatcttgttagcaatttgacatagaaaaatgaaacattaatgtttttattgtgagtcatgtcactggcacagttttcctctagtatcatgtgtggtgttaccttctatgtaaatttgccaatgaataaatgtttagtaaacaaacattttgtatttcattgtttcactcctctacaagatactgactagtttacttagtttgtaggtcactagttaactagttgaagatagaggaaagtttacctatcagaaataaattgaagccttctcaagtcatagaaggtttcacatttatgatgtaccaactactagcaaacataattaagggatcattgtattgtctaggtgcagcttagtagaatatgtaaagttttttagctgtccattaccctggtataatcttggagccataacccaaaactatattcctggcaagcatgttaagaagtggaaaatatgggttttcaaatcttgtggaaatactagcctttcaaatcatgggtgagaaaaaaatgctaaattattttcttactatgaggaagatttcttgccatttatctatgtatacaatattgtatcacaacagttaaggtataatatttctactcagaacaacagattacaaaaaaaatcatatgcccctttcagtgttcatattgctttgttaggccatctctcagaatatattgtgtaaaaccagaagttttagttttgtgtttaaaaatgaatgcactatgattatactgtaatattttcttttaataaattatgcccgtgtgagtatttggtatttaatattgtgacatgcctcgtcagtggtgagttgtccattggggtgactggttttataattctatatactttgaaggaaaaaagtatgtcttgagaaggaaatatttcttggctaatagtgctagaaagtcccaccttattgatgaatgacacttttgctgaacaggtttctatcctaatattctaatactgtattagaaataaatgagtaatttgaattcaggtaagggaaatggctaagtattacatttgatttacatttttatcattagcatttatataagctgttaattttcatagtttgtcaaaatgggtgcatttgaaatcaaagagaaagtttttcttggtaacgtgctgagaaggggtttcagtgaacttacagtattactacaatagtgtagttgatgttaaatgaggaatgcagttgaaatccccagcaagtttactttttgtgggttatcctgaaaagatgtagcaatttaaataaatttttctcctttgctgaaatgtctagaacaatacaatacagacttttaaaaatccttcacgcttgtgtatgccatcccaacatcctcagtcatggcctgaaaaacctctggccactcagatcctaattttttgcatcaagatcactccaggtatctctccttttctaggctttgtttttggtaatactcatcttttaagtttcacctgactgcatcatgggcttttctccatcatgcatttaataatgatgttgttgctatctaaaataaatatcatcatttcttctggcagaaaagatcatattgaccatttaaaacctaattctgatgttaacttttgccaagatttccagcacttcctacccccagtaacccaggcaattacaacacaagtgaatggctttggactcatctctacaccaccatataattatcactgcttgtaattctttctccttcactagggcatacgtcctttaaggacagagactgtgtcttgcagtacctgctctgcagcagttgctcaatgaatgaatgaataaacaatgcaagttagtggggcttctttgtaaatttcctggtaatttttcaaaggacattcacagtttagaatgcgtgtagcattttcacattataagacatttgagagagtatctttggctttaggaaacttcaaaccagaaaaattgcatgcattgccctgagctatatagttgtagcgtcagaggtagtaatagactcgaggtctctgtttgacaatcatttatgaaaaataaatgtgctaaattctgttttgttctaccaggttgagcagatatgtggaaaattagacttttactaatatagcaaagtattaaaattaatagatgtaacactttgatcgatgtctagaattttctcttcttcttttttcactggacaggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactggtaagctcatcgtccagggttggaaaacatgaattaattacagtcccattttatgtttaagtggcttactgctaaatacagttaatcatttttttaatagctctgtcttcatggtttttatatacttatcactcttataataaaagattatacccgaactctgtaaatttaattgttttagccttcaagagctatagttagtaatataaccaaaacaatgacaaaactactaccagtcaaaaaaccgtgctcatttgtttttcactttcactttatgatttatttcacatctgtgttaatttgatgcattgttttttaattaaataaattcttggtaactccctaaattgatggcaacaattagatacttttgcaaaactaagagttgatgtgttctaagagtgggaggaggctttttttaaagtgtttttttttttttttttcagagtgctataaccatactgtttaaaatgctttgtaattgcttttaacatagtgacttctggggcactccctgctattttctttcctgtgtctttcaaaatagaagaaagcatttgatactactgagccaatgtgtggctcatgaaggtggatgtgtgccttaatgtttatgcctagtaattatatacatcaataagcaaaagcagagctcctcttggggacgacctcacaaggttgtagtgataattaacacaaaccatgtgaagtattgtaccagaattttctcattgccctttctctggggtcttttatgaatatatcagcaaaatcatatttaaatgttatggtgttgttccttcaccacttagccattcctgcttcctactgtttttctggcttgtgtcaacattaaatattagataggaggtgtctgggggactggcatttatttgcgttaacatttttagtgatgatcttaacaaagtgaaccactcccccaatcctcttccctgactctccacatgaacacacaaaatacagttcatttatctgttaattatgaagatgttctcttggaataaatcacacctcttatttgggaccttgaaaagttcatctctagcttttcatttctttctttttaaattctctttttgaaagcacaggatttaaaaatagaactaccctcaaacctgtatgataatggcccatctttgaatgaggtttttgattaaacatagaagggaagactacaatataaagtaaaaacccatttgaaatctgcagatggtgttacattgactgctgtgtctcatatctctttctgaaaatgaaagtagcaacaacagagaaagcaaggattagatagacgcagtgttcatcttagggacaaaagcctttaaatctctaccatgatgagaaattgtggaggtggtcatagtctttggggcattataaagcagtatattagtgaaaatagataaataagtagaagggatagattgtggcattaatttccctaagggggatttgcaaaatggtgaggacttggataattttgctgtggggaatgtggggcaaagaaaataatatgaatgaagggttatccaaacaagaatgccagctgttctgaatcacagcagaaaatgcaagcttttccagcctgacaatatcttccctaatccttgatgaaaatgctatgaaaacaaaaggccaataagacaggattaataactggaattttaataacattaggggtcaggatatggttacattctttaaagaatcagctgtcattcctgccatctaacttgttaaatattccagtgtaccgtttattgtgtctgaaataagtttagtgggaatattgatagggaagaattaattttgtcatagtttaagaatatttagttatttaagactcttactaatgcacaaactcatttgacattttaaattgtacatgtagttcactgcacagttgtcgaaggccatgtcaaatggctaaacttacttgtttacttatagaatatactattttcaatccattaatcaattgagagaacattaataatgtgtttctgggggaaaggaaataacagcaaaattctaatcttaatggtaacataattttagaggatataaaattaaaggtgcaccaatatgtggttttcaggcgagattggcagtgacaatttgtatttctttgaaaaatcttttaccaacaatttatttctactaacactgtatttcaaatgcattctgtttacaagtttggtgcagtattggagttgaggttttttttgttttgtttttgttttttttttgagacggagtctcgctctgttgcccaggctggagtgtagtggcgcgatcttggctcactgcaagctccgcctcccaggttcacaccattctcctgcctcagcctcccaagtagggagttgaagttttaaattattctagaagaggtaaaaagaattggttagcatgtgcagagtgactgaagagatccactgacaatatataaaagaattattggaaatatattatttagagtttgctgttgcaagattgtgtcatatttcttatcatatgggttttgattttttacttttagaagtgtgtttttttcacttgggtgtatgtgctctcatcatataagccatttacacctaagcatagtagtatgtgaaggggcatctgagggtagatgtctgtcatcataatttgtgtttgataatttgagatagtcttcattgggtgatgactgacttgtttagtagttagcaatttacatggggctttcaccttaggttgctgaattctcttgttagctttttaagtgaatgagacaactgttctctttattgagcatatttaatacataatgagctcaaaacatttcaagtcaccctacccagtggcagggcttttgcctgctatcttacttttcaaacttttaccatagctctttaagagccaactctcatttcatgcacagtaaatcgcaactaaatttctgatgtacatccaaaggttgactgtttttttactagtatggatgatagttcttataaggccataaagggttggaaaagcttgcttccatcagaaacatgaggaagactatcataaattcagctgacagtggaaggagccctgggcatttttagtgtgctcagttagctgtagagggatgttctctcacctggccagataggcaaggtggccggacctgatatagtagagctagtatacttacttacccaatgtgcccagcacagagaaaacccttttcatattatgaactgtggctagaacaccttatagcactttagaatgtgttcacagatttttacaaacaggagtgattctgggacatcttcaaccacttgcgttggaggaacacttcagaaggcatcctgttaccagggatttgccatatgcttccttatcatgcccgcttgagccactgtgttggtgtcacccaaatcaaatgtcatctaaacttagtcattttcttcctgattctcatatactgtttattcactcatctatgcatcctcagcatctgtttcagacttctggtttagtatttttcttatgagctcatagagtacagggaatctttcttatctgttatttggatctacgtacctggcacaatgccttaatcagaataggttctaataaatgtttgttgaattgatttctttgttttaatatttcagagaaactgcagccttatgaaatggcatgccataatggcattttttttctttccttaaaacacaacataaaagatacataagaaggctagaatgtactctttttgaaacttctatttagttacaatttatatggtcacttgttcgctgctagtgtttgtatataatatatgacaggtttcctgaaaaattcagttgttctaatatcaggctcattttttatgatcatcttgaaataattctgtattgtcaaatagagtgaagaaacagagaggaaagtagagaaggagaaaattcacatggagaaagagttactctaaaagttaaattaattttgtatttttctatcactttctatacagccacagttttttttttaatggactgtatttgtattatttagttgaatttttcttgaggaatatacatatgtatatttacacttgcaggtatgtatgaacctccctaaaatggatgcgtgctatttttagtaaatatttttatttttattttttcttcactccagctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtagtgagtacaatctccatgaatctttatctaaataagttttaaatgctttcaggataaaattgatggtcccaagcagatgtctgtttactttgagcaatagagaaaataaatgtgaaatgtggcaatttggcaaaaattagtttttctcccagtttgagataacgatattactcataagtggcatgtttacataatatgcaatatgttaatatatatgttttcttaagagaatggaaacaaacacatatgcatatcatgctatgtccatgtatctttattttacaaaatgaaatgttttaacactttggctatttaaaaccaatttcattgaaattgtatttggttggttgtgggatttttgaactagaagagaaaattttggagagaaaccattatctcaatccatgtctagaatttggttacttcatgatgtcttcctttcattgctgttctttaaggtttatttattggaagctttcatattttgataattaaggcatttaatcaaagtaataatttgagagtatttattatagaaagtatttaggagcaaatgagaggaggaaaataatcatagttgttcaaacaccaatcaggtagtgtctctttaaatccaaatccaccaaaaaaaaagtaaaataattaattatatttatacactgaatgatttaaaacctttgttaatcaactgtaacttatgctgttctctggtggctgtttgtattccaagactaaaagcattaatttatcatacgcataaagaaaaatttggtgatgcattgccttggctaattatgatatgctaacatataacacacatgtctgtgaaatgaaatgactggcatattgcatggagacactgcttttttttcctccttttttgattatgaatgtttgcttgatgtttcatagtatttgcatgaaatattagctgaggatcgtcacctaactaaaaagatctgggaatggtggaagcatggtgggctatgggaactaactgggctaactattatacatttaccttttaacagtagctgacgagactaaactcaatacagtggatgaccagaaagcaggtaagaatggacagttagactgttgccatagaaacgatggcccacatagcttatcacaattatagagctgccaatcatatgccatgtaaacatacatattccagtcttacgcagatgttttcattgtgagaaattgaattacataagaaaagaaatattttctgttagtagaaatttatcagtggtgtacttactaaatagtaatatgatttactgcttcaaaaaggctagaaacaacctagattttcttaattatattcatgtaaggatgttttatcccaatttttaaaaaatcaaaatcctgcaaacgtgatctgttatggtagagtcctaggtttttaagtcagctatgtgatgtctaggttaacatccaaaaagtgattctcagagtggtgattttgatttgaaagataatagtgccaatataaatgtttttcattgtaggacaacgtccggtattgctatcattagtcattcagaaaggcatattctttttttgatgctggaattagcttataattaacctgacgttggattagactatataatgcatatggcttcatatcttaactttgtgagcttgttctaaattcgttacttctaaaatactgccaaatcattccatagaaacaatggattatattgaactgggattgcattatagtcatcgattttgctttttatgttattgtatgacagtaatcacaggaaggtcttttaagtgtagttaacgtgctttgtataattgaccatttatgacttattataagtttggaatagtgttttaatctgtatccagtatgatgtagttacactacttagcactaattagcttcaatttgcctttttaacttgcagtagtaaattagttttagctgcttaaaaaatgtgtatcccacatatatatatgtaaaaattattgtaaacatggttggagttatattctttggagtataagatagattgtaaaaacgacatctaataaatcataagattaactgtattgcacggcagttaaccgtagccttatcccttactgagttgtttgttgttcttatgaaacctaaagtttattgaagcagagctaaagagaaatgttatgtgatagttcacatatgtaaaatagtagttagtttttacagttagcagtataagcaataaccccgatccaagtaaacagtcataaaaaccaaattgagctgctcaggtaaaggacctgacttcatatacaatgtcagttaggtaaaataagaaaaatacttaatttaaccaactcacagctactataaggaaaaggacagtttattgtgatctacaacataatgatatccaagttataactcagtgcgttagataactttcatggaaagtcattacataagtttcaaggcagattttatagtctaatcaaaaatcaaactgtgctagattctagagaaaaagaacttttttttttttttttgcactttgtgcagtctattctaccaaattaaattagaaaatattggggcaaaaaattattacaaagatgtcaaaatacttggtctgttgattttacatctaaatgaataaaatacctaaagtagatattttattatttccctgtcccctaatattagacagtgaaaagattttcacttatttttctttcgtcacttcacttgacttgagttttcaagaaagattatgattttatagattagtccaaaggtttttgggagaatcatagtggcattttagcattgaacatctgtctagcctagccataagcctttcataatgaaaattgaattacatttccctctgccccttgcaaaagacatcctttcctttcttttttttttttttttttggcaagagggatattactaagtaggaataggaaacagatctaggaaaatagtatgattatgatttccctctttttttttccatatttaggaatcttgtatcatattttggggataaatatttctcctcaaattataacaagggagaacaggtataagaagagaattggatttctaatggtttcattcttgaagtatagagattagcaaagtatgctaatgacctaaaagatatgtgtaaagtaagagcttaaaatattgttttaaaattaagacaaaagatactaacttttatgatgtaaataaaatcttttccatatattttatgtacaaaaagactttttcaattttcattactagtaaaatgctgtttgtattgttagggaatccttttaattttttttctaaagacatttgactgaatcaatgtgttagggattttaataacttcgctgagaaatcctaacatatcattcaaaacctttgttatagtttcttggtcaaatatagtactaaagtgtatgttactcatattataaatcgaatgttagcaagctttttctgtaaaggaacagatggtaaatattttagatctctgttgcaacttttacattctaccattgttgaatgaaagtagtcatagacaatatgtaaatacatgggcatggctgtgttccagtaaaattttccacatttgactcacagtttgctgatctgtgttacaggttcagaagttgtagataattgacattttgtataattttttattgtaaaagttttcatctatacataaatatacagagagtagttcattgaccttccacaaacccagggcccaccatccacaatggtcaacagtttgccaaaaggttatttcagagtgttatgaatttagggaaacaaataggtaggtatgctctgaattgcacttacaaaattatcgtttatcgaattatactttgaccattgtttttctttccaagtttgcctgtgtttatgcttagggacactcaatttcaatgaatactcatgccatttctgaaatttattatttaagtttttattgctgtcagtacactaagtaaaatctcagctaactttacacaaagaaaagctttatataaatggtgtttttatgagaattttttctggaagcatgaaatctttattcatgatatatactcacatacaaatacatacacacatacacatatccttaataaactcaagaaagcaccaaatatttgcccaatacatgtgtatggaagccaaatatagctggtaaattatgaaagttgatagacatttattcacaaaaggatctttccagtgctaattctaggaactataaaggtaaatatccctgcccaggaatgatcttttcccattcttttttattccttcatttcttattatgtaggtttttggaacaaaattcatttttcttcccatgacatgacttttatgagtaatttagaaaatgcagttgtcaaaaattgtagtgctgcccagagaaaaagtaagatggatctcattcaaagaaataaatctcatgaacttttgtcataaaataaagaaatatagacaaacctgcactgagaaagctaaatatgacatctttttctttccagcacaacaatttgtggaatattatttcttcattagaatcatgtgtttgccttcctgtttgtactacattttaaacatatctattcttacccaaaatagcttcatttaacatcagtgaatcttaaaaaattaaattttgttttgagtctttcagtgtaattttaattctattttattttctgagctgtgaaaagcctatgtcacaactatttgtcttctgggtaataacatgatcaacatatgggctgatgaccccatgcagagataaactattttgtttctcctaccctctatttttttcacctgtctttttaactgtatatatgaagaaccagttctataacctggattgcccaggtggtggtgcagagctggtatttcagtcatccggaagctaaattagtctacctttgagtatcaggtcaggcagtgatggatgaggctgtcttacctggttaaagaaatcagttttgattgccttccacaacttggtactattggtattatcttgggtccttctgccctagatcctcaggaaatagagccaaatttttaattcccggaatttgtccctgtcatcctcatgaaatgttctggttaattgctaagtcgtctttcttctgtccatcacctgtttttcaaacatattgttcccaggcctagagatagaagtactcatatccagtctctccttttttatttccctctgagagagagcccttatgtaatctgtttccgttcaaagcttgtgttactcttcctatagaatatccatatttcccagggttgggtttctgcctgctgccaggttgccctaactgttttggtgacatgttggcccccgtggtcttactccttatgcagtgttgtgggtctgcagtttagcaaggaagagacttgacaatgcacattgatgtgcatgtctagcttctgttctaaagaattttaaattgccaaaaaaaaaaaggttttaattaagtgcaaagcttattcttggttgttgaccttagccttctcctcatcttcccttgcttttcaaatgagcttccaggttattctggttcttttagattattcctattaccggagcaaaacgatttgacaacaatttcatctgttgaaattttttttaaaaagtaatgacttagagtttttcctaatgcaaagagagaaaatagaccaaatctaatataagtttgggaaaaataaaaattagcaactattacttcatttattctttgtcttttccatctgcattccagaactcatcattgagcaaataattgttatgtacctgaagttttcgacagtgcatattcaggtacataattttcactaattcacactaacattttttttcttgtaaacctcccaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagacctgtaagtttataatggctgaaagaataataattaaaattagactctatttcttaaagtgagctccagggagccctggagttttctaagattcttcagggtaatctctgagatctctgaggtctaataatctcttatttcataataagacgatattatttgccctttactcacattctcttataagtatacactggggttttttggaggccacatgtcctgtgatactgcattagattgaatgcagaagcagatatgagaatctgtcttacaggccaatattaaactaaaaattctgaaaaaatatttaacagtgccattgttctcacttcttttggaatatatatattttttggtaaaaaatgtaatttctgttaacacgaagttgcttgtttttaaaaagtaatattttaaaactttcccagttttaattcagtacatgttgctagatataatccacatataaaaaagttatttggagtgcttaataattttcaggggtgtgaagtcatcctgagatcaaaatatttgaaaaccactactttgtagtgtctcaaataggatgtctccattgagtacctgtaataatctgtgatcttaaaaacattttttttttctttttttgctttcaggaattactcattctttcctataactaaactagcaagctatatttatgtgtgtttattttgaaattgcaaaatatttaaagccaagattattaaaagtcaaaggttaatatgaatgttttccatggtttattgaataaaaaataatttatagataggtacaaatatatccttccagagagttaaacatttcttatattaaagtaaacattctattaaaaagtaatggaaaaactctaccgatatatttactaagaagcaaaagggcttaggagtcctaatagtgaaaattgttgattatcttatattgctcataactactaatttaccttttagtgttttaacctcaaatgtgactcaaccatcaaactattgtacgaatagttggagggaccacagaataaaactaaggcagagaccagagataatttgtgtagattgtaaattacttgcaattcaacatttgagtggaccacttctatcacatatacctaagaaagactttcgtgggaagaagagttttaagtaataaagatcacattttgagaatatatacatatacatataatgtatatgtatatatacgttaatatacattgcttatacgtataatgcttatacatataatgcgtttgggaagatgaatatttctgtcataatgtaatatgcgaagcataacttagaggattgctacacttctctccacctccacctgattctccatctaaatccaggcagttttgtcactatgatcagattcctcacaactgggcctttccaggcccagtttttcccttttggcggcctctccaggcccagaacttccttaggtcagcctctccagacccagttgcagcctcctggtgtcctctccaggcccacctcttcctcccggctgtgaatatatgcagcccattcttgcaggatgaggagcatatttactatttttgctgccaaacctggtctccaagatcctgagtcatataagctttcgaccctattgagttttttctctttgtaataatggttccttgccatcctaatcaatattacttgacaattatagagcttgcttctctctgtcttgggtgtatatttaatcaaaaattactatgctttggccccttgatatatattttttaagtatctataatgatgcttttgaacttttttcttgttctggttaaaatgttatttaattttccttaaaaaatgcagtttgctcttataatatttcactcatttcaaatgtaacaggagatagaatacatatgaatataaggtatatttttaattctgtagggatagcctccagagtgtcccaccaacatggacatctgattttgtccctatataaacttattttttaaaaaacaaaatgagaaataacagtatattaaagttcattcatgtatctgtccttcagagaaaaaaagtgaaatgaaacacatggataggcaaattacaatttgcaaaccaaagataaagttctggacaagacctgggaaatacacgtgtggcaggtgccctaaaacacgctgcacctacaaccaccaaatgttgtatttttcaaaagtcctgtttttattattttttgcataccagtcttctgaactttgcatatggcaaatgaatggcaactattgtaaattccaaacttttccaattttggttgttgaaatcgtgtttatagggtggaatgaacacagaagtggaattcaggtgacttgcatcctcctctacattcttctaagtaatttgggattttagtcaaaacttcaactgcttgagctttaatttcttcatttgtaaaactgaagatttggactagataattgactttcaactggtgtgttgtgatctctggtcaggagcagtacctcaatgggtttggagagtgggaaaggccaccagtgtcaccttccccccaccaccaccttcacagttgttttactcacttctgtacatggggatcctttgtaaattttagtttttaaaaagggtgtttttgagtatttaggaaaaagttgtaaaagttctggcttagatggtttagatggtttccgaagtccttcctagtttaacattccatgattctatgtaccccctcactgccctacttctggcacgctaaccccctcaccttttgcgaggcccatgtggaaaacaccccatctatttccatcttgcattaccaaacacaaagcttggcaaatcatagaattaaataaatgtctgccaaatcgatgagtgggtgagtgaggtatcccacactggaccttgtatgcactagatcttcaatacttcagcaaactctttgtttttgtttaaaaaaaaattgtctatcaaatgtggtgttactgctggtggctgtcagcttacataaaactgaagacgcgaaggcactttctgcctccagctttggaaagaaggctggctcagttagccctccttcggcttcctaaccacaccattttcagcgtctggcttgtggacctgcacagcggagtctctggacttgctgtctctgtggctatgctcctgcatttttgcccttctgggcttgtcccttagctatgtgtcccctggctgcatgtccaacatcttctattgtctgtgctaagtgggcctcaggggaagtgggttctttcttgtcccgatggtccaactcagttacagctgcccgtagaaattaaaaagccacatcccccttgaacctggatctgaaaagaggaccctcgtctaggcagatggtctttttgtcacatgggacatttcctgaggatgcagtgcaccctggaaatgcgtggctagagactgagccattgtggaaaagctagttatggaggtcagcaggaacagagagctccttgcaccgtgctgcaggctctgatttctatcatcatgtggcacttttcctctttacaagtaagacacataggcgtaggcatggttgattgcttttgtcagttgggtcgagcccctccccagtgactatattcatggcactgaacaggctggcctcttctcagcagtgtggaaatcatggcatgggcacagcaatggggccaagagactggggtgggatccatgtggtatctggtatctgtcatcttctgcagcacttacattcttcctgtggagatggcagaagccagcatttttgtgtctcatttaatccatctggcctctccatgttgtgtgcgtctgtctggatcaagatggagctttgtattctgggacccattatctccgaggccctacctgtgtttgacaggtcagggcattgacaatctgctccctcttctatgcaaattacatgcccagcctggctctcagcaagcgacttctcctccccatgataaatcagtttctattgctaccaagaaaatgcatgcagtaagattgctttgttttcttttaaaaaatacattaattctactttttcgtaattaaaagttgccagaaattgtaagccctgcactcagttttgtaacagctttttgttaaggttgaggaagtgaaacagcaaaactaaatatctcctattaattatacctattgattttaagatatatcaagttcagaattttaaatgtgacaaactttgtgccttgcaaacatgaaggcattgtcttcaaacatgaagtaggtagcttgcataatttcctatagagctcttattaagagataggagaaaagcactgctccagaatacacataatttaggttttcagtatgaaatttgaagaaactgaatttacattattaaatcaactaatatgagagcttctaggggaattttgttattgttttattagctatgaaataacatattgcctttgatatctcattttctactctcagtattctacccacttctagccacctttcatcaccacctatttcagcaaaaataatgcaaactaagtataattttatcataagcaaaacacagtggattacagtaaatctattgtggaagaatttgggatcagatttcaaagtcagagtactttgtaaactgtttcctatttggttaatccattttagtggataattggatgttgatctataaaaatacttgttctgaaatgctaagaagaagaataacctatcacatcattttatgcaaataaaatgatacatatacttaacctgcagtttaagaaagggagcttcgattaatttttaggaggtttctgatcatagtatgggtgtatggttgtgaaataaccaaaggtattctctgcatttctttttctaggtaaaatgtaacttagcagaaagtgcaatgaatattgacatctgaagtgttttgaatgatagaatcctcatttctaacttttttttttttttttttttagaaagagtgtcactctgtagcccaggctggagtgcagtggcacaatcttggctcattgcaacctccaactcccaggtcctggttcacgcaattctcctacctcagcctcccaagtaactggaattacaggaatgtgccaccatgcccaagtgatttttgtatttttagtagagacggggtttcaccatgttggccaggctggtcttgaactcctgacctcgtgatctgcccaccttggcctcccaaagtgctgggattacaggagtgagccaccgcaccaggccccattttttaagaggaaatagtatctatatatttgactaagattacacttaggaactgaatcttagaatgcgtatcttctaattctcagtcctgtggtttttctagaatatgaaacacacttccaaacagaaagcccattgcgctaaaactactgcagagtgtgtacctaaagtctgatatttaggctattagttcctaagggctcggggttgggggatgattcaacccagtggataaatgagcacttgataaggagtgtggttcagttccattgtagtgtgtaagttagtgtgacactggggagggggtggtggtgtaggggtgcccagctgatgtggaattagggaggagaggaaagtagaggaggagatttccagaagagaggtattggccgagttgagtgttactgcttgagagtcttcaactggatgcacagagaaatatggaacatagggaatggggagccatctctgggctgcagtagttctgttaggttggtgtgtatggggcaggtgagagcatagtgaggagtgaggtttaagatgtaggtgcctgtcatcccagcactttgggtggctgaggcaggtggatcacttgagatcaggagttcgagaccagcctggccaacatggcgagaccccatctctactaaaaatacaaagattagccaggcgtggtgctgcatgcctgtaatctcaactacttcggaggctgaggcatgagaattgcttgaacccgggaggcggaggttgcagtgagccaagatcacgccactacactccagcttgggcgacaaagcaaaactccatctcaaaaaaaaagatgtagacagcaaaccacagactattttaaattacttgcatttcaaataaaataatatgatgggactctggggtagagggtggcttattgagatgggatgataagtagtaacgtcagggcaaggagctaatttctgtgatagtagtacaatcatccaggtgagcgatgatgcttggcagtaccagagcaaaggaagaaactgtttacgggcttagcgtctctcacacaaagatggatgatgatgatgatgtgatttctctcattagcacttccaggctcagaaacttggaatcatcatctcactgtgtcaccactccattaccaagctttcttaatctttccacatgtaatctaatctcaccccttacttgcagtctaggccggaccctcgttatttaatatcagaaggtattgctagtgtctcccaactgggcctcctgtctctagatgtgcccagtgagctctgcagtcaccttctgactctcacagcccctcaagtgtccgtgcttacccttgcctgtgccatgcggtgcacacttcgtgaggtgtatcttctttcttccccagccctctaatgtgtgtatattatactgtcatcttccttctccaagaaacttttcccccgacaatctagtttttcttaagctccagctgattctacacagtgcatccgagactttttagtataaattatttttttaacatcaggaaatttttgcggatcactcaatatagattatgtttcatggtaggtaagaacattcgcttttgggaagcaggcattctgattcctcacacacacaaaagcaaagtaaagcattgctagccattcactattttataatctctaaacatttttatgctgttaatttttgtgtttcactcaaaagagtctgagcagtggcctgaaatctctttctttgaccataaataatagtttgtatgttgttcaaacagacgttgtgtacgttaagctcactccttgattaaaataaaattctcagtggcaattccaactgtagggttaggaatgctgtcatttcgattgtgtagccagccctttcggtcagaattggtttttaaaaagccttcagcttcattttaaattgtccccatggacagaaaacagcatccactgtgggccgtcatttgaatgttaaaatcagttggacactaaaagcgaatttgcgaaggttcagaaaattgagggtgtgaccctcattgtgcctgctctgcaacattgtctagggaagggagggataatggaggtgacattctaccattatctgtgggagcattttacctgcttcatttgagggggatgggttaaagagaagtttagaatgtcaagtaaaagtgaagaaaggtttttggtaataactctttaaaagagtgatcctattgtttttcttccttcacccacatatattgaaaggttttttaaaaatgaaatagagctatttttagagtagagtgtctgaggagtcatctatttgaactttctcccagttgctgaaaccactctacaataccactaataaatgtcacctgattccttcatagcttttttacctcctcacagtcttcatcatatcagttattattctcaccccatgtattagtctaaaagctctaaagtcttcctgtttcatgccagctttgtgtgtgtgtggtttcctttttttggttttcaggaaaagctaagtttttctgttgccaagagctcatcattctaatgttaaaagtcagagtccagaagagcagatcatgttattcgacaccatctgtgtatcactagctgttcatttcctacatctttctttctcttccaaagtcaaagtgttccaccaaaataagaaataaaaacaatatttatgtccccagcgttcttgattcctatgcaggagtttgcagcgactgaaagtccagtcctcatttagttgtattatctttttacctaacactaacagaaattggtagtggtcagtggatttactaaatccagtgaaattttctattttgaatgtctcattttaacttaaaagttttgttttaagaatatagcttgtgaagactgagtcaccctgtgtagaatttttacatttcatcctttatctttcaatataaattgtaaattgctcaagtatctgtgttcctattactaagtattcctaattctaaggtagttcatagttaaatgggtgcaacaaagggcagttcttcatattgttggctgcttattcagtccttcatttaattgctcagtgagtatttaatgatgcttcttggggcctctccctcagaggagagtattgttgagttttaaatacaaagtaatactatgatattttcgttttgtatatctctatttatacccattgaacaattcattttaatctagtagcaaatctaaacaaattatttaaatctagtaaaattgccaaagctacctaaaatgatatttactgctaaattatacacttaagacaaataacacaatagatattccacagttgctctaacacttgctttatgcagtgtaccttttaggatgctttcagctatatgtaatagaaagtgcaactcagaccaactcaaacaataaggaaatacattttcctacataacttgagttctagagttcttcagagagatttctccaaagacccaacatttttctgccccttctgctctgctatccatgagtcagctacccacaaaataattccataattcagctatccatagggtaattttagggctcagaggccttttactgtcttattgctgtctaacagaagggaatgagccctctccctaagcatggatatgtccattgagtccaacggggccattcttggtctgataaccttggactggcaagtctgcaggggtatggcatccataaacttaataatgaattcaccccttggagctaggttgcattcctggacacagagttctattaggaagaataaagggagaaatggattttggataagcggccaacagaaattatagtatcaacagtagcatcacttctcaatgggggggggaaatagactctaatgaccttgaggctttgagtcaaccttgactgtaaaatgtttgtaaagtttagatagaaatagattatttatggcagtagctgcagaactttgcacttcaatgaaaacccaaagtcattttctccatcatcattaacacgtaaatgcccgatcttttccaaacttgttggtgatccagtcctaacatgatacctttcagagttgagtgccttaatttgtaacatggactagaattttaattgagctccatttgcatctgttgaaaacatggtaattaggtatgtcttaattgcagaatgactctgccacattaaagagaaataagcagcttcatgctacaccttctttaaaaaaagaaacttgaaagtgcctatctttataggtaatcacatggaaacatagctgatagttcagtgcatagagcaggtttaaacaggcagaaatgttgtcaaaaatggaaatttctatttgtttggaaggagataatcatcgctctttgtgtagggtatctgcaaaaggaaagcaaatagtctgtcaaaatgagcaaaattaaagagaaaaaaatcaagaaatgtatatagcacttaaaatagtacattatctaaatgtaaatttatgattagttcttaccttgtaatttgctgtatgaacacaatagatcaagccatttattgctgatatattactagtacttttcttacttgaaaaattgtttatatgcatgttcgtttaagggaataaagatattttatgtacctaattataaagctagtattaaatgtacagatttattttaaaacctaaaatctgactagtacatcagtgactttgaatatgtatatttttttcaaaaattaagcatgtgtaaccaatttatttgagcttttgaaactacaatatttctgcataggagcaggataaagatttttctctatcaaataatttcagaatttgaagtatatataattcagtactttaaaagaacatcttatgtttgtacatatgaagctacatattgctaaatatttttaattagttggcattcaaagggattagttaaatcagtacacccccagaagagtttctgtgataatgtattatctaatttagaatgttcagaacaagcataaagaatcctccaatgtgcaagtgtcattttaaacagtccactggcttggggcaggaaacagaggtaggacttttaattttataaaatgaggttacaaaacctgaagctaataattgatttcatactactttatttcacatactttagaaaataagttgtgttacatacaccagaaaattattttgaatatgaaaagaattggcaacaaacgtgacttcagcatatagtgagttgtgaaggcactgccattattctgttcccaagccaagagccgacatatgccccttgaacttctgccaaaactattaggcagaaaactaacagaatcgctactgatagttccattcatgatttatgataatggttgctgtggaagactaaatcatttacatttattgagctcatttttctgtttatagtttcagacattgtagagggtcgtaaaatctattaaatgatgcatacagcactaacaataatagcatgaaaatataccagaaactaattagagctaaaccaaatatcatgagcattcctacctagtgttactgtagtcagattgtggctagtcttgtcaggcttgatgagagaacagtaagcatttttctaaagctagaggaatggtgatacctggcgattagataaagttttggtcaggataaagtcacaagtcagtttttaccaaaagtctttcatttatgcagccatttatgagcagctgctgtttgccccacagtcttcatttgaggagcttagagaatgggagggagacatgtatgtgatatcatatgagaagtgcaataataaaagattgtacaaataaagagctttggaagtataggtgaaaggaggtttccatgcaggaattatacaaaattcactagcttccatttatctagtttgagtataccaatagacctaggtttttatagctccagagaacttctgggaattgttctgtaattatttggtcaattatctcacatttgtggccacacccatatctcaaaaacctgaagtactggttcacaagcagatagaacacagccatgttcaagggcattaagcaacacactacagccctgcttgagctatgtttacattctttgggggagctctcatttgaaaaggctgcacataattagtaagcccttgggccaactgccaggatattctttccctgctctgtgtacaccacaaaaaattatagcctgaactcagtattatttgtaagattatggattttcactatgtccttctagttgtaactggcttcttctaataaacgtgcacaattactatttatatcttaatagcgaggaaaaggagcaaattttcttaaaagccaccatgtcctttggaggaagacaatggcttacaatgagataactcgcagttcagaggaaggctaacgtttctgaagtcatttatatgcttgggctgggtgtgactcacccctgtaatcccagcactttgggaggagaggctggtggatcatgaggtcaagagatcgagaccatcctggccaacatggtgaattcctatctctactaaaaatacaaaaattagctgggtgtggtggcgtgtgcctgtagtcccagctacttggggggctgaggcaggagaatcacatgaacccgggaggtggagattgcagtgagccaagatcacaccactgtactccagcctggtgacagagtgaaactccgtctcaagaagaagaaaaaaaaaaaaaaaaaaaagtctgggtgcagtggctcactcctgtaatcccagcactttgggaggccgaggcggggagatcacgaggtcaggagctcaagaccagcctggccaacatagtgaaactctactactaaaaatacaaaactactaaaaatacaaaaaattagctgggcgtggtggtgggcgcctgtaatcccagctactcgggaggctgaggcaggagaatggcttgaacccaggaggcggaggttgcagtgagtcgagatcacaccactgcactccagcctgggcgacagagcgagactcagcctcaaaaaaataaaaaaaataaaaaaattctgagctttgttttttgcattatgataaatagctggctttttaacaaaaaaacacaactgtgttacttgggcgtagctataccaccatttgatagtctcttttcagatttgtgagggtttaatagcagaaatctaagatattgggacccttttagctggtcttattatacccacgataattgtgtattgctattgaaagtgctccttgctggtagagaggaaggactgaattttactgaggatatattaacttgatttggaggtcagttctttgcaaaagtttgggaagaggccgaaccattctgtttggctctttgttataagaaactcagaaataatgatctatactttctttgttgatgctggaaaaagaaaaatgacttaagaattcacggagtaattaaccttatggccccctataattctcattgtatttggaggagaaccttaggtgaccagtctcgaaagaaagatttctgagagtggatgttcatacgtgtctctctgcttcttatttaatagagaaatgtttaagctcttttggtagggggagacttacttcagttacttgtcgttctttcaactgcaaaaagtttggggtattgaagtgcccttggaccatgtgcttacgaagtgttggttcaaggaatggaatattgttatcactaagcagatcttttatctgcaaagtccagagaagtgcacttattgatttactcattttcatggctccctctacctctgttcagccgccatgatgcagataggcatgcaagattgtttaggattagaatatatagtagcatttacttctgatgttggccttatgcaaagaagagttacagaggctgtgcagatctgttgtagatataagccaaaataatctgctcttctgtgtgagcaggatatgttgggagcctaaggaaagaagtccttgtgctgacattgaatggtgtagtccagcaaattaatgaggggccagagtgtatctgcattattcttacccaagaagaaaggaagcactttgggaaggcctgcttattttctttcttttcatcttgcaaatatagtacacgggacccttagaggtctgcgctgtataacaaggtcttgctggcacccccctagtagtgtacaatctgattcttagagggtgtttctgtgggtgcatcagcatcccaccaggaagctgctgttttgctgctactgacttggcacacgatcttcacgtaggaggcatccacatcacatgttccattttaattctactcaaagttaaacagcattgcagtccatgttgctagcagggccatactgcagtaaaagtgtgggaaagtaaagtccttgaatgtattttagctttattatttttgttgcgttggttcactgtgtccctatttttttttctttccttccaagtggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtaagtcgttaccatcccaaaccagaatctccttaaacatacaggagtgtgagcttagcaaaaagtactaaaaactggacacggtagtgcacacctgtaatcccagctacttgggaggctgaactgggaggaatgctggagcccaggattccaaatccagcctgggcaacagatcattccattctctctctaaaataaataaataaataaataaaagcactgaaagcacagatttgaaaacattatctttgagatcaaccaaaattcttgtataatcttttcctacctcatttttactttgttatggatttcatgttagctattttcagactattttagcagcctaaatgattatatcttgccaaccatgtaaataattgttgagaggtaggagggacatgtctgtatcttagttatgcataagagtgaaagccccattgagacaaagggctattaaagcagtgtttgttcttttttgtgtgtgaacaatggttcattatttaaatttaaacatagagctcaagttagtggtagcatttaaaggttcattaataacaagtctaataaaaaaagttacaaatagagcttcaattaagctgcgttcattaatttagtacttattacttcggtctgtaaagatttcattaaatgtggtctctggctgtttcttgacagttgtttttgtgcccataaattatactctaggattacttagcatatcattttttacaaatcattgccatacaataaaagtgacaagttgttcagaagttgcactgaaactctcccataaaagttcatctaagatgatttataatattcaggcacttaatgttaaatataaagattgcttgattgttccataaattaaacccctaaacatatcaaggtgatggtttaaaattgaaaacatacagcacagccatttgacttttcaaaaagtagttatcctgcattatggatcccctctttttaaaaacttttttttaaattgcaaaatgtgaacaacagttttcattttcatagaattagttgatttacaatcctgaaattgacctccataactcagggaggtatagataagtcagacctggaaagtcgaggaaccatggcccagcctgaaggctacacagctcaacagatgtgttctgtagatgtctgattaagtgcatagaagaaggagagttaactctagacttatattaacacaaagcctggcctatgagcagtattttctttcaatgtgattagatttctgtctctcagtgcttcagaactgtgggattttcatagtttttcattagagtttttctagtttacacagggccccctcatcatgtttcttcattatactctgtgttcaagaatcatataggaagaaattgctctaactgccactttatttcaatttctgtgttagccaagggcctttttgttccatatgtgcagactgacagctcataaactggcacctccacagtgcacagaaataaggctgctgcccatcagttaacatggaaggaatctgtactactgtcttcttcaaattacagggttagagatgggagaaaccttcccctgagacttgtagcccactctctcttccaggggctctcctgacgtcttactgaaagctctaacggcttgttagttttcattcattggccaacatttatctgtttaagtgctctgttctggtcttggagtaaaaaatatacttctaatatcttagaattccattaattataagtgatctttttctgtaacctgcaactccagaagaaagaaaggcctatggtagagctttctatctggggccagaggagcagagtgtgggagaaatgtgtattgtttctaagggaccttgaagaacaccaccacacaactctcttttttctaggagtcctatcaagcattacatgatgctttctctagatcattatctacagcctgtacccataacctataatgaaagccagctttatgataaagaagttgaccctgcatattcttggaaataaaattctatatgcaggtgcaggggctgaaggtttttttttccccctaaaaattaggctgatattctcccagtgtttaagaatgactgttaagaaaataacagacattcatacttttttaggtatgtggaatcattggtttattggaatcagcccaccttggctggtgagagccaattgatcaatttttagaaactttgcaagctggttgtcaaacacagccattattaaaaattaaatacattatctaaaaagcaaaggtaattaatacttgaaatgcatcacttcctaattatttttgctatactttactatgatctctgcttttgaaattatttacatttatggcatggacatagggctaatactatataatgacgactgtgcagcttttcccggccccgtgtttagtgacatcatgctggtagctgaaaatttgccatggtggcagtgtttacaccaggaagtctatggaattccacaaaacagagttcttctcccagcagagcaacatagcaccccacggtgaacataaatacctttgaccagagtggcagcatcttgtctagtgcccctgggcatggctgggttctatcagattgcaaaccactgcgccagccctttcccaatgggttgccacatattgccccttgaatatgagttcagaataatatattaaacacgaaataagcttttttgttattgaatgttggctcttgatccttccttcacacgatgaggatagtcattagtctttgagaagactgttaaagcattgttagatttttcaaaacattcttttaaactaccttccttccataccttctggatctgattgtttgagatgaatataccctcaggttgattcttttacgtttccttcttttttttttttctcctaacaacataggggactacagtaagatttaaaaattggtctcttcctttctctttgttcttttaagaaaactaggatgtggtttccttagcagtgctgcttttaaacagcttaatcagaacatgcatgtgcacatatatttcttagtacggtttgcaagagggttcaagtatggaggaccgtgcaggcctgaagtataaagtaggggtgtgtctgtgtgtgtgatccttttctttctatcttgtagctcagaaaacaaaaggctaagggacattcagtagtgggagtctagttttgtaggtaaatatagcagcacatgagcttgttctctttagtctgcctgaggaagtaatatgttttcctttaaaaacaggctcacaggctctcctccctctaccatcctgtcctacccccatcatcctgttgcctccctgcaactcccactcatacactattcctaccccaacaggttgtctgtgatatttggttaaatatgatgagggtcaaatagataggccttgttttaaaaactctaccagaggaaatgatggtaccttgagtagatatttttagtcattggcatatacagacagcatggttttctgtttgacacattgaatggtagtcacaaagatgatttaattattaataaacagctctaggaaagaatgtgagtcatatgaatcactcttctgtttataaattatggagtatatgaactacaaaagccgccttaatgcaagtcttaaatcagaaatttaaatctataaggaatcaaataacaaatgcaaagtttttcctgtttgtattaatttctcctcatacatactacatcttttgcacacaaggagcttctatcaccttaattaaaatggctttgtatctaagaaacctgagtgtgcttacaaaacaggtaaacatgacttgtaaatgtaatcattctgtgtgcagattgcagagcaaagcggggagcacaaagtttgagtctgtgtatgtttgattctcagacactcggctattcaaatttaatactggaggatatttctgagaattcttcaattgtatgaaattgtcacgaaagaggaaattgagtatgtactttaggaggagggagatatgttttttaatgttttaaatgtgttcgtttttaaaggaaagcagccttcttaagcaacatggttttgccttagtttttaatctccaaattgaaataaccagcaagataataaaatactgtattgtcagatattaagaagttaaaatcatgtgctcgctttttgtgagccctagagtaagtgtaatttgatattgctttgctgcaaaattggaactgttatcgtttgaatatcatagaattgtatgtactctaaaactgaaggttcttagacgtgaccttattgtacatgtctcagatttatttctagctgttgtccatatgtgatagctgagaacctatcactgcagaaagctaaagcaaaagaaatgttgcaatattaccattaaaattgaatcctccaattacatttaaaatgattacctgggtccccgaagcattgttttattcagttttgaagaggaaatagataatttagtttgtaaccttgtttggctgaaatcagatttattgctctcttttcctttttagaatatgatcattttcagaacacaatgaacataatcaggttttaaaaactgaatgtcgtagtttggattatacatcttaggcatttgagaaaagaacaaacacagattcttgttgctttcctcacctgtactaactgtgtgtctgtaccgtgtctctcatttagccttgccaaactgaagcccgagaagagatgaacaacaaagcgattcaaaacatgtcttgaacagcacatattgcacagttgttgttttttttaaacaaacaataaatttacttttaatgaattcttagtggctgttgacgaattttgtttacgacatcagcagtttgatggtttagtaatttccttattaatccatttggaacttttggatcttgatttcaagcttggggtttaaattacgcttgaaaaggcagagacgtgtttttttctctttcctttctttattggccccttttcatagtggaaaaccatagtcctctcactgctggcgtattcagaaatcatcagcacacacccattggatattagaatcagagttttcaagattctgtaaagggccaccacccatttggttgtgttgtgtaaccaccagtgactttgggacacaggcagatgttacaggtgattcagggcagaggcaaagaggtgtgtgggctggtacagtcacccatcagggatgagatgcaacggatagattcatgaccagatggaccagtttgaaagggcctttttggcaaaggtttcagtccctttgtggattacagagtttagaccaaaaatgggtggttggcaggggggtggtggtgtaggaaaataaatttctgtgcttagatggctgaaccagcaggttcttcccgtgtgaaaaaagcagagctactttggcatatagtaatcccaaggtttgctgagaccacgtgtcgagagagcacacactctttcataaatgtttctggaaagagtctgcccggccaagtgttcgaatcacagatccaatgctagtgcaggtggatctccaatggtccttactgtggtttgaagccttctctcttgtaagaagccttaattcacagtttcattattcatggcttcccaggatttgagacagagactgtatatttaattaactctttttcctgaaaatgttagcattgcattcttactgaaaataaacatgggttgggttcattggctcacacctgtaattccaggcacaggagttcgagacgagcctgggccacacagtaaggccctgtctctattaaaaaaaataaataaaaaaaaataaataactgaagtcttgaaaaccatctgataaagggtattgtggattgggttgagtgcctgtgagaaggcttgacctctgctctgacttgaaagcagtttgcagttctaccctcgcccccgcccaagtgaaagccctcagttctagtaaggagacacacagaagagtgtttatttgtcatgctagttttttatgacttggacctaattgccatggggattaatgtgaccagtttcacattggtacatcaagtggcatcctgtgcaatctgctgatgatttaaggaatacagttaaagtaagcacatagaaaacaatgcttctccaaatgaaacacagtgagattttacataattttatttgctttcttgtttgtcacctggacaaagaacagctctgttttgtgattatacaccctgggaggtttccttggagtgagttctgaatttgtaaatcctaaggacttaatgtatgcttctattaatttgaattgaaacagaggttcccatttttaacacaggaaaataaatgtccaactgacctgctagcaaagacaagttctaaggtagctgatatcatattcttcaagtattcttcttttcctggttagcagttttaaatagagaacctctgacatccacagcgcccaggctgaatgcagaggaagctgaggaggcacaaagcatgacggctgggcctctctcagaccttttctgacattctttaatgtttcttttccatagacctgtggcatgaatatagaatgcaggtgtcaaggatgacacctacttgatagtctctctaaagcaaaccttttcgcaaaagaaattcttgacagttctgagatgctaagtcaatttcaattccaggctgtgtggaaaatggaatcttttttctgcaattgatgtgaaaattgaaggctactgactattcactttctaataacacagggtaaataaatactatcgcaccattgaaaaatgcacttagaagacaagctcagctaatgatattcaccacaacatatgttggaaatattccttgtgaatgcttttacttgttaccattaaggttccatattgtttacattaaatataatagatcaagtacatgttactcctaaatgtacttgtatcaagccacaaattagtatataaaggtaattgttttgtcctgacaatcttttaaagaattcactgggggatctctttcctaattgagcgttgaatggttttcttctgacctatgtttaataatagccaatttagaagcaaaagactaaaatcagattaaattttggatcatagtgaaataaccaggtctcctattaacctctctgcttgcagttttttttttttttttttggatggttgatccttttccccacttgcatctcatgctttaagccaagagccaaaccattctggtcctctcttgcctcctgcaagcaattcataattctttctgcatcatccatgactactcttttcttcttgggggggcgggggggtgggggagatggttgaacctctgcccccacctccatcccatgctgtaagccaaggccaagctcccaaaaaaccattctggtcctctcttccctcttgcaggacattgccccaacaatgtttaattatttcttctctcttctaaatccatctgatccatctgtgtctgcctttttttttttttttttttttttttttttttttggagacagggtcttgctcagcaggagtacagtggtgcaatcatgcctcactgcaccttgaactgctgggctcaagtgatgctcccacctcagccttcccagtagctgggactacaggcgtgcaccactgtgcctactactttttaaattttatatagaggtgggatctcactttgttgaccaggttggtctcaaacttctggcctcaagcaatcctctggcctctgcctcccagcatgctgagatgaggcatgagccactgcccctggcattgctcttctctctacaggatcattcacattgttttgcaccatgctgttacctcctccatcttagagaaaattctctcttagccctacttactctccaactacgatctcatgtcctcttgcccaccacagcagaccctttgatatatttgctgtctcttttttccgattctctcttgaacttgcttcaatgaatccttcaccccttccactcagcaaatcctgttctcgtccaggtcaccagttcctcttccttgggaagtcggggtccattttcatccctcatcgtggtccactggcagtacccagcatgttaatcatggctctcctttgagaccaactttgccagctttccctcctcctccctggcctaccctgtcttgtctcctttgctaattctgtgccatactctgtcctccaggtcttgtgccccaggtgctcagtccgaagtccttttgttttctctttttggtaacacagaattttgatattctcaggaaacagcctttgtgatccaaatacagcctataggcagatgactctcaaattcacctctcctgcctggacattttcttggaactcttcatttgtagtttaaccatcttcttgacacattcacttggagatcaaccagacacttgaaacttcacacgctcccaactcactgctggattccccctccccgcaaactgctcccgcgagccttccctttctcagataatggcagttctgtcttctcagttggttagatccaaagctttggagtgatccttgacacctgattttcccttatgccccacaagcagtttaagaatgtataaaagcaaaagtccattagctctgtttttggtacacatctgcaatcctacttttcagcccccagtgccgctgttactgtgccccagtggtccaagctctgtgtgccctcttcctggcttaggcagtagccctctcactgtgctccctgcctcaacccctgcttcctgcagtttattctcaccaccacatccagaagtcacttttccctcctctgttcaacccccagtagccttcggcaccactcagagcaaaaaccaaatccttagggccctacagaacttggtcccccaccccagcctctttgaccttgtccctaccgctctttccttcagtaactttactcttccctgaacctaccgggtccactagagccttttcccttgatcctgcctctacctggaatagccttttctcaggtattcctaggttcactcttgtacctttaacatctttattcaagagtcagctttttagagggtctagccaaaattgcaaactctgctccctctcaccctgacacttttctaacccactttttggcatcatttttcacatttgcactcctacctgagctatgatagatcccactcatttgatgtaaatatacattgacattgacagagaatgttaacccatttttcccctgctgtatccctggcagactgcatgatgcgtccatcatcagtgcccagtaagtgtaacagatgcccattgccaaaccccttcagtggccattctctgcctctgtgtctgaggcctctctgaagtcttggaaggcagctctgtgtttccatctgtgcctgctggatgtgcccaggaataacaccttggagcagccttcaacgccagtgtaaatgtaccccagtctccatggcccttgggtttatagcactaagtcataaggtctgcactcttcaccctcagaccaggagcttgttggaaatgtggaatcccaggccctgcccacatctgctgacattagaatgtgcagcttaacaaccctggggattcctgtgtgcatttcaggtcgagaggcagcagcccctaccctgctcccagagtttgcctgtggggttgtgttccccatacccacagtttcacaggctcggtaacatccctttgtgacagcctttcctccccactgtggcatctccacttctctcccaagtgtttcttcccttaaaccactgtcctgaatccttgtcccagggtctgcttgtgattaaatccagactaaaacagtgttgagtgaatgaataaataaaacttttgagccgggtgcggtggctcacgcctgtaatcccagcactttgggaggccgaggtgggcggatcacgagttcaggagatcgagaccatcctggctaacatggtgaaaccccgtctctactaaagatacaaaaaaaaaattagccgggcgtggtggcgggtgcctgtagtcccagctacttgggaggctgaggcaggagaatggtgtgaacccaggaggcggagcttgcagtgagccaagatggcgtcactgcactccagtgtgggggacagaacgagactccgtctcaaaaaaaaaaaatacttttggaatcagcggtgaatagtgtatgctggaaacttctgttgggggtaattttgcaatttatgacaagtcttcataccaggacaatgctggcgttcccatctttggaaggcaatgtcactgccgtctctgcctttgtatacgtacatacctgtgactgcacacacagtccccaaagagcagcctttcatgctccatggatctacgtcatggtatttgaattattgttattattattttgagatggagttttgctcttgttgcccaggctggagtgcgacggcacgatttcagctcactgcaacctccgcctcccaggttcaagcgattctcctgcctcagcctcccgagtagctgggattacaggcatgcaccaccacacctggctaattttgtaattttagtagagatggggtttcaccatgttggtcaggctggtctcaaactcctgaccttgtgatccccctgccttggcctcccaaagtgctaggattacaggcgtgagctgccacgcctggcccggtttattattgaagttcttttattctgctaaaaatagccatagatgatttttgtaaattaaaaaacattaattttgattttttttttttgagacattcttgctctgtcgcccaggctggagtgcactggcgcgatctcagcccactgcaacctctgcctcctgggttcagtcagttttccctcagcctcccaagtagctgcgattacaggcatgagccaccacacccacctaatttcgtagagatggggtttcactatgtatgccatgctggtctccaactctggacctcaaatgatccgcccacctgtgcctctcaaagtgctgggattacaggcgtgagctaccgtgcccagcttaattttgaatttttttaataaaaaaatttttttagagacaggatcttgctctgtcacccaggctggatggagtgcagtaacatgatccttgcaaccttgaactcctgggtgattctcctgcctcagtctcctgagtagctgggactataggtgcatgtcaccatgcccagctatttttttaaattttttactttttgtaaagacacggtctcactttattgcccagggtattttcaaactcttggcctcaagtgatcctcctgcctggcctcccagtctactaggattgcaggcgtgcaccactgtgcccagccatgatttaagtattctctacataagactgtcagaaaagataattatgattaccagattaaacattccatgttgggaaattccctgttttcaggctgaggattgtatagttgagtggtgatagatttaagcaaagagttcgtgttaaaattgccctttcatgtctgcctacgcctgaaaacgtcagagtctaggagttgtgtaagattctgtttctaaagaagtcaaaactggttttactccttacaagctttgtgggcagctgctgcagagcaaatgagcaggtggaaggcctcccttctgaaggccccagccatgggccacttacagacaacctctgcctcgcccactggaggcgctctggggtttccctttcactaccgctgctaggtatccacacatttctcaagaggcaccagggcccagcccatacctggggcctggaatctgaggtatgccttgacaggctgatgacaacctcaccttcttagtttcttctcccatgacatttataatatttatattgtgccttccatttcttttataatgacaatattatctaacaatgttagtctttttttaaaaaaaggaaatgaagaactttacagtctctgctcatacaaaggaacagatactttgaaatgaactgaacagatactttaaagtgatggaaaccaactacaaaatttttctaacttgctatattaaggtttctcaatttccactctcctggctaatttagaggatgatctattatcagtttttattccatttctgattttgtcaggtggtatgttggtcattctgactttttaaggcaaacaataagctatttctcatgtagccaatactgtggctagcagtcagcattcattcattgcatgttgatactggtggacactgcagagaacattgttttcaataacccctttacacctcataataaccctataaggtactaattttagccctgttttatgaatgaagaaactaaaacataaaggtgtggagaagaacttaccaaggtcacaaggtaattggtggtagagtcacaccgaatttgaacaatggtcaacctcaaaggccgtgttcctaacactctcctgcaccatctgagccgtcttacccttccgggtaggttttgccacccctaaaacctatgtgggagccaagattgctatgcgacatggcattgctattgtgagtgctatggaaaaaagcactcacatgttactagcttggaaatgcagaagttagtattttttgaacctgactttcacgttttattcctacttgatttctatagctttctctgtctatggtctcttctcttcccaaaataattcttttttttttttttaattttgtagagatggggactcactttgttgccctggctggtctcaaactcctggcttcgagtgattctcccacctcggcctcccaaagtgctgggattacaggcatggaacacaatgcctggcaccaaaataattcttaaggatttttactgctaatgaaaaacttaccagctgtctcattcctctccctcttcacagactctcagacctgtctgtgtaggtgcgatggcagccatccctgctccagaacacaaacgaggacgattttaaaacaatgccctctttcctccggctctcttccttctaggtggctctgtgctgcgcattccctgcctcttcctgttcccaccctcattttcccctttccttactgcatgccaccttgtacctctatcttgctccaccattgctgcctctgatttttccctatcaaaacaattatgaggtcttttccgcagactgtgttagcagtttttgcatcctctgctcattcctctgtctccttgtcttcctctccacctcagcccatgccctgtcagtgccgcccagctcacaattgcctgatccttggtgggtacactggctcacctctcagggctttgctccttgggaggctattcaagctcagcatcacctgtctcacatctgtctgggatcctcaaacctgacctttgtaaatttccactaactgaagattgtagaggaaaaaaaaaaacatcttatcgaattcctgctcttatagctgattttagctattaggaaaacatcccaagttgagcttttctattcctagaatttcagatttctttcctttttaaaaattttatctccttttatagtagtaaaaatattttccttttttttttggaatggaggtcttaagctcagtgtcaaaaataaaatcattttcttaattgagaaagtgatgacatctgtttaatttatctcaggatatcttgattctggaacaattttgagaaagtaaagtttagatcaactgcaagtaggtactctaacaggatggaaattttccttcgatgttctttctaggccgtagcaatagccagttgcctgatgttactttgagcacagtggcaaagcattgataatcacttaggcagaacacattcacataaagttttacctgccttgcacaaaaaaaaaaaaaaaaaaaattcacctgggcagtaaaataaattctgagggttttatttttcacctggcaaaaatggtttctaatgatgggcaggtggattttttttttttttaaaacttggttttggagcaggtgtgatgattttagtaattgagaggtaaaaccatttgtttcatacattcaacaaatatttactggagtgcctactacatccttggcagtgttagaggtgttggggatttagtggtggatacaggagacgtggcagtcactgagtaagtaggtcctgctccagggcctcgtgaaagggagatggggacattgtgggaacttgccacaaatgggcctagcgcagactagaagccatctgccttcttctgaaaaatgacattaaaacaggtctgaaagaggttttgacttctttctctgaactcaaaggggaaaaaggagtgttttgcagcagtgggatttaaccttttttgatatcatctgtaagaagaaatacatcctaccttgcaacctcgtgtacaggtatgggcacagatagctaaagtaaacatttcacagaacaagtgatacctgcccttctcagtgtgatggagtgtgatgtatttattgagcagcagcatagggtagtggctaagaacctaaactctaaatttagatgtcctgagttcaaatcccagctgtatgctcaccagccttgtgtgtggggccagttaattaacctctttgtgttttacttttttcagttgtgaagtgtggataataatggtacctgcctcacagggttgttttgaagctaatgggaattaatagatacaaagcattttagaactcctcctggtacaaagtaagtactttgtgggtattagctgctgctgttgatactaatattctgcaattcattttttttaaatggtaagtaagtgccactaaatcaatttcaggtcttcagtgagttccaaaacaaaatttgaaaaacaccatttagatggtggaaatcctctcggtttgcgagggtgggatgaggaacctggaggcattggagaggcaggtggcctctcataaatgactcgatatggcttgactctgctcctaaagatagtgggtagccattcaagagaatagcttgataaagtttacagtgtttagaaaattaaaagattcctctaaccacagtgtgtagagtgaactgaagggctagaccagagtgatgtcaggaactgtgaggcagcttttgtaaaaattgtggccagtgatggaggtagccgtagggacagagacatatagatgtatttctcaggtagactctaggggacttgcttatttgatttgatgttaaaaaaaaaaaaaaaaaaaagaaaggagaaagaacaataagaaagaattgccacagttttagcctggtcagctgggtggatagtcacacaccggctagtaaatactggaagaggatcctatttggaggacatgtgacatgttgcatctcataagcctgtgatatgtctacctggagggaactggagggtggaagagggggaagggctggcactgtagagatttggaaatcaaagacatgtcaggtggtgcttgcaaccatggcagtgtgagtgaacagatggtctgggaagtgcgtatagagggaaggagtaatagaaggtggccagagagagttctaaggcccctttgaatatcactggcgctcagggcaggaatggggcagaggaaggagctgttggtaactgagaagaggccactgcagagagaggaggaaaaccaaaagagtgcagtcactaaagccattaaagcaaggatgtgtttttaattaattagaatgatgtggtcaacattgttcctgctgagaggtcagaaagtcctcctggtcttggctacatggagtgattagtcagtaggtgtcaactggacctattttgaagggttacccagcactctgtgatatacttgaatatttctatatgatgcaggtgtggctagcatctctgatgctaatgcttgttcaagttgagaacatcgcatatccctgttttaagaagcagagcttttttcgtggcactgtgatacaaacacaagcgcaaaacctgtgccagatttccatagtttttgagcaatagaaatgaccttttaggtgacattaagtgaatcctaattgcagattctcacaaaggattgtagctattaggatataaggaattaatttgtaagtacttaacaaaagttgcaggaaaaataaatttggtgattgattttgctgcctgtaggatcacttcttaccctccatggtgagagactgtcattcactgtctctgcctttctcttgtatgttgggagttgtcctgctgaacacgaccttcctagagctatctgtgggttaaggatcttcgtggcattagctactctaaattagctgcctagttccagtcttctctcatgcttacagaacaagaaaagtacttatagtcagtaaattgttttgtcaaagtccaagctttaaaattgcccccagccctgccatttttttttttttttaaacaagatcttgctctgtcacccaggtcggacaggctagagtgcagtagagcaagcatggctcactgcagcctcctgcctcagcctcccatgtagctgggaccacaggcatgcacattcattcattcattcatttatttgtagagatggtttctcactttgttatccagggtggtcttgaactcctgaccttaagtgatcctcccatctctgcctcccagagtgttgggattacaggtgtcagctaccatgcctggccaaaattacctttttaggaagcttttcttttccaatattgtgacatttaaccattataacacataatcaggagcccccactatgtactcacatacatttccagactgtgttttcccagggtttgttttttccaagattcgtgaatgcttctattcccatgacttccaaaaaaattgtaatatactatgatttgtggatatctttgtttttcagggcaacagtgtccatctttcatgtctatccaaagagacataaagtccttggtatgttcaaactattaatgtgaactttttatttgtacatgcatttttaatttcgtgagtcactctgtgtatgatgtactctccggttattgcattcggaaacattttaactggaattatttctgaaagtgtatttcccaggaaagtgtagacttatatgtttttcctactgtgacacaattttgattttcttttatattttcagtaataaagtattatgaactaattattatttttaaaaaggtagaccatgtaaccagttagctattgtttggtaattttggtaatagttagataccattacagtctttaaatgggttaccactaagattttatctttcttaattttaatgaacaaacagaaaaatttatatagcatttttcctgtggaactcctttttcagaaggtcccacattcaaattagttttatccatgcaggtcttattatcttttattctcaaagttctatgctttactctttggctacactcctgtctatctgacagaatttctttaagcattatttatcttgtaagacagacattctctgagtcataaaagcaacatttttatccagtttccatttagtctggtcagcaaagggaaaagacctctccctttagaagtgtcttccaccgttgtctatacatacagctggtggacagccgtctgattagagagaaagctcttattaacagccaacataatagaaagtgcatgaagccatcaccaactggagagtacccaaatagcatcagaaacaatgaagagaaaatgaaaatcagttctgactcatggattgttgttttccttttgtcttcagtactgacagtctttgtcagctggaatagcagccttggcctgaatatctattggtgtttatttgcagttgtctcaattagttctgctcttagccttttgggaggcactgggctcctcctcgcactctgttggccactgtgggttggctttgagggtgccatcctgacaaaatcagttgttggggactataagactgaacaagttaggtattgatctgaagatgggagcatttccaaagatgttacaaaggatgtattattttctctcactgggaagccaaatagatgaaagcagacactccttgcttgcttatctccatgccttgatctgtaagaaattgtcttggttgtagcacagactcaaatacttgtggcttaaacaagccagagttttattttctctcattaagtctggggattggaagtccaaagatcatatggtcgcctcagagtgttgtcagcatcaccacctcctttttattcaaccatccttaatctgtattttattgttgttatcattttaaatcgtggtgaaatatacctaatatttaccactgtagccatttttaagccgtttagttcagcagcagtaagtgtgctcacgttgttgtgcacttcaccgccaccattagtttctagaacgcctttcgtcttgcgaaactctgtacccatcagccgctatctccccagttccctcttcccccgtccctggaaaccaccactttactttctgtctctatgagtttgactacttgagctacctcatataagccgaatcggtatttatcttcttgccattgattgatttcacttagtataatgtcctcaaggctcatccgtgttgtagtgtgtgtcaggatttccttccttttgaagctgagtagtattttattgtatgtatatacgtcattttgtttatccattcccacgtcgatgcacgctagcggttgtaataaggctgctgtgaacgcgagtgtcttaacatgtgtttctatcctcagtgtcacaactctcagagttacaactctagctaagtcagcttctttctctggatcttttccagaagtgccactcatcagtttctgtgaaccagaaattaaggataacaatgataataaaatagctcatatttatttagtgtttttatgtgccaacacacagggctgaataattcatttcatcttcacaataaatctgtgaggatggttacattttaccaaagaggaaattgaggtttaaagaggttaaatgagttgcccttcacagccagttaacagcataatgctaggaagaggcagagctggactttgaacccaggattctggctccagaggccatgctcttaactactgtcttttatcttcagctcctgttttcaagggaagctggggaatgtagtttaaatcccgaataggtacatttcctctcccagccacatcagggttttactagtaaggagaaagaagagaatggatgttgggtgagcagcttgcagcacctgcctctctagctcactgctctgaagccaggtggcctcgggcctctgaaagtgcagctgctttgtaactctgggctgctgtccacccttactttattgtgctggccaagactaaccatcactggccagatcattttcatttaaccaaaaagacccacaacagaccacaaatgatggaaaatgctaccactgaaatggtcgtgggcttccaaactgaggtagactagagtagctacctggaaatggaggaggagatgaatgtttagatattcttgttaggaaatagtgtctgttacatattcagtgatgatttctgccagcagtgtgctacgtgttttaaaaaatgattgcattttatctttgctattactattttttatacagtagttttattataatttaatagtgccagttatcacacatcaaataccccaagtctttttgattttagagttaagctcttatttatttacttacttatttttttagagacagggtcttgctttgtcactgagactgaagtgcagtggtgtgatcataactcatcacagcctcaaactcttgggctcaagcaatcttcccacctaagcctcccgagtagctaggacgacaggcgtgcgccaccgtacccggctaatttttgcatattttctagagacgtggtctcactgtgttgtcaggctggtcttgaacttctgggctcaagcagtcctaagtgctggaattccagttgtgagccacaacacccaggctgagtgaggctgtttatcatggtgttttaatgttggttgtagtgacctaggtgtctttttagtcttgtgggtcttgtttgttggtcagttggttggttggtttttaagagatggttttgctctttgcccaggctgttctcaaactcatttgacctcagcctcccaagaatctgggattataggaacatgccatggtgcctaactctcttgtgattactttgaaattatcccccaaagtattcttgttctagcatgttagatcttgtcttctgggacttagatggaatgctttgatacttttatatctgatactttcaagcccatccaccatcagcatgtactgattgttactctgtattgagaaataatcacatcatgcattttggtagacgtttaagagtccaaattacatttcccacatccacgtattttatagtctagttaaagattcttacatagtgatctttataaagttcattttaatataattttagtataataaataatgagttggtcaggtatgagctcatgcttttaatccaagcactttgggaggccgagacagggattgcttgagctcaggagtttgagaccagcctgggcaacatagcaagaccttgtctctacaaaaaacttaaaaattaactgggtgtggtggtacgtgcctatagtcccagctactcaggaggctgaggcggcagaattcttgaacccaggagtttgatgctgcagtgagctatgattgcaccactgcactccagcctgggcaacagagcaagaccctgtctctagtccaacatgttctttgtgcaaaggctaatagttgggccatcaataacttattttaaaatataatatagtttacttcatgaactcttaatgtgtaaatctaaatgaagaacctagtcattgaaagcagtggaggtaaatcagagagagataagtatactgtagtagagagaatttgggatttagactttctagccttccctgcccaacccagctagctcagccccatcctgccccactgcctctggcatttaaacatatcagcctcagttttccttctttccgcgttcttcacatttaattttaagaactaaatgaaagaatgggtatggaaggcttttgaaattttaaggcagggtacatctgtctgctcatgttgttcactaagttcctcttcacagggttttctacccttaacttaattatgcctgaattatttcctcaatagagtctctgaactcctttgctaaaaaaagatatataggttatttctacccactgagatttgtgtatatactgtccccagtgaagtgagttttgctaatacgtcatgagtatacacactagtttagacaagatagtttccacctgcagccagggaaaagcaacataatgatatcctgcaaaagcagctctgactggaggagactcagaaaatgagactgaaggcaatgatgaagcattgccttcagttccaggattccgtcttggataaacaggatctgcttcccccagaactttacccttgcttgtgatggccagtgagcctgtctagggactgagaccacacagcaggcagtgcagacgtgacagttctgagaagatggaaatgggatgagaggaattccaggccagtgcacaaatcaacaagttgtatatttggacgcttgttgaactatttggtcaaataaggaagaatgtggaggtttgacatttgccgaatttcttgtcccttttacatgagcagcattcagactggagatgagacaacacatctccgtgttctgaccccttgctgcttcacccaccccaggatttcagatggtttcttaaccacagttgagtcgtaaataatatttagtgctgtacatcctggtagagagaaaccacagcacaaagagtgaaggatcttttctggaagagagccattgacattttttttggtggctcgccatcattttctgtatgtgttttttaatttttgagtttttgtggaggtggggtgtcactatgttgcccatgctggtcttgaactcctgtcctaagggatcctcccacccctgtctcccaaagtgctagtattgcaggcgtgatctaccatgcccagctttctctgtgtgttaaactctccaggatacaggcatgctgcacagatggtgactttaagcaaatatgtgacctctagtccctttttcttcaaaagggcattgtgacacaggtagatggcgggtgtttgcctcttgacttgaacctgctccctctgtgggaatcttttctttcctgttctaagaattaggtttagtttccaattcttagcagtttttccacagagccctttattgggccttaaaaacatgtcagctccctaatgtagaatctgaatatgcgaattaacttaaagataaataaaaagaaaatctgcacctcttaatttactctgtagagagcattcgctaagaaatgtgaatcaaaaggaattgtttcctataatcaacagaaaaaagtgctgacggtcaccttaactttacagataatgagatctttagggaagctttaatctttcaaagtttccagaagctatgcaaagagcctggggcttccccaccaccaatcccaaaactttaatgatcacattatttgtctgtctttgtgactttcgtctgctctatgaacatacaagggtaagaaaatatttgaaggtgtttccgttgctgtaacgtatgtatgtgtatcacttcctgtcagtagttgaaacatagaatttgaatcacaatgcatatttaattgagggtggatgtttataactcaaacaaagatatccttaccttgtgcgtgtgtttgtactacctcataagcatttacaacctggatagccatttgattaagtaggcagatggcaacccgaattattatctttgttactgaatacctcctgttgtttgtcctagagaaaggtgtgtagtgaaatatcattccaccttttcctttttcttccttcaagtgcccttttaaatggatgtgtttttgtgacttaggtctcattagcatttcttatggggactgccttcagggcagtaccacttactaaattgttcccttgctttaggaaaaggaaaaccatggtaaccagatgtagggtatgattatttgcctctgacctggcaaagtgttgggtttaacaaaagaagcttaatagaaatgttcaaattgacccttctcatcacttgagctgcttaaagctcaatcaatctctcattattatcagagttatttgagcaaaggcagcagtgatagtatttttcataatcactccttgagccaaatgtaatttgcaatttgtagtattgtattatgaaacaataatgcattaaaatgaacagcacaagaattaggaatatagtcataaagaaaggatccacagaagtagttgtgtgaaagacactctccaaatcattttaagtggacatgaccgatttcaatgccaaattaagcatttagaaaaatcagaattctgtgcttttactatatttaaagtatatatatagtatgtttgtatatattttataataacgtcaatttagttgggagaaacagaaatataatgtgattattatttgcatttgggtatttggggttatggggttagtgtggtttgattacctgggtaggtataatttgaaaaaaataaagtgcatcaagccaaggtatatcttttgcaaagagggaatattttgccgcagaaattatgtcttcttgtctatcagctagttgatgtccaaaaagcttcagcatcataattaagatatgctttcactcatcttctttcattttactagaatggctgtaagtatagattatatgtattatttcagtgatttgtgtatttatcttgtgttttgaaggattactgtgtttgcttttatttctcttaaatctttatatttgagtcccacagttttttgtttatttgtttgatttttagatctgtggagtttgtggtgattcttgtaaagtcaaaattgattttgtgctcggttccctttgtcccccctatttccaattcctcatctattgctttaatatttccttgttccatatggttctaggacttctgaagtgtcaggttacgaggcatatcagtgcatccttgattagctaacacaggctatgctggagtaggagtgcacttataaggacatttaatgggagtcctgaaagggatatgttattcattaaggttgcattgcacatttaaagattgttctagcttggttaagtagaaggtgctttttctttaaaaaaaaaaataataataataaagttacctctttttcccaagatgccaagcaatacaaatttattttatttaaatctaatcagattggcactgatgaaaagtacacaatcaaataattattctcaagtttgtgaatttccttttaaagagaacctctgccaaactccaccaacttaaaacagcatcctgtcttacaaaagcgctatcaagttgtcacgtaccctttctaaggctcctctctcatcattgttgattaccaagatgcttttttgcctaaataggagctttctgcttttcataatcaacctcctcttcgctgattcatccagcattgccacaatctactgctgagcaaatcagtactctttcatggtagcgatttcttaaaatgacactaaaatatgtaagatcctgtacaggaaggacatattagaagtgacttattttcttttcctttttcccatttgtaaaatggaggctgaggtacaaaaaatgtggccagaatccatgagcatgtcattacaaatgataactgcatgcagtgaattccttgttattttaccctctgaatgggtttgggcagtttgacgtgcttctgctgttgcctgacagtatttgcatatgtcagcacagatgattttgacatttggagtgtcactgcatttagaaaggttggcaggatcctgtgaatgggtatgtgggcagtttttctgatcttttgcaatgattaggagcagttcctgaccttgccttcaaatccctggccttccgagataagttctattcaggaacaatgtcctttggacctaatttccaccggcaatgcaagatttactcattgattgatggtggagagggtagcctcgctctgttgcccaagctggtctcgaatccctggcttcaagtgatcctcctgccttggcctcgcaaagtgttgggattacaggcatgagccagtgcacccagttctatctcatgtatttaaacatagatttattaaccagctactttcagtatgagagcacagagtcactgtctttggttcctaaagcttatgaggtgtctggctgtggtaaaaagtgtcttgggtatgaattctagctttgctactcactcactatatgacctaacaaatccttcaagcccctgtgcttactgaggtttcccctaagcatgaggatgataacacctgtcttgcatgctggttgtgggaatcaatgagataaaagcacataataagaattcaataaattctagctaagtgtaattaaataatcaaaagaacattcaacaagtgcataattatgtctcacttaggaattacacaaagtgaacttcataggtcttggaatttcattttctcttaggcatatccaagttcagaccaattaagaccttttaaactagctacaagctgaactgaacccttgtcctagcttgcagtgggatttttaatctttgattttcagaaacatgtggacatacatcttcagtgcatatggacaagagtgtagtaggacaatctacaaagatatatggctagattttttttcctttgaataaaatctatagcaattacctattaggactttaagcaaaagtaagtttgttattgtgttagagaccagggtaattggttgagggaagttagttctgcaccaagaatgtggaaaaagcacaagaatcaattaaaagtttcccagagaaacttggatcaaaaaccatttaggtgatgtatgactcagaggaatagaggaatgatatgaaaagttcatgggtttgttttgatttgagtgaataatgtgctctggactatgcagagaactggattgagacacaggaatgacacaggacagggtatgtgcttttgctgtacaggatcttgaggccagctcattgggcagctggtatctctcaaggatctttaggacaaatgacagcattaccacagctggccatggtcaaagacaggttatgcaatggctgtacaaacacatggtcttcaaaaacatcaggaaagttccagaaagaaaaaatgaattcctgaagaaagggacagaatggatcatgtgatagtgcaaatatgtagaaatgagggtcagacacaaggcagaatactgaactagtgactatattgaccacgccagggcaggagttgggcatttgcagaggatatgtggcttctggtagctgacattgaactcatatttgattcattttaaattctcttccccagccaagcagtatcacataacctacaaatttctttgggtaaatagacatgcggtgtagcaaagacttcttagacatgaagacctaggtaattagcagtgagaaataacagatttctaggtgacatttcagtggggtgttttgaagaaaaacttattttaaagactattgctaaaccttacaagataattggttccggatattctgttcatctatttttaaatatggcagcagatttttaagacttttttaaaaacactgtatcatgtttcaaagtatggtattaggaaaaacacattcattacaaaattaattgtatttttatttatcgcaggatgctatgcattattattccgtgtaatttttttctaaagacctctaattttggtagcagcagaaatattactatttaaatagtaaaatatttcaatagtattcatactgcagagagaattatgttgctttgctgaaaacccaaatgatggttttaatagcaaggaaacttgccagtagttacttttcaatgacacttatttcattataaaaacagtagaatttgttgtcatcctttgttgtcattttgtttgctttttgctatccccattcatcctccagttcaggttttgtccatcattgttgactgtaatggtacatatggctgatctggcagacagcagtgatctcatttgtaacgcattattgtaaaacccatttagcagattagtttgagattacgttagctgaatgaagacattgctgtgtcctttatgaagaaagccatacatttaagacatgttagaatcaattctgctctgaataagacaggattagctcactgcatctttctgtgaaggagtttctggtggagtgtggcatttttaaaagtgtaccttcactcctaatgcagcactacctctaagcaactaagcaatttttcatttatctcaacattttaaaggtattttctttttatccctctacttattattattattattattattaagatctggccagatgcagtggctcacgcctgtagtcccagcactttgggaatctggtgcgggtggatcccttgaggccaggagtttgagaccagcctggccaacatggcgaaaccccgcctctactgaaaatgcaaaaattagccaggtgtggtggcgcacgactgtagtcctagctccttgggaggctgaggcaggagaatcacttgaacctgggaggcggaggttgcagtgagctgagattgcgccactgcactctagcctgggcaacagagcaagcctatgtcccccaacaccctcccctcaaaaaaagacccgcagggacaatatgggaaaccgcatctctaccaacaaaaatacaaaaattagctgagcatggtaggtaccatgcacctgtagtcccagctactcaggaggctgaggtgggaagaaggcatgagcccaggaggttgcagtgagctgagattggattgcaccactgcactccagcccgggtgacagagtgagaccctgtctccaaaaaagaaggtcgttcttctattttaatatgacttaaggcatgactagcaaattcttcctgaggtaccagtgtaggtggccactttacctttcagcctgacacctgctgggtagtaaagttttctctttgaacgtttgtgtgagtcagagcagattgcaaaactctgattctgtgctgagaatgggtttggtcctggagcaactattaacacagtatttcttcagctatgctgtttcttggaaggtggctcatctgacattcatccatggcttttaaaagataacatacaaataattgatatcttccaggtttttgagcattttgctattaagtgattgtcttcataggttgattgccaatttcagctgtgaaactgtctttgcgagtatatgtataggtgaaatttttcaatgactccctccccttttcaggaattaagcaactataaattaggaagtacagtaatattggctattagggtgaatatgggtatagatacttttttttcttttttacattttagaatggctagtgtattttttatttacagttgatttcatttgtcagaatattacagctgtgagtgatccatttttgtcccaattataaagtaatatgctgtgattttatagtataccttaaagaaatcacataatttattaactaaagcaattactaaaagaaatgtccaattctgacctataaacgttttacatatggtttctttaattttcatacattcatcttgaatctgtattctttttttgagacaaggtcttactctgtcacccaggctggagtgcagtggcacaatcatggatcactgcagcctccatctcctgggctcaagcagtccttacacctcagccccttgagtagctgagactacaggtgtgtaccaccacacccagctaatttttgtattgttagtagagacggggtttcatcatgttgaccaggctggtcttgaactcctgaccttaagtgatctgtccacggcgacctcccaaaatgctgggattgcaggcatgagccactgcacctggccaaatctatactcttaaaaaaggaaagtgcgttataacagtttggtaatacatttacaaaaaatagttattccagtgattagggggtggtctaggaaactaattaatattttaataccaaacacagtgggaaaatatgcaatccttaggtatgaatcaggaacctactctttaaaaaatgtcatacgtacttaagagaaaaagatgaaggttgattgactgagttcatatatatatgagactatgtgggcaaactgaaaccttcttaacaatgtaggaccaataccattttctacaaagattttaacatagctaattaactcaacattagcttttggctgaaaatatctacactgttttaaaacttgcaaaatcaaccaatctaaatctttcctcaccattactaaaggagcatatgtacactatttcttaaagactaaactgtaccttttggtacagatagagagtagattgttctcggtgtcacagcatggtgtttctcaattatggtgcagagttgtatttctatcttttgggatgtaggaatgtgagccagcacaatgtcttaaaaatcagtaagtcaacatggcaacattgtatcatttgaaagatttatgaacagaaacactaaatggttcaaatggtttaccttcggaatacctcattataagtaaaatgatgtattaaaatttgaacttatacttttctggaagttaggatttgtacatcttatacttggagatgcctcagtgttgcagaacttccaggatgaagtgaatgccctggctttaaatgctgtctgctgacactcagattaatccatcccgccttatgctgtcccttgaatttttgccgttatgatatcttcacccccaagtcctccaaaccttttccttccctggccctgtatatcttgctggacggtaactcctttcttccagttgcttggctaaaaccctggaatcatcagtgactctctttccctaacgtccatgacctccccatcagcaaattttattggtgctgctgtgaaaatatgtccagaaactaagcacttctctcactgtcctccattaccagctggttcatcaccatagcctcctgaccgttctccctggtttcaccttttcacctgcagttcttcacatgcatccagggtcattaaaatgtcaccagtgctgctcctctgttccaaatccttcagtggcttttcatgtcatctcagtaaaatccaaaatccatgtggtctgccccctgatgctgctcttcttcatttcctgctgccttctctttttctctcccattctagccctatcactggaataggcaagaatggcccttgccattcctcaaagacactcagcctgcctgtgtctcagggccttggcacttgcctgctcctctgccttgctgactcatgccaatgtggctggctccctctagctcagatctctgctcacatgtcgacttaggagagaggccatcaccctccccgtcagtcctggtctccttactctgctttgctttcccccttagcactgtgcagtctgatgttgttatatgctaattcgttacctgagtataagcagtagaagctctatggcagttgaaatgacctaatgtgctctgtttactgtttatagcctgggtgtcccaaataagccctgactgcatggtagatgctcagtacatttttgtctgatgaatgagtgtgaagttttagttgttgacttctcctgagatgtatcagtttttaatattttttcatttattcattcattctgtaaagcccatcattatgtgtaattctgaggcattattgatatattgacaaaaatagtgcaaagtcttttatttttaatgttttgtatttattagttttaaatgcatagcatgtattttataccttgtgaaatgtggtcagattctggatttcagttctggagaattttctatttttcttttttgcaactgcagtgatcaaaaatttaattttaaggatagatttgctttataaagttaatttacagtcagtttttgattactgtataataatatatgtaatttttaaagtagtggtggtggtgttttaccttttttctgttttaacattttaagaatactttcctttccatatttagagacccctttcaaacatagtgttactttaatcaacagatgagatatgcccacatatactttaattcatatgtagacaagtattggaaatcagatttgtattaataaaaaaatcaatgctatcaaccaagccattaatagaaataattttttctcttttatgtcaactttgggacccttttctcctctctgtttctttctttcttttttttttttgaaataaggtctccctctttttcccaggctggagcacagtggcgcaatcacagttcacacagcttcgaactcccaggctcaagccatccttctgcctcagcctctggagtagctgggattacaggtgcacaccaccacacctggctgattgttttggtatttagtagagacgaggtctcgctatgttgcccaggctggtcttgaactcctgagctcaagcagtccttctgcctcagcctcccaaagcctcagcctcccaaagtgctagaattacaggcgtgaaccactgggcctgaccctctttttcgatatgaaattgtcacagtacgccagattgatgttattcttcagaaagaaatactcaatatactttaattatttctgaatgcttagttgtgtgactgtctataaaatatttcttttttgaaacatctggtgaccagtgcattacagacaaagattgcttatggatatagagtgcatgcattccaggcaatatggtcttttatagagaaaaataacagagcagggaaaggaattgataccaagtttgagtatcaaactgggatattttggatgccagaagagaataatgttagtgttttcttaaagagctcagcacccatctgcagaaacttgtgtggactgtttttcaataatgggtttgttccgtgtgtttgtttttgatcagatgtggatttataagtcatagatgccacattcagcaattgctttttatcacatttaggagagtatttgatgagaataccttaaacctttcaatttaattaaagtgcagtgtaaatgatctgttgtactttaaaccttgcaaacatggcctttgtcagtttttaaactatgatgaatgtttccaataagcctggctgtgaaaataaagaatagttgtttatggaaagattattaactagatgattgtggattatcattctttagtcctaagaaaaacccactccaatgcagatctttcttcctctagcatctaaagtattcagcacttagtcctacagatgtattaattgtttaataaggataaaccacaactcttgttgtttgtttttgttttgctaaaggaaaaactgctattgagatcatttccctcaagagttttctctgggaagttctaattaaaaatgaataaaataatctgattcaaaatactagtcctgacccaaactactgactgcagaagacacctgatccctgttttgaagaagctaacattcatttcattgggtatatgtcattaccacaaacaaaagaaagctcattttgtatatattgacaagttagaattttttgttattaacaggtttggcaaacatcgaaaagatgacaagattgagaaaacgggtaaaataaaaatacaggaatcctttacatcagaagaggagaggatacgaatgaagcaggagcaggagaggtagacttcagttacttgattaaacctccttagaaagaggttctttttttttttctttctactttcttcttttttaatgtaaagattttacatttaattactcttcatatttcctgtatcaacccaaatattgatggttgtgggtgaatatattgtaaagagagatttaaaaaaaaaaaccttatatgtatttgtgacatcaaagtggattttaattgctttagttaagatcttttgcataggaaatagaacagcatattagatgaataaataaacattaatactgaatttatgattttttaaaataacacaaaaagtacttaaaatcctgcctgatatatggatatttagtatattataataattttaaagaaatactcttctgaaaataaaactccgaagttttatatcacattttaaatataataagaattcaggaggctgttattcattatgttgtttttctttcaaacctgacacttatttcttgattctccttctattttaccatcttcacattttgtgacattttccacttaagttttccatgtcttccggatagattgttacctattgttgaatcatttccatgttgagaacttaaagaccaatgaaaggaatgaaaagagttactctaagcaggcactcgaaaaccgtttttctaagtgattagaatttttctcattataattccagggggtgagaaagccatctcacacttttgttattagagtttacaggttcacagtgagcttctctctgtcatcacatttcattttctgagcagccacagctaagaggtactatgcctgttttactttgaataatctgggatttcagtgagtttctggtaccttgatgaaggttataatgctaagtactgtccatagctaggactgtagcccagcatctttaagattaagcccagtattcctaccataattctaaagctaggctgcttttactctaatacttaatgaatgaaataactaaaaatagtatcctacaacagttttatttaaaagagattagtgtttgggtattttttcattcatccttctaatacctctgaggtttttcttgaatagaatggttactctgagtctctgtagcttttcagggtagaaaatgtatgtgggaaaaaatatggattttaaatttatgaagcaagacggctggttcctcctcaatttttatttttaaaaaatcatttcaccttgctttgtaggactctttctaatcctcatcaattttgggattcccaaacttattagtaaattcactatttttgggtttgggtgcatagtgttccttagtgtgtgtgccatagcatttagtgactcagaagtataaacttctatcctagaagagtttcttctccctaaaggaggagactataccaggtaaatgtgtgaactcagattcatccacaggcaaatatgtaatttacttagagagtaatctgagcgacagaaacattatacctcccctatatcttgatacctgccacaggggatagatagcttcattaatcctgtactatttttcatcttctaaacatttcttccttgcagtttaaggtgactgctatgtttccatgcagaattctatcaacattttccaaaatacttttatgatgcttagtcaaatatttccagccaaacaatgatttttacataatggtttcacttgtattattaatttgcctaaggcacagttcacttctcagttttgcttttaatttccatctctgtacctctaatgatgcaatacttctgggaactaggttgatcataatgaatttacaatgtacaggaggcctaaaataaaaatctttcagggtcaaggaataagtgaatggtccattaaaaagtcaattaggctcataatttaagaaaattattatactttgactttgtatttcaataacaactttttgcaagtatgttttatttaaacttatggattttgtaatagagcaagtgaatgcaagaaacggactgaactaggaggtggagtaggtttggcacttgtattttaatagggcaagcattcttccatatgtcgttctttctgttctgtctgtggtattggcagtgttctttttgagaatggaaactgcagcttccttgaaaaaattttgactggagtaatcaataaaaataaataaaccactacttatattctccttacaacctttccctcactgctgactagtagtgaaatacctctcgggatattatttaccactgtagctatttgaattccaaaaattattttggctaattccatataaaaatagaaaacccaacattcccccatgagttatgattgtccacaaaccagaactttttttgcctgtgtacatctgggaatcttgaatattgctcaagatataaatattgaaaaactaaaagggctatgaatataattttaaatgttttttcttcaatgttaagatctatttagatggtgacaatatactagattgttctgagccgggtccaagattaagtttgacttcattcttgctaacttccttccctttctgtcacttgctaccaacactgtgaggttgggtcttgagtaaatgccatccatatgggagaaatggactaggaagatcactgtatggatctgtgctctgctctactagccctgccctgcctcagactagagcctccatgagtatggtcttcttgagaagcggggagtctgggcgtgataccaagggggaagttaacaggttttccgacatgctatttttgacttctcattctggagcactgaacctaggtaccctattttttcagagatgctgttggctacattggagacagactgagaaactaagcaaaaatgtgaattcagtgcttcgtgcctctgacttgtgtttcaggcatgcctagggacagcgcctctactggctcatttccaccacatgaaaggtttaggctccaaactcaaaacagaacatgttccaattaagtgatctacgtaacttcaggtctacttagcctcccatacaaagccccgtgatagatttctctgtcgaccaagcatcacacgttggctttctgttgtttttgctccagtgatacctccatgtatttttaaatggtagtatatacactatgtggtacaggattgcccagtgttcagcagcagagaatgtgttctgtttacaagtatgtttgagaaacacttgtttaaaccagtatatgcgtatctttctactctgttatttctcaaaattctaccaagttcatgtgcattatgagtcaccaagataggaacagagagtcaccattctccaaacttatttattctcaaaacatcctctcaacccctcactttttgcttttcctggaatactgacatcccacaacattctgagtcactggggaaataccaagggcaagtaaagaccgttgactcctggttcagcggtgttcagcttactcctctaactggctgtggaaaccggagttgattgttttccagaactgcgagcaagtttaaagcagtgttgtaacctgtctctactttctggcttctgttttgtggacttatgaaagtgcgtgcttaccactgctcctcctttttcagttttctctttcccacctttctcacttgtttaaaaaatgtacctttttaagctctagttctaagtttattctaatactaaaaactacagaaaaatttgggagaaacccataaaattacaatcagaaaacaaaaatttatctgtattaacacactgttaacatactggtctgtgctaatcattttttttcctataaagtacacattttccacacctatgtacttttaagaagttgacatctattttcatttttatttattttgcatttttatgcattcttagaaaatcatattaaatgttttctggatcacggtcaggtctgtgtgaacagacaaatgggaaagagggacagaaagaaggaaagatgttctgaaacatgaaatattagctatgatatctggccaaatttcccaactctcaaataatattctcctcatgttattcattctattaaatgaggtttataatgttagctggcttgtattttgtagttattcagccattgaaagctattacaatattattatctatatctgcatagtaagttgtgcttgggaacatttccagggatactgaatgcttctagtggaaatatgtaaaagttaattaatttcttattaaatcctcccagtatagaaggaatatttataaatctccttaggaaacagatgatctgaaactttccattattcaatgttctaatcatctttcaaagccttgtgttttcaataccagaccgttgaactatctgtgtccttcagtgggatactccccattcttggtgtgtcattttgcaagtttatgtggattttctgcatgccgtttcctctctttctaattttaccagctgttctcagtaatacctgctttgggtaattacttgaactttttgtcatctcagttggtaggatccttttcagcaagtgatacatgtttgttttcctaacactaatctttgcatttagatcacttattgtcatgcaaagattgtcttttaaaaattaaccttttaagagaaacattttttctatcctgtagcagcatttttcatgtttctttgacctcgtgaatcctttagaaaagtcaattctaatcaataggctaagtttcaagtttttttaaaaaaattttcattgcacaggtaaatgagaatttttaagaatctgttaacctgctttgtagaacttaactatttcgataaatacttgattgggtgtgttggctcacacctgtaatcctaacactttgtaatcctaacactttagcaagagcatcacttcagcccaggagttcgaggctgcagtgagctgctgtggttgtgccactgccctccagcttttgtgacagagtgagagcttgtctctaaaaaaaaaaaaaaaaaaaaaaggaaaaaatatagatgaatacttgaggaaaattaagcgttaggcatactatatatctgaaaccgattttattgacagatactgcaaatgaagtaggaaaatgcagtttgctttctgatgagagctgtcctagatatatttggcttaagagcatctctctgcattggcaataattgtaggtgctttaatatccatgaaagcctgaacattacttgagtgagtatctgttgagatgtgtttgtgtctgttggttagggaaatattattctagtgttttattagtcagtataagacaactggttttgttgtttcacaatatattaagtgtatcagacagtatattagtctgttctcatgctgctataaggacatactcgagactgggtaatttataaagtaaagaggtctaattgactcagttccacagggctaaggaggcctcaggaaacttacaatcatggcagaatgggaagcaaacacgtccttcttcacgtggcgggagaaaagagaagaatgagagcccagcaaagggggatgccccttataaaaccatcagattttgtgagatctaagtcactatcacaagaacaggagggggaaaccgcccccatgattcaattatctccacctggttcctcccatgacacgtggggattatgggaactacaattcacaatgagatttgggtgggaacacagccaaaccatatcagatagtataagtctttttaaaattactattttaaaatgttttttccctctcagggatcccttacctttgttaagagaaaaagatttaagcatgttaacattaaaaaattgatgtaaggctgctcagaaggctgaggtggtaggatcacttgaggccaggagttcgataccagcctgggcaacatagcaagactctgtccctaaaaatattttttttaattagcagggcatggtggtatgcacctgtagtcccagacactcaggaggctggtgtgggaggatgtcttgagcccaggagttcaaggctgaagtgagctatgattatactactgcactccagcctgggcaacagagtaagacccctgtctctgggcagggggaaaagacaatataatcaattgttaaaatagatgattacagagctttgggaaggggaacgaccagtggggctggagttagtagtgactgcttcatagagatgatagtttgggagctagatcttattcccaagaatatgtataatttagcaaactagaaaaattctaccctcactttcagtctctctccccctaagcacaaaggcttatggaaagtgggcagtcttttaactgcctggattctttacaagttgtgattgtattagtggttagcagtctccctgttaatgctttcttttatctctttttcaacttttaaccgttttgtattttaaaaccagtttcatctcattttagcattgagggatgcaagttaactttccctcccagctattctaagggaccactatatatttcagcaacttgcattcttccctggaattggaaatgtacctttaaaacagttgttttcactcaagaaaatttttttcagggctcatttagaatatggaagtcctttcttctcaatcaacttttaccctaatatgacaaagatattaaaatcccacttaaaattggaactgttaccagggtaagaaatttagtggaatagtatctctcttttgggaattcagcataggcaccaaactggcagcttacctactgttagggggcagttgttagattcacctggcagggggaggatcacccaaaggaaggatgagttgagctgcagtatttttgaagtctgccatctgctgaagtactctgagggcccaataaagccttccatggtggactaaaactgctttctcaacagacggttctttccagttgttttgtagcttaaatttcatttcgccatgaatttgggttttatttgatcaatttctgtaatactgactttttgagagaagaaatactgttggaaaaagatccacgaactgttgttcccagaatgaggcttctggatggcagtgcagtaagttgggggtaaaatgtttcccaaaagagttgattgcaagatcctgaacattgttttgaagatagtcaacaactatctgatatgtagcaatctgaaatttattaaaaacattttttctgttaaactaatattagtatattctatcttctgcagacataactttttaaattaaaaatcgttaaaagacagtttctatttcttgtagtctttaaaaaaatacaacatgtaaaaagagatgtgttgcagcatcatagctttggaaatggaggtatttggtatgtaactgagaggtttaaggacaccactggttttgcatcccaaggagtttggaaatgaaagtatttagtatgtaactgagaggtttaaggacaccactggttttccatcctaaggagtttggtcacttcggtggttattcccgtacctggtaccttttctggatatataaagactagactttatgatcataaaaagttcctttcatcttattctactgcaattagtgctaaaagccatttattgtaaaagcaaaaatactaatgaatagaaatgttacaaaaacagaagtcttgtgtgttttatcttcatcgagcgtcatccattttaattagagaaaaggtggtgaacactgtgacaagagcctggaattaaaatcattaattgatgtcaagctgaagagagactgttagcatgaatttagtgacagcaggaaagaaattaaccttattactttatttagtatattacattattttgtgtattattttctatgcaggttcaaggcaatttcattatcataatggaacactttatttttttttttacaaaaaggaaagatgtatttatgcttgaacataacaagttgaaatgataagttctttattaagttaaaaatgacttgataaaaggttttaattgtttgaatttgttttttcaagtttcaaggataggaaacagtataaatgttgtccatcaatgtcgggtggtacaactgcctgtgataatctgaacttcagaatagttctttttagaaccaggaaggacttactgaaatgtttaaagcaatagacatttatgtcttttgctgggttttggactaatcagttacttctgtcattgttgaggtttggcccgagataaatgggatagagaatgctgaacaacaatctgactgttcagaaaaatgagtgactcttacatcttggagataatttgtgacctcagggtcacaataaaagagtaaagggggtatgcttttatagccctggccatctggatccattaagggctcaactgcaagatactcaccatcttttcaaagtttccttaagaagtcatgttatttttatgaggacaccaaacatgttttcttcctgagccaaatattttcttactgaaatatgtatctccacagagtggaaatacataacatgcaaatataaccttttggtcgtgttagaaagttcatattctcactttgtaacaagacattcaaatatcaaagaatataataaattcatttgtgtcttttgttaattttgcttgtgaattgccactaaaatttatgaaaatcacagtgcatgcttagtttcaaaagtctactctaaagtgctatttgtacagcaagcctcgttagcattaatttctagaatgaacttgagaatgcacattagttcaggctactgaccagatccgttagccttttgcggcagtagttctacctggtggaccacacgtatgctatagttttattctaaggttttcaccaccagtgtaagctgccacattggaaagcagtgatgcaggttttagaactttggggacaacattattggtgatgacaagataagcaatacaaatacaattccttcattattggagccttgaaaaaagtcagtatttctggaaggtactacagatggggctttaacgtttattaggctcagtgactggtggcgattagtcataatgtacaaatttgggtaaaagaaggcagctgagatctgggctttataaatagtacttcatgctgctgagcacttcttttgagagattgacttgttagaaattgactgctaattaatattattttctgcgtcatttggaacaaaagaatattcaaatccagaacccatcagtaatataatgaaactgatgtgcaagaagtttggggagattatttaggtttatgcctcccttgaaaagagtgtgttcctattctctttctgttagctttctttcttaagagggatgcattttctgatgtaagtaagctggatttttcacttttagtgaattaagctagatgtatcatagagtttagtcattaataaatcagtctgagtccttctctttgatttttggaggttctccaaattcagaaatttcagctttatatttatataattatacttaggtctgttgtgttccttcaaacttcttcagtttgccaaacttcaagacttatgtgaatgcctagttaccctggatattacctatgattaagtgactgatgaatggtgaccaaatatcatagtatagtgggttgtcagataagtgatcataattgagtttcaaattaatatcccattgaatgtaagaaagaactcattttcctctttctgctagtgatttctggtcaaatcaagagtcaaaaagacattatggtgcaaagaataaaattatctcctaactcctgtcaaccttccattatggatagctagtatttagtggtaaccagcttttataatagcatccttaactgtcataattgctcttaaatggataaatggcgtaaaaatttaaaaactgtctagtagaattttagctaaatttgacattagaatttgagttgctgtttctcttgtgggtattctgtctgtggaacctacagtcttagagttactaggatctagaacagtcctgataaaaatttctaacttcctaatattcacttttgagttaagaaagtcattggttgtcacctcaggaaataaggttctcctagagagttttggggaacatgagaagcagttttcgttgccccattggggacactgctggattacatgtggctgtgaccagttctggtaaaagtcctgcttgatgacaaatagccccttctcaaatgtcattgggtcctgttgagaaacactgagctaggtgaatttatgtactttttatagctgggagagaagaaaagtcagacagatttgatcccctgtattcaaaattggaaaccaagagtggggtgatggtgatacactagatacaagaaagaaacaaggaaaatgcaaagtttgcttgtaatgctatgtgacaattttctgtctttaaaaaaacttttaagtttgtaataattttagattcataggaagttatgaatatagtacaaagaggtcctatgtacccttcatccagtttcccccagtggttaagttagataactgtagtacagcatcaaaaccaggaaattcgcattggtatagggtgtgtgtagttctgtgtcatcacctgtgcacattagtgtagccactcctacagtaaagaaacagaactatttcatcacagaggtcttcctctgtagctaacccctagccatcactaacctgttcaccaactccatacttttgtcattttgagaatgctatataagtgaaatcatatatgacctgtgagattgactggggtttttttcacattgcatgatgcccttaagacagattcaagttgctgtatgtatcagtagtttgttcatttgtacagctgagtaatgttctgtgatatggacacaccccagtttttttgttttttttgtttttaactattcacctattgtgagctattttgggtgttcccaatatttaaatattacaaataaggtaatatttggcaatgaacaattgcatacaggtttttgcttggacataagttttcacaactttgggatacgtaccgggaggcacaattactggacagtatgataagtatatgtttaatttttaaagatactaccaggctattttccagggtgacagtaccattttaaatttccaactgcaatatatgagaagcccggtttccctacattcatggctgcatttggtattgtcactgttttttattttaaccagtcaggtgtgtagtaatagctcatcatggtcttatttgcatttccctattaactggtggtggcgaacgtcttttcacatgcttgtcatccatatgtcctcttcagtgaaacatcttttcatgtcttttgccattttctaattggattgttttctcattgttgaggtttcaggggtttgtttgtttttttgtttgtttgattgtttgtttgtttgagtcaggatcttgctctgtcacataggctggagtgcagtggcacagtcatggttcactgcagtcttggcctccagggcccaggcaatcctctcacctcagctgggtggctgggattacagctgtgcaccaccatgcccagctaatttttgcattttttgtagagacagggttttactgtgttgcctaggctggtctagaactcctgggctcaagcagcacgcccccatcagcctcctaaagtgctgggattacaggtatgagccgagaaggctgactgttttaaaaaatatttcctggatataagtcctttgtcagatacgtgccttgcaaatatttttttctagtctgtacttattttttcatcttctaattagagcttttcacagaggaaaagttttttattttgatgatgttcaatgtatatacttttaaagttttatggataatggttttggtattagtcctaaaaacccttctccacgcactagttcctaaagaatcccttacattttttcttaagttttatacttttacatttacatttaaacctgtgacccattttgagttaattttttagtaaggtatgaaatttatttttccttttctttttgcctatggttatctcatggctcctgcaccattggttgaaaaaactattttattacattgaattgtttttgctgcagcattgtgtagttttcaacgtatctatcttacacaggtctacataaacgaaagtttggcttatagatgtgtatctgtgtgttttgtttcgttagggattataaatagcattgcatttttaatttcagtgactacgtgttcattgccagcatatggagaatacaatggatttttatatgttgatcttatatcctctgactttgttgaacttgctttttagttctgggagatttttgtagattctttggaattttctttgtagatcatcatgtcatttgcaagtaagaagcattttatttcttccttttccatctgtgtacttttatttccttttctaggcttattgcattgcctagaacttccaacactatgtggaattacagtggtaggagcacacatccttactttatcatagggaaagcattcagtctttctccattatgcatgagggaacctgtcggtttttggtagatgctcttaactttaggaagtttcactttatttctagttttctgaaggttttctgacatgatgggtgttgaattttatcaaatgcttcttctgcatcaattgatacaatcatgtaacttttcttctttgatctgttaatatgatggattgtagtaattgatttttgaatattgaaccaggcttgaatttttgcagtaaacaccatttggtcacggtgtataatttcttttatatattgctgaatttcatttactaatatttcattaagggttttttgctttcatattcatgaggaatattggcctatatagctttcttttctttcttccttttctttgctgctgtctttatctgattttggtatcttttctgaattcttttgaatatatgtttatgtattgtttttgctagcagaggtctacttcaaacatgaaaagaataactgcaataaaagattatattcagtctaaagtgttgctttatagaagtaagattttactgcatttaagtgtgtacttaaatttgtaagtatataaaggagatattttttccattaaaattttattgagggttttaaaattttttccaggtaactaagattgacttaggacataaattatatcaatatattataagttgaagaggacattgtaccaaatagtttaataaaatcatagtaaactaaacgtaacttcagtaaaggtgagcatttaaggtttgtttcttagttgtaatgtaggcaagttttacttcacaatttgattggatacatgccttctagtccttaatttaaggattctccatttctgtatgcatcccatgaaatgacagagtcgatgtcattaagctgagatcctcttttgtcactaatgaagagttatggtgtggattcgtgtttaagcttcatagtaggttgaatgtttatggtgtattaataatgagtaagataggtatatattacatataaatattttcatatataaagtgtatgtaacgttaaaaaaattatttcttgccttaaacaaattcatgagtaatatccaagtagatgccagaaatgatctgttccttgcgagtttttaaagctagttaataagtgaaagtttaaacttaagatttaaattatggccaggcacggtggctcacacttgtaatcccagcactttgggaggctgaggcaggaggatcactggagctcaggagtctgagaccagtctggccaacatggtgaaaccccatctctactgaaaatacaaaaattagccaggcgtggtggtgcacacgtgtaatccctgctacttggcaggctagggcacaagaatcacttgaacctgggaggcggaggttgcagtgagccaagatctcatgccactgccctccagcctgggggacagagtgagactctgtctcaaaaaaaaaaaaaaaaaagatttaaattatgactgcaatcttgtagacatgaacaaagggcatctcaaattattctttttgagcatccatagcattacttaacaatctagaatgtgtatgacctgtcatttataccactgatcttctatagctgcaagaaatcaaatatattttacaacatattttgatgaatgtttctatatgcagttcctaaaaaaggaaaggtttctcttatttcaactttgttctgatttcataggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacaggtaggcgccaggggcaatcgtggtattgcttccaaatcagcttttatacagcttctgacaggggagtagaccattcatcaatcctcaaaccagaattgccttttattaatggcctttaaaaagctgttgtgtctaaaagtattgagtttacacaaattgaaacctaatggaaggatcagcagaggttttgatggcttttctaatgattccaacatatttcattttgttctgaagatggttttatacctgagaaccaacctctactttataactcaaataaaaagcaaacttaaaattatgactcttctacttaagtgatatgtccttttattgctaggagagcctctaggtgtggcaattaaatagatggggaatgacatgatttgttccacttatgatttagatggatcactttttttttaggcagcataactttatattatgaaagaatcggtaaatgagaagaataatatagtataacagattgcttattaacagccacagaccacaggtctaaattatgtatatcagtgtagcacacaggagtgcaatgttaactgtattttttaattgatacatgctattttacatgtttataggatacatgtgagtaatttttacatgcatagaatgtgtaatgatcatgtcaggatatttggggtattcctcagcttcagtatttatttatctgttatttgtgttttatcttattttatttatttattttttattatactttaagttctagggtacatgtgcacaacgtgcaggtttggtacatatgtatacatgtgccatgttggcgtgctgcacccattaactcatcatttacattaggtatatctcctaatgctttccctcacccctccccccatcccatgacaggccccggtgtgtgatgttccccttcctgtgtccaagtgttctcattgttcaattcccacctatgagtgagaacatgtggtgtttggttttctgtccttgcaatagtttgctgagaatgatggtttccagcttcatccatgtccctacaaaggacatgaactcatccttttttatggctgcatagtattccatggtatgtatgtgccacattttcttaatccagtctatcattgatggacatttgggttggttccaagtctttgctattgtgaatagtgccgcaataaacatagtgtgcatgtgtctttatagcagcatgatttatagtcctttgggtatatacccagtaataggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatgtcatttgtgttttaatggctatatatttacttaaaattttaactgaaacaatttttaaacgatcttttcccgctctttcatttgtatgttcaagcaccatgaggagtttagttcacaaataatcatttctttttatatcagacatacgcatgttattgtcataaatgatacactcagctcatcatctctcatagtggtttcttataagtgttgctctatttaggaactgggccttgaacattatgaatagcaggtttcattaaaaccaggggctctcaagctttagtgtgtgtcagaatctcctggagggcttcttaaaacacacattgatggactctccccaaattttgattcagtaggtctgaggttgagcccaataatttgcatttcttacccatgtccaggtttgatgctggtaccattggtcctggggatggcactgttaagaaccctcacaaggctagagatgtacgggaaatacttcatccatagcatccatgtgttattggttgctacgttttgcacccagtttctattttacctacttccagttgtttttaatagaggtttgcagatgcaacaggtaactcttaggcaaacccaggaagaagtatttttaaaaatagcaaatgtgaagccagatcttaaggtgaaatgctatagccagagtatttggtttgttgctttgttttgcttttgttgggttttaggttttccttatggtcttatgaaaatctgtaggtctgtttgatattgactataatgactgaataatgtaaattaacataggaggcatatggtttatttagacccctttgctgtgatcacctagaaggttcacttgcttattatctaaccacagatatgtcaggatccaaagaatacaattattatcagtgacaatgacattttctttaaaagctcttacttggtttctgccatacttgtgaatgctgcttatagaaggtcaaacagcatttgaaggccatgaatgtcccattggaattgttttcctgggagaaaggacaccagaatgctggcgttgtcagttagtaacttttggaggaagtaaaaaaaaaaaaattagttgacatattattgatcgttgataaaagcactcatcattttcagcaccttccacatccactttgaaaacctgaaaaatagtagactaccacgtagcagtttttcacacagctcagaagtcccacatgacatcaaagccaggagtcagatgggttctgtcttcccagctcctgaggcccagaagtggttgctttaaaccccagtttaaatcatagtgccctacaagagtctaaatcttgcatgtaaatgtctgcaaattttcagtagcacttacatgctcagaacagcctctgtttctggactccagcatccccacttggagtctgtaccctgcactgtgctaaccccaaactgaaactcagcctcctaatttctgccaaaatgcactcagagaaacattctggaggagactttagtcatgaggatgagttacaccaagcagtaagtaactcagaatcacatcttagacattgctgtattcaaaagcccctctcatcctaactcaagcacagcctcagcagctgtcagacttacgatacttttatgcatttgtgccccagaagggtgattagactagataatttgtgagatgcttccaactcaggagagacataatttatatttttaagaaaaaggactatggaaactttagttttttgtaattattatttttgcagagaataagatgtccattaaacaaagattgatgttactaatccaaaaagttgggaattatcatacctgtaaagcacttcttcatctgcctttaacaggatgtgaatttggctgtgatgtcatggtatcacctccattgtctgttcttgtcaaagagaaagctacatagaaaagtgtttctcagacttgaggagtataggaattttttttttttatagaaagacaatctcttggtactgcagtattgaactaaattgttttgattataatgttacttaaatatgtgtaaaaataaaataggactaaactccttctgttgacaaccattatacaaccataaagccaaacatctttacaaattaaatacaaaaatggcaaagccattaccttcaaatgaacaacattaacttaatgtggccaataatgtttcttaaatctaaactcttgcacaaatcatgaatatggtggtggctgctccatggcaggttcatttgggtttgtttgccgacccccacagtcttgcccatcccttttctctgttgaatttctgcagttcttttgtatgttcctgttcagcagcctttggcctgcagctcccacaggggcatcatgtgtgcacgaagttcagcccgcttctgttgtcattaaccggagacagtgaaaatagcattccatcgtgccttcatgtgtgtaaacccaaattcagacagtgaaatgacacgcctgtaagaagatctagaatatgcttatactaacgtttttgaaaagtaattattcaagtggaaacatgcaacttggaactccgcagagattatttcctgtatgaagaatagacacaatagagaaactcctgtcaactgactaaattccaccaaaatttgcaattggtgtccagtgacctttactattcaaatttttggatttcatgggaatgcaggcagttgacagtctgatgtgtagcctgcatctgttctgggattttcattgttcagtaaggaagcagtgttctacatttcactgcttaatcattttaattgatcttatagtcagaaatatggatctggtagccccacatggaaacagccagggatgatttattaaatgtggtgaatttggcatcaaaatgggacattttctcaatttccacgtattacttataaaatgctttttataagatagcatcatgccatgtctagaaatagtcccatgtctgtttgattttattataacatgaactgtaggctatagtcacagtgtcactgttactactgtttattagtgtcgtgggtaacattttgatttttcaccttggattgatgctaaagagaagcagatcctatccttgtgtttgatatgaataacaaggcttaaaactcacaaaaatgttggcgtaggccgggcacagtggctcacacctgtaatcccagcactttgggaagccaaggcaagaggattgcttgaagcccagcgtctgagaccagcctaggcaacaaagtgagaccccgtctctacaaaaataaaaataaattagccaggcgtggtgacatgcatctacagtcccagctactcgggaggccagggcaggaggatcacttgaacctaggaatttgaggctgcagtgagctatgattgcaccactgcactccagtctgggcaacagaataagattctgtctcttaaaaaaaaaaaaaaaaaatcccagtttttttctggctagcagagtgcctagctaaaagtttcccaggctcccttgcattaagaggtgaccatgtgacgtagttctgactcctaagtgaggagtgtacctagagtggggacttcctataaagctagtcttttcctgagtgaaatggggctgactcattttgtcctttaccattttccctgattctaaagttgtaggctacatgaaggaagaggatagcagtctggtcctgtgagcagctcttctagttcttatcacctgtgaaaagtgaatttgttacgtgtttaagttacctgcaatcaggtttctatttcatgaagccaaaaaccgttctgaatacagatgcttctcaactttcaatggtgttcggtcctgataagctcattgtaagttgaaaataacatattggaaatgcattgaatacgcctcacctaccaaacatcgtgggttagctagcctaccttaaacatgctcagaacacttacattagcctacagttgggcaaaatcatctgttctaacatgaaacctattttataatgaagtgttggatatcttgtacaatttattgagtactgtactaaaaatgaaaaatagattggttgtgtgggtactcaaagtatggtttctactgaatagttagcacctttgcactatctaaagttaaaaatcttaagttgaatcatagcaagtccgggaccatctgtataatgaattgtgcacagaagagcccaaagggaatcattgtcttttgatcaagattgtgtatattttagagaactatcccctggtcaaataatttccacaatattttgtgaaattaagtaatgagcagtattctccagtgttgctcaattagctcttctgcctttcattttgttatgcatctaattaaagaaatgttaccaatcaaatgtctgccagcagctagtcttcttaattctttaagacactgctatcctctgataactcctatttccaccaacaatcctgctataaagtaagaagcagttgagtgtaacgtacaagagaatgaactatggagccagaatacttgagtttgatcctgggctcttcttttttttctttgaaacagggtctcactctgtcacctaggctggtgtatgatttggactcactgcagcctcaacctcctgggcttaagcaatcctcccacatcagcttcctgagtagctaggactacaggcatatgacatgatgcccaactattttttttttattttttgtacagatggggtctcactatgttgcccaggctggtctcaaactcctgggctcaagtgatccacctgcctcagcctcccatagtgctgggattacaggcgtgagccaccgtgctcttcttcctgggctcttctgccatcagctgtgtaaagtctctgcttcactttcctcatctataatatggggataataatggtacttgcctcattaggtttgggaaggattaactgtgttaatgacatataaagcacttcacactgagcatggtctgtagtaagcactatttgtttgctgttgcaactgttacttaggaaatgggcttttactctcaggaaaacacatatgctttcagcatcgccacataggtgcagaaacaagcaaggaatgaaattgaaatcaataaagacaggtttgattctttatacttaacatagatataggagtgtgggaatgcaattctgctgatgccacttccttcattaaatagcttggtctcctaagtattctccataaattacatcacatcatgaactgtttccctttaaattaggagttactgaattcaggataaggcattccagatggcttctataatataaatatttagaatagagtaaatgctgggtagcatgaaatgtcttatttgagagtgacaggtgggtcatggtataaggacctgacctctcaatcaatttcagcctttggtttggtaatttgaaggttttcattttgtacttgcatgaaattctttgaagttcctcatggtttgctttcataaaattcttactgagtctgagtttgcaatactccatggaaatagggcagcttgaacgtctcaaaccttgtctaaaatgttggcatttctgtttacatcaagttatatcttagagggacaggcaagcctgaatcatgatcttaagaactgtaaaggctaggcacagtggcttacatctataatccccacattttgggaagcagagatgggaggatcacttgaggccaggagttcaagaccatcctagacaacacagcgagatgctgtctcttaaaaacactaaaattatccgggcatggtggtcacacacctatagtcccagctactcaggaggctgaggtgggagggttgcttgagcccaggagtttgaggctgcagtgggccatgatcatagcactgcactccagaatcagtgacagagtgagacctcgtctctaaaaaataaaaacatttaaaaaaaaaaaccgtaataggctttgttctaaaacagtggtttttctaatttaagcatatgtagaaagaccctggagcacttcttacagatcctgacctcccctcatagatattttgattcagtagatgtagttgactacaaacccacatttttaccaagtaccccagttgactctgatgcagccatcctttggaaaatattactcttgggctaataaaaaaacagtttggaactccagtatgagttagtttgttactgttaacagtgaagctgtgaaataatttatcatttctgtcagacacagctttatcctggcatttataatgtccattgttcatctatgatcaaataatcattttgtttaaaaggtcatcttgcaggtgtcatattcctaaactgcattctgtccagtgtgtgtgtgtttgtttgtttgtttgtttctttctttctttctttctttctttctttctttctttctttcttttctttctttcttccttccttcctttcttccttcctttcttcctttcttccttcctttcttcctttcttccttcctttcttcctttctttctttgagacagagtctcactctgttgcccaggctggggtgcagtggtgtgatcgtggctcactgcagcctcagcctcctgggttcaagcaattcttctgcctcagcctcctgagtagctgggattacaggcacgtgccatcatgcttggctaatttttgtatttttagtagaggcaggggttcaccatgttggccaggctggtctcgaactcctggcctcaagtgatccacccactttgacctcccaaagtgctgggattacaggcatgagccaccgtgcccagcccctgttcagtgtttcttgacaccagaaagtttcttttcctataggttacacaattctaatttggaaagtttagtacactttaaattcttaacaaagaaatcataaaatcctggtcaataatgttttttttatttgcttgaagacaccatgcaatttgtatttttatatccagagaccagaatctgtagttaaatattctacagaaagacagctttaatggacatttgctgactgtcactatgcaatcatttgccaccaggagtgcattgtcctcaaatataatgggaataaaatacgaactgtgtcactataaatctaaatagcaagaaaatagtaggctagactccccctgcttgctgaggacaccttaatggaaacataaataccataatcacatgctttttgcatgcattttaccactaaagagaaaaatgtcgattttaaaagaaaagacctttgtgaacttgtttcccctcccgttaaaatcagaatccggttgcgtcaaagggaagcctggcaaacacagaacaaaactaattttcttagatataggcacttattaaacatgtgctcttttagaaatgttgggtcatataacaaagttgtatttgctactgaaaaagtcaaataccactttatttatgtttgcttagtattacttacctctgcttttcttgaaatgtgagaaagtaattctcgaaggtagtcaatctcattgtaatgtgagttctgcaagttggtgcctttgctaattaatgtgctccatccaacctgggcctgatctcagtgtccttggctgtctactaatatctctggccttggctagctccttctccattcatgttagcaactcttccaaactttgttggtcccttcagcacaactcagctccagacctctagcccatccacatctgtgcctgggccacttgcctctccttaatagctgaagatcacctttcctccttccaggccagctctctaaacagtcttccagatcccagccccaccacttcaaggcacctgctccgtcagtgtctcctctgagcccctgtcttcagcctctgcctttctactggaacttccatgtaaacatgttaatgtctaccatactgtttaaaaagaaaaaaattggccaggtgtggcagctcacgcctgtaatcccaacactttgggagggtgagtctggaggattgcttgagcccaggagtttgaggccactttgggcaacatggcgaaaacccatctttacaaaaaatttaaaaattaactgggcatggtggtacccacctgtagtctcagctacttggaaggctgacataggaggattgcttgagcccaggagttcgaaatcagcctgggcaacacagtgagaccccgtctctacaaaaaataaaattacctgggcatagtggcacctacctgtagtcacagctacttgggaggctgaggcaggaggatcattgagtccaggagttcgaagcttcagtgagctatggttgttgtaccaatgttctccagcctaggcaacagaatgagaccctgcgctccaacctgggcgataaatgagattctgtctctcaaaaagaaaaaaagaaaaattccctttttaccatctagctatttgcttccctatttttctacttcacttctaattcagacttcttgaaggattattaatacatttgatgtagattgccatatcttctctcccacatctctggttcattcctctcgttgtatgatgggcatgataatgcttccccaaagatgcccacgccctaatttctggaacttgtgaatgttatctcaccaggtgaaaaggaccttcaaatggggaggttttcctggattatccttttgggcccagtgtaatcacaaggctttatcagtgaaagagggaatcagaaggggcagagtcaggaaggaactgaagctgctgccctattgactgaagtcagaggaagggaccatgagccaagggatgcaggtggcttccagtagctggaaaaaaagcgaggaagcagattctcccctcgagcctccggaaggaacttggctctgccaacaccttgattttcacccagttgaaacccatttcagacttctgacccccagaactataatataataaatgtgtgttgtctcaaggcaatacagttgtggtgatttgttgcagtacccatcgtgtatttgtttcctaattgcttcctagaagcatgattcaatgaaacttgagtgctttgcattctagattactctgtggcattcctgaaactctgttctctttgtttttgtggcactgctttccccttcctttgaaactatcctttttttttagagacagaatcttgctctgtcacccaagctggagtcagtggtgcaattatagctcactgcaacctcaaattcctgggcccaagcgcttctcccacctcagcctctcgagtagctgggactacaggtaggtgccaccatgcccagctaattttattttttgtagagacggagtctcactgtgttttgtagacatagggtcttgctatactgccttgaactcctgggttaagcgatcctcccaccttggcctcccgaagcactgagattgtagatgtgagccactgtgtccttttgaactattctttagatgtctctttagaggttctattctactttttcctcttaggttttggatttcctagggaaatagctctggaccactgctatttcctatgtgtttttcttggttaaggttttcactaccattaggcataatgatgcctgatctcactagcccagttctctctttataagccccagatttctccagcaccaccagctgggaatgcacatttcctgtgcctatcagtcacctgatcccaactgatctaaaacagaattcatcattcttcattctaaacctcctctagtttcaacagcctaatctcagcaaacgcaatcacaacccacacatctcaagccagagcctttcttttgtagcctgctccccccgataacagtcagagacaaagccctaccaatttgccattacaagtaattccacatccttctctccttctgtcgtgcggcccatggatactgatggtcgtctcctgacccctctcccatctccagtcttgttctccacaagtccgtatttcacccagtacctggagttttgtacctgaaacaaaatatgaccatgtcattcccttgcttaaaataattctgtggcttattgtctccaagatgcagtctaagccctcagtatggtgtttacgggcctgtaagacatccaatctcaggctaattatatcagactgtgtcatattggttcacatcatactataggatcagtttaaaaggataaatccaattgcatctaatacatgggtgaattacgtggctctttggtgttatacattttgcaaatgttaaattttggtgagttaaaaacaagcaatcaccatccattaagctattctaatatagttagagatgcagcaatgaaattaaaggctgaggtgacataaaacacccaacaaatgaaatcttgaaagtaatgaagccataaataaggtcatggctaattttaaagacttcttgtttaattctttttgttgattaacattgcccgaaaccacaatttgtttgtagaagtaatgtgtaatgggggttgtttatttatgtatttattttagccttagaggaagtttaaatattctgcagaaatgtggggataaatgaaagctgttttagactttggtcgttagcaggcaaataatcctccagcagagtatctgcatttttgttttaatgtctttcccttcatagaccactgaacttttaggtctttaaagagattttaggccattccatgatcaaaatctcctggagctgcctgggatttctttcaattttagccttctaacaaaagctccaagatcctgcttcatgtgcaatttggcacgataactcatctttttattttgacctaatcacttggttctcctgtcctttagacagtacaaacccatggcttcaagtaccaatcttgttggtattttgtgatcttaagtttgtgttattttcttccttgctcctgcataaggatggaatatcaatcaactattaataaaaattcatgaggatttatgtggagtcccattgtgagatgcattttcaacttcttgggagactttatcgagccctaaatccgcaatccagttttaaattaacttcccagatgttctagagcttttccttgggtaccctaagtccttggtgtaaataactatttgattactttctttctcttgttgtttcatgtcttcttccattttttccccaattggttgattttgtgtaactaaaggagatgcagtagttgattttaaaagatacctgttttcttttccaatcaagcaagttgagatatccttagtatttttcattaaaacaggtgtgtacatagaaatgtgaaaattataaactttctgtatcgttacagaacagaaagtaactagataattcatttgttctatggctatgtaataactattttgaatatgcatttcacattgcataaaatggactccaatgttagagtgaattaatgtagattgttgtatatatacatttctgtaaaactgacagatatttttaaactgaattttctgtatcagtttatgcctttcattactagttctattccatagactatatagggggtcttgggttgactctttgagaatacagggatttgaaaatatttgttcctaaaacaaaatgctttgggaccaggtagttgcctccaaggtgattccttttggtgaggtgggtggatgtctcttgcagcttaactgtttttacagactataaatgtaaattaaatatcacttacaggcaagaaactgatcttagcctgagactgcacttccttatcacctttgttttaactgaaagtcctgattgtctccgagagaggccagcctggccctgctccggctgtggtaaccttgccagggtttggggcctgaccaagtgtggagcaaacgacagagcagaagcccatggagctcagctcatgaccaaagctgcagagtgtccagatgaaatggtgaacaccaagttcatgaggccagaggattccctgatgtgcacaaattcggacaaaagcttcagtacttggaattgattgataatgtccatctaagtagaggaaatgatataaagtctgaattagtgaataattagcgaatatgttgaaagatatgatattccgaactttaaagtgtatccagcaactcagatgaaatgcttacactgcttcagttagtaaatctttattttttaaactctattataggttgtttttaattccaattttgaaatcagatttgcttacattttgttttgatgtgattcatgtgttgattccaacaccattggaataaaaagtagttattctaagttcccctcaaatgaatccccctaaaatcttatttatactacaaatgtatatagaaaaatgtacttaatagtggaaaagtacgtttctttataaattttcaaaagctacaaatagtggcgtgtaaaataattataaatcacctctgtgaaaaatactgctttagtttcatgttgacttcatataattctggaattgtgaaaatatatttaaaaataagagtttgtcgtcttccatgaagaaaagtgttatttaaaaggaaaaaagtttgccatttcagaacttactgatgatcatgacctggaaacagttccctccagataaatctgcatgacaaccacctaacagatatctttttcctcttttctctggcctctgctttgattacttaacaggtcattcattaccaggcagaaagtttgaaaagcagtaattttttagtcttctgaaagttatataatacactgaacctgtatcaggtacttagaaggcagtgcagtggtaaaataaaaatttaactccaagtttgtttttaattctattattacctaggatttttaaagaagggaagggcaggatgcaaatggaattggggtgtgctgaggttgtagaggaccagttgagcaaggtacagacaatacaactccaaggggtgctataaaactatagcgtggattggaacacttccggtgattttttttctggcagttggcagccaagtgtcttgaggaatgagggttttctctgtatttcacaaagtcactgtgtggtctgtggcagaaaggagggagatctaaaaaatgatttaaatcgtaaattattagaatttggttgcaacagaatttgtgggggagggttttgggggttttgcaagctattagcataatttaaaaaatacctgctttgtaacaaaaactaaagctgattgaggttacagacttctagttattcttttccttctatttccttctttcctttggtctgtatgtttcagccctgtgaaatagtcaagggtttaaagtctttgcacaagcccagagttcttgtacacatctgtctgtcagtgtatctggcagcctttgtgactgattactcacttccccacaatttgactgtgggccaagaattgtggtaggtgcctgtggtagggatggaaatgaataagacctattcacccctcagggtcaccccacctggtatcacatagcagaccacactcaatacattgtgtacagagtgataagaattaaataggatgctaaggagactgactcaggttgaggaaggatgggcttctaaggggtgatgtgcttgagctgcatcctgaattcctaaatgggaaagagctaaatttttatacacacacacacacacacacacacacacacacacacacacacgtttacctacctagatgttaatactcacctttcatcactatttttaaatgttgattacacaattacaatgacaaaaagagagatcatagatgttataacaaatgtaactttatcttaatttttttgtttgtttttgtttttgtttttgtttttgtttttgagacagagtcttgctctgtcgcccaggctggagtgcagtggtgcgatctcggctcactgcaagctctgcctcctgggttcacgccattcttctgcctcagcctcctgagtagctgggactacagcacgtgccaccatgcccagctaatttttgtatttttagtagagatagggtttcgccatgttggccaggctggtctcgaacgcctgatcttgtgatccacccgccttggcctcccaaagtgctggaattataggagtgagccaccactcccggccttaaaatttttttagtttgtttgtattcatcaggtacaagtgcagtgttgctacattggtatattatattgtgggaagtcagggccttcagtgcacccatcactggagcaatgtgcgtgctgtacccaccgagtaacttctcatcatccagccccctcccactcccacgcttccaagtctctgctgcccgtcataccacactctgcttctgtgtgtccacattattaaggtcccacttatgagtgacaacatgctgacctagttttgacagacaggggacctagttaaggtactggatttatatcttcctggtaaatattaaatatgatgaacactttactgtgaaagttcctagatacctcttgccctgaaaagccactggcagacagctgtgtcttctctgagtggtcgtctgattctttgaaactttctatgatatttcagcaattaaggattgcttagcctctacactcatggtgtcctgaaacctcaggtagctgaggccttaagacctgcgggataatgagggagagccaggccatgaagagatgctgcagaccctccaaggtagcaaccagatggcttctaggcctcaggtaccgtggctcatcactgtgggtggtgattgtgactgtatggatcagttccagagtaggtctgtcagaatatcaatgtctttaatatagttttaagcatttgaagaatttaacattcttggtttggccattcatgactgtgaatgacacatgatttacagtattgctagggcctgtaggctttgctggagcatgaggggttaaagaactaatgtgagtcaaggacagtatctgttgcgcacctacttgacacaaactactttactaggccatttcagatacacagacaaatgtcgtaaagtaatgattgagtccacaccttccttctgatatttatttgtaaggaattttatttgcatctgggagagttccattagtctctctttgtaacagacaaatctaaaacctactcccacagtttcttgtaaagaccagcacatctttgaattgtcttggttttttaataagatttccagcttttataccagatcaaggcaaactggatgtaaatatagcgttatccttgctgaacactgttgcagaccaacaggttcacagtttcctacatcctacccatttataactgaaacagtatgtcagttgatttttaaaagtgcaggtggttttctgatcgttcactatgatttcctttacagcaagggcatgagagcaccatttccccacttttatatctagtccgttcttgaaaatgtgtaacaaatgactatgcatatatatatatatagacatacatacacacatacacatatatataaagttatatatatacacacacataaacatatatattcacagaagttgtgttctcagaataatagtaaaataaacaatgatgcttcatgcaggcactggtgataaactccactgtgtcgggatgatccagggctgagacacagatcagcaagggccgctgccatttccctttcagatcactgtagagacaggtgtgtgcagacaggaagcacccttttccattaactgtctctcctgacccctctctggactctgccagcgcttgcccatggccatcagggttaagtttgcctgtgtggcttccaaggagagcaacggggaagggagaggaaggacgaggagataacaagttggttggcagcccaggcaaattctgggacgtcacaggagcctcagtccttaggagggagtgagtcagaggtgcttctgcatggaatgtcacactctcaggagcacacacctgtagggacctcagctgcctctgaggggcctggctctgtccccaaagcacagcagctgggggcaggcaggcagcaccaccacgcagtgactggtgttagttgacgtgaccacacgcaggtaatttaaaagtgcagctctcccctccccctccccagcacaccctgactcccttccctgccttctttttcttgctagtccttatggcattatgatgcggcataaatgcactttaaaaatgttatcatccgtctcctccaactagaatgaagttgcattttggagcggggcagggggtgttgtctgttgtctgtttcattcactgctgtattccaagttctaccacacagacattcaaatatgttcaataaattaaggaatggataaaccaaactcctcatcagcacagcaaagacagtttatgggatgtatgtgtgataagactgtaagctgtgtaggagcagagagagcctgtttttagaaaagaaacctggagtttctgtcagcaaaatgcagttaaacattttaagtgttaaagtcccttttgcttattgtatgttaaacttataattcttgtaggtttcttagaacttgtatagttttgagagagagagagagggggaagagcaaaagaggatttgatacaacaccataccataagatgataaggtaagatgtgatgtaggtatttttaagagcacaggctctgaagccagcttaagttcacatcccagctctgccatttaaccttctgtgccttacttcttgtatctgcaaaacggggataataacacttacctcactggggtttttttgtgagcatgacatgaatgactacatgtaaggcactttgaacactgcctggcacacagagcagtcccataaatgttagttgctattgttcgtatgatgccaccactaccatcaccgtcgtctttgttcttgagttctaagggcatttcaaagctaaaaggtttgccacagagattgtttttgcatgggtatgatattggattctgtatcttatttttagcatcttttatgtgtaaacaccacttaagttagatttgtcacctttgtatttcatgatacaactgatgtctgtacctctttaccttacatactgctgctaaaatgggcatggttatggacatttgattaatttctgtaattaggaagcgtcttaatctttagtaatttggtatagtatttcacttgaatagctaaagattaatttccataacaggagactaaggtgaaagaggtttatgatattagaggatgtgattgaagatcgtgcaggcctcaggcctggagtcagattctctcagagcttgtgatgcaacctgggtaattctcactcttaagagagaactgctttcctcctggaagtgtggaggggaatgataaggccgtcttcaatagctgtatgatatatttaaataaaatctgccatagaattgcataatattagtattataaatgccttgtatcattatatgataattaaaataagttctatgttaataaatatgtagtgtactattattgatgtttgctttatggtaaacaggaaacatcttgagtgatttttttttttttatttccagcttggaaatgataaacaaaatctgaaaaggggcttacttttttttcttttattactgagtatgtctgtttctggcacattttttccacttacctgggtcaactacatacatatctcctaaaatgaagtctctgtatacccaagggtagctaaatgcccgtcaaggaataaatgaatgcatttgagttgttttaattagctaggtatgatttaaaggttgctgaaatcaaaaagccttattcatttttcatcaataatcacttaccttaatatttcattagaacctgctgatttgcagactccttctgggctttgattcattatgactgcagacataatttaactttctctctttttctcgttctgtattatgctctttcatctctgagacactattaagatgtttccagcattcagaaggctgctaattgatccaactttttttttctttttttaactgtacttaaagctaagagttctaggctgtggaaagctgtgtgtgtgtggagggggagcagttttctttaattctttaaacagctgataataacgtgtaaattttctatttcatatgttccaagaattaggatggacttattgtatgcagcaggcaggaagtacatagtttggccacattcttaagagtatgccatcaattggaaagaacaaagcatctcgtgtgtggcatgctcaccagatgagattgctatccatgcatataccttattttcaaaatatttctctagttgctttagatgcagcctagcatgtggcctcggatgtgcagcgtgcctggtggactcaggtagtgactgctatcccaggcatctgtgctgccacctagggagtatggctctcatgcggagaagttgagagatgggccctcagattaataggatgcttgtgcagaaaagagccattcttcttcttaaactgtgcctttatatgaatgatcagatcagagccagagacagaccatacagggtgggggacatatggttggaacttcttaaaagccaaaattccaggcacctgtctttaaacacagttatatcttagttttttgggggagagtagctaatctaaaacttaaaaatatacccagcacggactggaattctgactggctgatgctggcaatgagaaaagaaaatagataaatgtgtaaataggtatttttcatttcttccagattatgaaatgctgcatgtctgtcttttataaccatgttaaatggtttgtatgaagtgcatattattaactttcactagctgtgccagttttgatgccgagtaaaaattcctaaatgttaaggaataaatttgtgtccttaaaagcttggtaaatgcaggctgagcatgctggctcatgcctgtaatcccagcactttgggaggctgaggtgggaggattgcttgaagccaggagtttgagaccagcctgggcaacataatgagatgtctactgttaaaaattagaaatgaaaaaatttggtagatgtagatgtatatgtattcagaagtgtaagtatattcattggactagaccttttattaacttattgatactttccaggaaacgtaatgctggtctcccttaccactagatttctgtttcaaacacaagtctaaaaaaaattaaggagccaccaatataaatatctactgatggagaattaaaagaactcttatgtgttaagagattttaaccaccatttaaaattatcaatccccggttaactaaggctgctcttcacattttgcttacctttggaatatttattgatagtgctttctaacactttgtgtgtgtgtgtgttggagttaacatggcttgctttgtgtgagtatgaattttaatactattctttgtttatgatgatcttcaggattctggaagaagttttcagtatagactgtctcttcattgggccttaactttgtgatctcagcctgcctttgcggcttcacagccatttttctacctgtgtgtgcaggtgtgtgctggtgctgggaggtgctattgtagacagagcatgaggcattggattcagatcctggctctgccacttaacttggatgttgggcaagttatctgacctctgtgagcctcattatattcatctgtatttccatttttttgtcctattgttagaccatatgtcagctgtgtcctgatttttatatttagagaatatgttcttgccatgcatcatgatctgtgttagaagctattggggttgaaagagaaaaacagattcaatttctgatagtaatgttcttccagtcttttgggagataacagacggacttaaataacaccaccagttttattgaccatgctgtttattttaatagctaggccagaatggtttgattgacttttgaaaaatctggtatttttttttaccatatggacaaggccatatctggagtgccaagctaataagccttcttttctctgccagtgaaccatgaaagttgttagcaaaatgttttatcttgaattgatccattttccaagctcttggtgatataaacacccatcttaagggataaaatgcagattatctttcatcagtcattggaaatttgttgcattaaagaactgtaggcaactggtatgtgaaatgatctagaaaggaatgtacctagtgtggttggggatgcctaaaaatgtgtaggactcccgtaaatcagttacttatcagtacaaagcacaggtcacattattttgaatgatgttgtaatacttgaacgtaaaaaatgggagtatagtagtacttaattgtaacatttttcttaaacagttaaggtttaaaggaagatgaccgtacttttccgattattaacaaaaggtccaatgtatacaccattctgagtcagaataccaccaatttctgtgtctagcaatgaaacaatgtaaccagtattagttgtctttcaatctaatcagtgaattaagtattcattccatcccaagcctccttgttaccatcaaaatatttgtatctttcatttctctcctctttatgttcctgtttttctttatgttctttagcatgtatttgaagcatctttttaaaaattctttttcctctgattctatcatcactgtcctttctgggtctgtttttgtgttttttgttttgtttgttttgtttctttcagagtcgctgtgtcacgcaggctggagtgcagtggcgtgatcttggctcattgcaacctccgcctcccaggttcaagcaattctcctgcctcagtctcctaaatagctggcattacaggtgtctgccaccatgcccggctaatttttgtatttttagtagagatgaggtttcaccatgttggccaggctggtctcgaactcctgacctcaggtgatccacccaccttggcctcccacagtgctgggattacaggtgtgaaccaccatgtctatcctgtctgtttctattgattgatttttctcctgattgtggccacatttccctcttcctttctatgtctaataattttttatcagatgtcagacattatacattttgtattactgagggcttgggtttcatttttttttttcctttggaaggaggctcttgctctgatacccaagttggagtgtggtggctcactgcagcctcacactcttgggctccagcagtcctcccacctcagcctcctgagtagctgggactacaggcatgcaccaccacacctggcttcattgtattttgtgtgtgttggatctttcctggcaggcagttaagttacatgctaatcttttatatttaaattaccttttaatcgcttttagaccagttgcagagtaactttcattctaaggcctaatttagccccatttccaaggcgtagccctccttgactgaataccctgggtattcagtccatgcagtctcctcctctgcgtgggtactatcagggtgcccacagttgttcatcttacggccgcctggtatttattcttttcacaaaagttgttcttgtctgggcttataggattttcccttactcatgcccagggtgggaatcaaagactgaagagggcccgtgctgatttctggagctctttctctgtgtagttctctcctctcaggtcatctgtctaaagatgctgaccaccttagcctcccagattcataattctgtcccctcaactcagggtggctgcagtgtggtttggttttgctccctgcactgcagtgcccagaaagccaaggtgatggtggggcaccccttctttttttccttttctcaggggttacagtcttagccatcttggtccccagttcctgctgaaaatagttgtttcctatttttgactagttttctagttgcttatagtaggaagttaattctggactactgtatcttcttattgctggaagtggaaatctcttaaaatatatttgaacaactgttctgccaaaggcttctaccatctctttacctcattcttactcttaaaccccttaaaatgggcttcagcccctctctactgaagaaaattcttttcaggtgacaaaattgccaaatctggaggccatcaggaaaatgtgtccacatttgacttataggacacccttcttccttggtcactagtgctctcctgtgtcttcactgctgatccccaccttttggggagttcatttgtccctgttgtgattctcacgtgcctacacccttgtctatgtttctccctgtcacgtcttcagctgtcactggtatgatttccattgacactgtagtagtgccgctctgtggcacacaccaagcctggctctgcacacatgtctctgggcatcctgacagcatcacgaactcaacggggacagatctggtggggtctttattatccagaccgtggctgccactgtgtaccatctctctgctcttttcaccagcaccctgtccatctcctgtgctcttcttgcttctccgtccttagccctcatacctagttccggagtgttattgattctatttctatactttttctcagatcagttcttctccacacattccttgttttgttttgttttgttttgttttgttttgttttgtttcagggatgtattaccccttgtctggcataatgaagtcacagcatttacgtgtccacacctgtctcagcccccttgatccctcttagtcctgtctgttacctttctaaattctagtcagggtggcctcactcaccctctccaaagaacgacggcagaatcaagtccaacttacttggcgtggcattctcattctagggaagcactgctgactcaatccccagtatttatcctcattgaaactagtcacctagggctctttcccatcccatattgcgtcaagcattttcctacccccgttacgtatgccttctcatcagtgtggaacgccctgctgcagccctctcctgattctccaatgccatcttttctgcaaatttagtacttttagttggaatgaatctcttcctatcctcagatctgacagagtttgtatgtctgctaagacttccttgggtgtctaaacaggattgttaaaagctatctgtatccgctccactttttgcagtttgtacttttccctgtgttctcccgacatcttctttggtgatgttgggaagtcattaaggcacttcctgagatctgtttttaggactcacactgctgctagaaaacagtctcatacatagggctgtggggtcactgtgtacaaggcaagctctcctgtaaggaaataagaacttatcttaaggagataaggataaggaccatgccttaattcacccttatcccctccaaattcatgtgtacatttttggagaatttaaaggcagtatgtaagatgaatgaatgaaaaatgatgacttcaagatacttaataactcgattcatttatttaagaagattcctttatatagcatgtgaactcagcatgtaagaatgattcaatttttaaaattagattgtataagatttttagtaacatatcaatgacatgggacagaatatatcactttacaaatctattattacactgtaattttttgctaggacttctttcctcaaaaataaccataattcagaattgataacgttgcatttttttcttggtgaatttcttaagccagtggtcatgatataatatcctcctgatactgctggattcaagaacaggtatcaaaaggaaacaaagtatgtaggttattttgaggcccttcagtatctctgttcgtctgtgttttcttcctgggccgttattcaggcaagactgggcactatgtttaactaggcgcaacattttgctgatttcctttaaatgtttcctgagtaagaaatatattatcccttaatcagcctcttttgagatgtctgtttatagtaaacaaaatcttacttcaattagtttcaaattctaagcgaaactactggtaattcgacattgtctaaagtaacatcctgttactgtactgcaatattgaagttgaggtgcaatagaaacagatattaagcttattaccacatttatcaatttattggtattctttaactgatcagccacataggaaaactaatactgacaaggaatttttcttttctcaaacttaagcactgagaatttgggaagcttaacacctttctcttcttatctgtaaaactagataactgtatacaaataaataattatagtcactatcttgtagggttgttgtgcaggatgaatgatctaacctagctaaaacatttgtcatagtgactgcttgcagtattatacatatatttaattatggcgcaggtcaaatttgatgactatatacatatatatatatatttgagatggagtctcgccctgtcacccaggctggggtgcagtggcacaatcttggcttactgtaacctccgcctcctgggttcaagcaattctcctgctcagtgcgcgccgacacacccagccaatttttgtattttttgtagagacggggcttcaccatgttagccaggctggtctggaactcctgacctcgtgatccatccaccttggcctcccaaagtgctgggattacaggcatgagcaaccgtgcctggccatattatgatttttaaaaaatccttaaagtaagtagatcttcagacttcaatgagtagctcagttacttgaagaagcatttcgttttagcacatcataaaatattggacaacatctcggagtttattttaaatggaatttaatctgtaaaaactgcgggccatctatggagtaaacaaaatgaaataatctctgaatgtgatgtattgggcaatgtacttaatatatgttacatatgcataaggatgatttgcatctatctagtgttttccaggtcctttgttttgaatgtgggcatcaggtgggatgagagcatttcaaatttgaactgtcagtacgtgaaccaccgtaacattaattggcagtagtatttcataatgtgtgtgatctgttatagtggtaaaatagattatttttagattcccaatataaaattgttttctcactaggtaattataattggttctgtgtgtaacacaaattttaaatattgtatgttattagttaacaccagcgcaacacagatactaacaagatagaaatgcaaatggattttctgtttcttaaactgtggctacaaatggagaattggttccataaattatggttattatcattttttgagatgaagtcttggtctgttgcccaggttggagtgcaatagtgtgatctcagctcactacaacctccgcctcccagattcaagtgattctccttcctcagcctcccgagtagctgggattacaggtgtgcgccaccacgcccagctaattttttgtatttttagtagaggcagagtttcaccatgttggtcaggctggtctcgaactcctgacctcaaatgatctgcctgcctccacctttcaaagtgtttaaattatttttagtgtgcatactttttacaaggtctttacagtggtcatttctcatggagaggtagttcatacttttgttcgtgaaatattggttttcattaaactttatgttgaaaagcaaacctttagaatcatatatttctgccattttagagctggaaggagcatggtttaacaacccctcattttacgggagttgaactggtctgggggtgtggtgctggggatgaggggtgcagatgaaggtagtcgcctcctaccatcgtctttccttttacggatgtcctctcacatgtgatatggatttggacacctgcaggctagaggggccactgtccttaaataggagtgctgccttggacaaggtcacctgattatcagtagccttttaataaatttataaacaggcatgatcataccaattaaaaaaggaagacagactgatcaagtaaattatatatatgaaagcatgcataaaaacataaagctgtaccagtgtgttatgttccgctatgattataatgacccctgtatactgacctctcccatgagctccaggagtgaattcaaatgcgaagatgtatatgatagcaactttggaaagtagagtatacttgaccatgccagctggttatcataagtatacctggatttaggtatttctgtttaaatgatacctagttaagggtcttacttggacttaaaatgagaagagattttttttttaaaagagactcaatatgcacaatacagatagttataaccatgttgacttgagagttaaacagatacagctgtttgtgagtaagccagacaaatgtgatttgagtgttgaagtactgatgacgcctatttagaacctggtaagaatgctgtggtctgggacttctgggtccatttcttctggcgttggtgttgagacctcgctccctcctgaattccatgtcctccctattactcccacaggctcaagtggtggtagtaccctggagtgcatctgtggccactgtgcagttcgtttcaggttcttgtgaaacatcttgatggcccttcattgcagctgtgattaagacgtgttgccctgctctgtattgagagctcagtctgtttccttcttcttttgcctactacagtgctgctttccattcctctgttctgtgtttttccttttttctctttttatggacctgtctttgctttttcacttctgtgaacactagacaccctgtgccctcccgctgctgaggcccgccaggaccaccgggtctcccaccaccctcccctccaccggtgctccccagtgttcactgtccagccacgctggcctccttgcactccttgactaggccaaatgtagagtcctaggctgctagtgcccctgcccttgccatttcatctgctgggtgtcctgctctggatcttgaaatgactggcatcttcctgttatccaggctcagctcagagtttcctctttagcatggtctacctgatgtcctgtctaaagcacaagccaagccccaccacagacacgtcctctcaagcgcatggtccctcttgaatgctttttatacatagatccatatctcacattgccctgttcatccctgtgtttttctatttctgattctgccctcttaagtgtaactctaggagagcagagaccccatctgtcctgtaaagctgtgtgtctgcaagccccgaaacagcggctggcagacggtggctgctcagttgacactggtttcatggatgtgtgtgtgcagggtgtgggctcctcacccctgagcgtctctttgtttggtggtgcacgctcaggcagtttctgtctgtgttgtctgctcgaggtccttctctctatagttttgagctctgcttggtgggagggactgtttacctctcctcagaaaatcttgctctggagacaggaagggggaggttggggaaaaggaggctgactcctgggtgtgccaccaagaagacatctccaccaggaagcaaaacaagccctctctttatggtgcttcctgtttcttatttttaaagcaacttcttttcaccaaatccaaaaatcccaccttacctcaaggcagctataattaaaagcctgtctgtcaaagattttgctattcagaatttcacatgccttctgaaaaactaaaactcctgaaaattgttatcattgaatacaaaaatagaatgatccctttgactaaagcttaaaattatctgaatatgaaagtgatacttttttgtataaaacttacaaaacataggaaagggaaaagatcatccagcccccaaaacaataatttttaatattttagagtatatgcttagacacatacagttatttgcacatctgtacttactcagaactgaaaataaaatcatactctacataactctttagtaatgtgccctcttacctaataagtcacgaacatctttccagaccacgctgtattctcttacgagaacattttttaagtggctgcatgatctttcattttatggatttatctcgatcaagttgcttaacctctaagcctcggtttcttggtctgtaaaagggaatcataattgtgccttaaacaacctaaaggaattagacgggggtcatacgctaaatcactgagaatgttcctgtcacataggattgctcagtgattgttagctgctgcttctgtttatccaatttcctactatcttgtaacaacttaaaatgaactatgacagatgtccatgatctatcctatttcctgccaataaaatatttttaaactctaaaaatactcatattttttcattttcagataatattatcaaaagatggtagggtatttctacttaaggcaaacaccaattttttttttttttttgagatggagtgtcactccattgcccaggctagaatgcaatggcgcgttattggctcactgcaaactccacctcctaggttcaagtgattctcttgtcgcagtctcctgagtagctgggatcacaggcacacgtcaccatgcccggctacttttttgtatttttagcagagatgaagttttaccaggttggtcaggctggtctcaaactcctgacctcaagtgatccacccgcctcggcctcccaaagtgctgagattacaggcatgagccaccataccaggcccacaaacaccaatttttaaaaactttggttttagcagaaagatcttaggggaaccaggattccatctgaaagtagacttcagcccacttctctcagtctgtgtctgcctctgccttgacacttcttcccctgagccctctgctcaaggcggaggctccgcttttggtactgatgtccaccaggctgtttcagaaagaagccagtgagcacccttccatcggccaccgtgcctagagctgttctccacattctctttttgcttatcctctcagcactcagtgggctgccagcctcaggatggtgttagattaaagaaatggcctatcagagcttagtaattcaccagttctctttaagaattcacatgaccttaaataaaatgttcgatttaacttaaaacaaatcatgtcaagcatgtaagcaaacaaattccgaaatggtgaactgtttctcttattttagattattttcttaaaatacccatctgtatttgtaatgaaggtctattctccttttaaaatatgtcagtgctcttaaactggtggcatgaggaagaaaaaaaagtttaaaataaaatatgtcagtgttaaatttctattctgaagttatgtatatttaaaaccatgtatattcatggctgtacagtgcagttattaagagctggaaaaaatgctgcttatttttaatcaggttgacacagtggatttattaggattttcctccattttatgagttactcagaatctttcttataggaggtggagtgagttagaagagagacgtattccttcaggttagagtcatcttccaagtgagtgtctattcccgtcaccactgtttctctgagattttaaagtgttcagcactgcatggttttttaaaaagcatttcctgtgattttcaaaatattttcttaggctttttttttaagggcatgtatttctctttcttagtcaaaaccgattgttggctaccagcttctttgtctgggacccctatgtgtgggagatgtttgggactaagggagtttgttagccctactgacatttgtattgtttaagtggaactagctattgaaaaatgctaacacaaaacctcagctattcttttattaatgtattaaaaattctgaccaaattaaaacaaccaggagagccttgttgagcctgaatctgttaggctatgaaatgcaccctgggttttgaggaagaagtgagcacatttatagccttaattactcatttgggatactacagtctgttgccaaagccagttatcatcagctttgattagaaatcaggaaagacagctgctgaaatgcagagtgaaaagaattgtattggattagagtggcgttcttttgaatctgaaagagaaggaaagcatctttgggaaacatctgaatatgcatttattttaataattcaatggctagaggtggagtacagtacattgtaagttggagtggttttcattattaaattaagtgcctttgtttagttcatctagattttcctattggctgctgcttttttctctttttgctccattttgatgcaatgttatattcctatttgtgggttgaaatatgtcagtattcataaactaaattcatggaccacccttcccatcatttggcctgatgaaacaccatttaccagtgtgaagccaagccaggagacgcatataaaatactgcatccaaatgctaagtttaaaaagacaacatgcttaattcccaatcctacgtacatggagaagtactactttgagctttattattttaacaatgtaatgtggggttataatatatatcagaataatgtcctaatcaaatgtccctgagtaaatcaaaatttcagagttatattcacttgtatatgttcatagtttatgtaatcaaaagatgtgtcaggaagatttacttcctgccttttgaaagctgtttgagatattgtatggaaatttacatatgagtatttcccccatccttaattaaacttgttaaacagcagcatttctcctatttctacaaaaaactatcatggttgttaaaaaatatatatacagtgcgtatagaagtacacctaacccttaactaaataaataagaatagttgtgtttatattcatatttgcaggagagtaaacatttatgcaaatacactgaagaaaattatcaaacactttgtctccatgtgctctagcttcaaagttaaagctgagaattttcacccagttatttaactctaggcagtgtagtgcttaaacaaaacaaagataacattctgtacctacacaatggatcaaaacagcttccttcatcctcactttggaccatctgtttaaaagaaactaaaaaccctcaggaagcaagcctctcatctgtggttaagagtttacagacacatgctcattctcacaacccagcaatgtgtatcgagggctgtaataggttttgtattagctgtaaaaggctagttgtcttgacctcagcatctgtccgttacagcttctctgttattcggataaatttaaacactctttttgtagaggatctaattttatggtattttaacgtcaactttgataaatattgggaataatattttccaagagctaaattattcttagtttccccatccttttaagaaccctaattctcactctccccctgcactcccttgatgaaaagagttgcagtcatccagacttattggagaatagacttgattggtgctaagagaattgtgaaggtctttagccccacattatttcttattgaatcccactaaaacttttgaaaatttcacattggtttaagagatttggacatctgttaacgttttccgtcttgagtactagcatgggtctaggtctgttccttcctgtaaactagttgttgcaaggcggtcagggttgcaagacaatttttccataataccaaacaggaaaaacaacagtagcgcaacaaaaggtttctaccttgctaaaaggaaaagaatatttttataattaaagcttttagttatttgtcatatactcattatcggaaaatgttgttatctttagtcctgtattgacacaaatgtgttacgtgttctttattatagttgtggaaaactttagtaaaggtggtattaaagtagtcccggtcaggcagccctggaaactgaaataaatggaataagagtgggaaataaaaaaataagcttcaatatctgtgtttagcccagtaaatggtgtctattactacagatgcagttttcttttatggatatcactggacagacagtaggctgtgtagattgtgaaatttagtcatcatctctccagtaagtgctctctctccccatttccttagatcataagctgtaggttacccatattatagccgtcacataccccaaaactagccttgtacttcaatagatggttggattaggtataatctccaaggtctttttaaactctgattccaacatttggcattcaccagctatagagaagatgacattgtcctagtgacacccttttagttgtgcagagttttctcggtatctctgttaattcaaatacttttaaaagtgtttgaatatacttatatggttggatatttttagagagaaataccatgtttggaaacatttcagctggaaaatgcattgaactggatattgtcagacattttctgagaacaaatcaaaatcgtttagtacaatgtaaaatataaaagacatgcaaaagccagagcaattattgcaaccttccttcttcatacatatgcatacctgactcacattcagaccagtaagaccacaagtggatatcattagtcagaactcggcaagatccaatttcatgccagtcacattcacacacacacatttgtttgtttatgtcagtcattagaactcagtaactaaacgtcagtggtagttaatgtggcgttttataaacacatagatgaattggggaaaaaaagcaaattatccacaaatagccaccaattgcaaataatgccatatccatcacaaaaatatctatgagtaggagagaacacgacaagggcaaacaatttgaatgaggttatacaaaaagtcaatgtggtcgactctggaagcatgcctagaatcttaccaacctatgagctgattctcacccaagtcattgtcatgtttagcagcagaattgggctgactgcaaatctctccgatgcttcagccctgacattagcttttatagttccaggaagatttgttgggaatttcaacctagtaatttaagaagcttttatagttctataacataataattttacctttaaaaaatgaatgaagaaaatatggcaaaacttaataaattcacattaagcaggagaaagacctaactaaattagtaatctgaattgtagaatatttttaaaaaattaatagtaacttaattactgtcagattcatggagttccttggagaaattgctttggcaaatagataaggaaaatttacaaatagcacaaaacttggtaaataaagcaatttctaaagaatccgccatggactagtatttttaagttattttctccataaagtgcatgtatgttatcaatttgccttgcaaaatcatttttataagaaagagagctatttctgtttttaccaattatttgtggtatttgaaagtcattcatttacaaaaacataagaatgatatccatttactcattcattcattcattgagcaaatatatattggaggtcactgtgctgggtacatagtggtgagttcaataaagtccttgccttttctagcatgggggatgggagttaactaaaaaataaaataaatgaataaatattttgtaatacattatgataagagcataatcaaggtgctgaataatttctttgggaagatgacatttggctgagtactgaaggatgcaaagaagtcattcatgcagagaagggaggaaagagccacccaggcagaagggagctatgtggacaaagcaaaaggctgggagatgtttagcatgggccagaaactagaaggtagtcagtgtggctacagtgtgttgagtggtatgggaagaaatcagagaggtatgtggcagatgaacctaccgaggcaaagctaaaatatgaaattttattccggatgtcatagggagccatatagtgttctttagattgtgagcatagtctgattcataattttgaaacatcccaatggctttttatgagggaaactgattacaaagtagttgtatcagccaaagtagttatatcagtagttatatcacaaattgattacaaagtagttatgtatcagtagttatatcagaaattgattacaaagtagttacgtatcagtagttatatcagaaattgattacaaagtagttacatcagccaaagtagttttatcagtagttgtatcagaaattgattacaaagtagttctatatcagtagttatatcagaaattgcactaggtacttcaaacagatgagatttagtataggggcttggttacacaggtgttggaagtagaagaaaaaggcaacacagggtaactggagataataactgcagaaggcagctcccacatcacagtgcagagtgtaaagggccaccttggagctcagagacagacagtaggtgaatatccagcacagtgggcagccttgaggcagggaagcctgtgtgagggagctgctgctgctcctgggacagaatcatggaggcttgcactaggaggtgggatgggatagaaataaatagacgagagagcgattttaaacctagagcctataggacctgatgcttattgggtaggaaataaaaaatgactggcaagattctgacttgaacaactaaatatctggggcactgctttttgagatgcagaaagcaagagaaacaggcttagagcattgtaagtgttgagtttagaacatgctgagtttgagatgtcaagcaaatggttagatatgtgaatatggtggacagagaagacatgtagactggagttatggatgtggaaatcaacatgcagatggtatttaaaaccatggaaatggacgatatcatcgagggagagaatggaagagagagaagggctagttctgagcccttgggaatctcctgtgttgagagatcagtacagaagcgacaaggagcaaaggaaactgagatggggtagcaggaataatagaaatcaagagaatgcagtcctatagaaaccaagacaggaaggaggcagcagtccactgtttctagcggacctaagagatgcttaagatgtaacagaatgatgtccatggatttagctacatgaggatatctggctacacgcctgatggggtagtaggctgaagagtttacgggaggcaagggcactccattctgacacagagagtccaagggaatgtaaaggccaaattgtttcctcagttcagggcctacttggagctaggcaaaaaaaaaaaaaaaaaaaaaattaacatttgaggatgggccgggcacggtggctcaggcctgtaatcccagagctttgggaggctgagactggaggattgctggaggcccaggagtttgagaccagccttggcaacatagcgagatctcgtcactacaaaaaattaaaaaattagccacacgtgatggcatgtgcctgtagtcctagctacttgtggggctgagatgggagaattgcatgagcctagcagttcaaagttacagtgagctatgatcacaccattgcactcccgcttgggcaatacagcaagactttgtctctaaaagaaaaaaggaaaacatttgactatacctgccaggaggcaacaatcctacctacccttcccagttactttctctatattgtaatttggggaccaagttcttgtttgtattgcacaatattcctttatgattttcgtgttgaactttcttccaacatactgttctataaaagaggaacatttcattcacgtgtataaaagtcatcttgtttgaaaaatctcagaagataagttgttgggattttaagtcctgattaaaggtttgcctctcgtgaggtctaaagagaagcccacatggccgtgttttaccaggtttcctaaactgtttaggtgtgtgctgtgacgctgcagagcagagatgttactgtgaccttttcaagctcccctttctgtctgtcatatccaggtccagtcatctttaccaaatagatagggtcataaaattgcaattgactggagtccttggaagaaacattttgtgagttttatcagtcccccaaatatctcatatctggactaatagtataatttagatattgctattgaatacctataagacgtggtatctggtaatattatctcagcagcattaacctctgactctgctctcaaaccaggattgggaaagtgaagtatttgcttaatgattgattaatatttggacctttattcgagttctgtgaagcgcctaacatagcgctgagtgtttcggcctattatctcttggtatgtaagttatctcttagtttgctttgctgctataattaaggagataagaacagaaagcctatttcttggtcaaagtgctatttttataggaggacaaaacatgtattgttttactttactatcaacaggccacactgctgatcactaaggttgtgtttaataagtatgttctcttgggccagaatgtcaaatatatccctaatgagttcagtgacatcactgagcgtgcttatgttccttgccaatagtcggcattgttggagcagatgacattagctgtcatctgagcacagatgcgaaggtcagggcgttaacaagcaagagagcttcaagagagaaaaaaaaaagatgaagatttaaagcaaatctgtccatgtcagagaacaatgagtggctgtttagggggagtggtagagacattcaagagaagacatttgcctcatacaagttttctgcacatctctgccctgtggaaattgcgtcagttagagatggacctgaaagatgatcatctgtaagccacagctgccactttgaatgtcgaggtttggaatatgccatagacagccctgacattctaaaattgattgaaattttgtgaccttcagaggtaactaatatatttccagtagtgtgacttctggaagtaatatagttcaggaaccaaaagttgattctttgtagttaatgaacaagttcttttttttttttttttttttttgcctaagattatattaataacactagtgtatgtcaaaaggaaaaaatatctcatgtatatattttttcctgtaagaatagagtatataaagctattttaataaattttgttgaacatgtatatatatgtggatgtctaaaacaaatatgacaaactgagaaatttttgtggctaggatgaacctccgcttttggatacaactggagtaacctgagtttcagttggggttttcttttttaagatacagggtctcgctctgtcacccaggctggaatgctagtggtgcgattatagctcactgcagccttgaactcctgaactcaagagatcttcccacctcagtcttccaagtagctgggactgtatcctcaccccaatgcccagctatgtttaaattttttgataaagatgaggtctcattgtgttgcccaggctgctctcaaactcctggcctcaagtgatcctcccgccctagcctcccaaagcactgggattatgggcgtgagccaccacaccaatcccagcccctagtttgtttttttaagttgccagttgtacaatttcctctctgctctccaaacttgttattttagaatagagagaaaaagagtttctagctttcctggtggttggtttgcattgagaaggaaaaggccaaaatatgacaagacatcctcagtattcagttgactaaaggaaaaataatttggaggaggtagagccagtccagacctatagtcaggtgactagtgggagtcgctaggtatggaaaactttcagtctatttcttctctagatattggccgtattgagatgtctttgtacattgctttttggcaaatatagacaaaatacttaactttaccagtgtgagtttagaacggaatctgccttcatgcagaggtctggagtagaggtagaaggggatgatggaagaggcacaaagttcttccaggtagtacctgctgctgctgggtggaccaggccctggtgtgtttctccctgctcaggaaatccacatgttgaggctttcctgatttctgtggctgggtaggtttatgttctatggtatgtatttatttattggttacagtctttgatttgtggttgctcaatgtattaaatagaaacagaaggccacattgtttcctcagctcagggcctccccagagctgggcaaggaaaggttattcatatttgacactaatgtatttgccttttctgtcgcacctcattgctgcccaagtgtataaatgtgaactaacgcttcagtatttttaaactgtccaaatgcaaataggaattcgtttgagagccacatgacaaaagctagatgaatagttctcacttaagacttttatgtaagaaaaggtactaaaatgcacaaattggatgaataaaatgaaagacatgtttctttgttgcatcagcacttcactcattctctcctttggttatttgtttgcttgttcattcattgcccagtaacaaaaacaacaaaaattgattaggtgtactgaaaacataagaaatatgaggcagaacagagtttgtgacctggagtttttgagcaggttgaacacacacacacacacacacacacacgcaccctcaactagagaagaattatgatgggacgtatgaacaagagcaaaatgatagtattaaagaggcatatttaggcataacagttgtggaatgtatttaaaaagaagagttggggccagatgtggctcacacctgtaatcctagcgctttgggaggtcagggtaggagaatcactcaatgtcagaagttcagagaccagcctgggtcacatagcaagaccctatcactagaataaaattctacactacaataaaaattctaaaattctaaaattagctgcgcatagtggtacacacctgtagtcccagcttactcaggaggccaaggtgggagaattgcttgagcccaggagttcaaggctgcagtgagctgtgatcatgccactgtactccagcctgggtgacagagcaaggttctgtctctaaataaaataaggaggaggaaaattttttaagctgtatttggaggagaggcatctcatgcagaagcagtcatatagctgatgctgagaagctgggcttggtgatcccattggctaggcgtgtggctgttgtgaggactgagtcaaagggacaggggacccagttgctggaggtttggaggctgaaggaaatgataaggaaacactgttatgatgtcctcatcagccctctactcaggagaaacagagatcagggccatggagtaacttggatataaagaggaaagaagtgtgatctcagacgaggtgtggtgactacaggaataaaaagcaaaaaagagagaagcttcaatataatcccagagttacctgcctcagaaacacacgtgcgtaataaagggacagatgaagagagtttcacatggtggaggggatgtctcagcttgcatttgggagcacagggtctgttttttcatttaagtaattttgttgaacacgattcagctcctgtgctgcttaaaatcccatatcttcctctgccattttcatcctaaccaatactttataccagctttattgaagtataatgttcatatcatataattcacccgtttaaagtgtacaagtctataatttttagtaaattcatagagttgtgcaactgtcaccacaatctagtcttttaacatttctatccacaaaaatcccagcagtgttctcaccccagcttatctgcttctgtggatttgcttcttctagacatttcatataaatggaaccgttaatatgtataattttttgcatgtagattcttttttatttttcttccagcttttatgttttggttcgggggtacacgtggaagtttgttacatgggcaaattgcatgtcatgggggcttggtgtacacattactttggcatccgggtagtgagcatagtagtggttacgtggtttttcagtccttaccctcctccctccagtaagccccggtgtctattgttccctctttgtgtccatgtgtactcaatgtttagctcccacttataattgagaacgtacagtatttgattttctgttcccacattcatttccttaggataatggcagctccatctgtgttgctgtaaaggacaggatctcattcctttttatggctgcctagtattgcatggtgtatatgtgccacattttctttattcagtccaccattggtgggcaactaggctggttccattatctttgctattgtaaatagtgctatgataaacataggcgtgcatgtgtctttatggtagaatgatttatattcctttgggtatataaattttatatatacatatatattcccagtatatatatatatatatatatatatataaaaaataattcccattactgggaatatatatatatattcccagtaatgggattgctgagttgaatggtagctctaagttctttgagaaatctccaaactgctttccaccagtggctgaaataatttacattccttccagcagtttgtaagcattcccttttctccacaacctcaccaacatctgttatttttttattatgtatgtatttatttatttagagacagagtttcgctcttgttgcccaggctggcgtgcaatggcgcaatctcggctcactgcaacctctgcctcccgggttcaagcgcttctcttgcctcagcctcctgagtagctgggattacaggcatgtaccaccatgtccagcttatttttttgtatttttagtagagatggggtttccccatgttgatcaggctggtgtcgaactcctgacctcaggtgatccacctacctcggcctcccaaagtgctgggattacaggcgtgagccacagcgcccagccttgactttttaataatagtcattctgactggtgtggagatcattctggttttgatttatatttctctaatgattagtgatgttgattgagcattttttcatatacttgttggccacatgtatgttttcttttgggaagtgtctgttcatgtcctttgcccatttcttaatggagctgtttgtttttgcatgttgatttaagtttcttatagattccagatattagacctttgtcagatgcatagtttgcaagtattttttcccattctgtaggttgtgtgtttactctgttgatagtttcttttgttgcgcggaagctgtttaattaggtcccatttatcaatttttgtttgtgttccaattgcttttgagtcttcttcgtgaaatctttgccatgcatgtggattctttaacttagcattcatctgttcatttaacttagcattcatgctgttgtatatatcaatagttccttcctttattttgcttcatagtatcccattataagatatactactttttttaattcattcaacagtagatgaatatttgggcttttcagtttggggctatgatgaatcatgctgttatgaacttgtgcatacaagtttttctgtggacacgttttatttcccaggggtgagattgcagagttatttgctaagtttatgtttaactttttaataaattgccacactggttttcaaagtggctgaatcattttacattcccaccagcaatgtttgagagttctaatatagtcacatctccaccagtactacttattgtctgtctagttttttttgagacaaagtttcgctctttcccccaggctggagtgcagtggtgcgatcttggctcacagcaacctctgccccctggattcaagcagttctcttgcctcagcctcccaaatagctgggattaccggcatgtgccaacacacccagctactttttgtattttcagtagagacggggtttcaccatgttggtcaggctggtctcaaactcctgaccttaagtgatccacccgcctcagcctcccaaagcgttgggattacaggcattagccacaacacccagcctattgtgtatcctttttattatagccatcctagtgagtgtgaagtggtattttatgattttaatttgcatttttctaatgatgttgaacatctttttgtttgattaatagcctattttctttcttttttggtaaactattcatatcttttgcctccgtttttataagattgcttatcttcttactgaattgtaagtcatttatagatctgggtactagtctttgtaatagatatatggtttaccagtgtttctcccagtctgggacttgtttatgtattttttatttttttaatgcccaaggttacaacaatgtagcttgtttcttaatttacttactgttgtcttttgaagtataaaagtttttaatttcgatgaatccaatttttcaactttattttccttcatcatgcttttgatgtcatatctaagaactctttccctatcccagaaccatgaggatttttctcttatgttttcttccagaagttttacagttttagctcttatgtacatgcctatggtccattttgagataatttttgtatatgagatgaggtaagaaactcaagttatcttgctcgcatgtgtatgttttaaccgataattaaaacagaccagtctggccgggcatggtgactcacacctgtaatcccagcactttaggaggccaaggtgggttgatcacctgaggtcaggagttcaagaccagcctggccaacatggtgaaaccttgtctcaactagaaatacaaaaattagctgggtgtggtggcgtgtgcctgtagtcctagctacttgggaggctgaggcaagggaatcacttgaacccgggaggtggaggttgcagtgagccgagatcatgccactgcactccagcctgggcaacaagagtgaaactctgtcctaaaaaaaaaaaaagagaaaaaaaactagtccagtctgcctggtgaactttcatttgtcctctggaacccatcttggatatttaagctctctgtggtactttccgtgtcctctcttctccactctgatacagcttcctcctacttatctctgtgtacatttgtctgttgttgaatatgaaatccagtattgtcatgatgtgtatatgtctgtgttccctactggaatatgagcttattcatcttggtgttttcaatggctgaaacatagtaggacctaaaatatttttggttaaatttgattaaatattaacatctctaaaccttgaaaatcttggtctcttttttttctgtctctctttcaaaatttaaaacagtcaagcatttgaaacaacaacaacaatgaaaatagagccagggaaccagcttgttcaggaaaaggaataaatcattctagctgacagtactcagtagactgctttgtagctttttgagatagacatataaaaagggacactgatttgatggaacttgaacaggatgatggataagtgctccaggcctaatgaaatagcatgtctaagaaaacctggaaaccctcagatgacagcagacacgcgaccagttccacctctgctatttactcccagtcattctgcgctttgtttggccgagggtttcatggccccctattgattgcagagatgggcacttgtccctctgcccgccctgtgcacttcctgttatggcacctaagttttcctacttcacaggtgtgacaacaaccagtgctttagagagttatcttaaatttgctgcactggagtttgtttatatctctgcatattcaggtgagaatctagtctcctttctccgcagatatttactgaggatttagagtgtgtaaagctctgtgccctgtgcctgtggaagacacatgcacactcgagtgacacctggtctcttcccctgagggggagtttcagtatgcttaaaacactgatgaaagaagaagaaatattgctctaattcccccatgtacctctgcaaaatcttgtgagatttttgccagtccagctgagaagttatctttccatattgtcaacttaagcaggattcattgagcaatgtattcagatattgatcgtcttaactgtgtcttatgaaaagcttttaggtcaatctcttaaagtttgttgttttgagacaggaatataagggcgttgatgattataggatctggctcaggctgtcagaatgagacgacttctccctcctgaggctgacctgcttaggagtttgaaccatatcaaactgtaaggatcaagtacaccctcaaggtttaagaacaagcttttaaaatatccacctctattgtctcgcctctgatgtagtttaaaacatgtcatttagaaaagtgattaggctgggattagagccatgaagacctgggttagaatccaggggctgccacctgctggctgtgtgtccttgagtgtgtgacatggtctctgagccccagtttcccattcaatacaagcagtgttcacacctgtctcacagagatgttacaaaggttaatgaggaaatatatagaggctgggtggacctaccttgtgcataagaagttattaatagatggctgtcattattactgttttcagctatttctgtgctgacatgaacttgattatgctaagcccatacaatttctctgtagcagtctgtagctcatatggtatctcttgattgttttttatcctttagagttcttgttaagtaaaccacacattatggatatggtcaaatttatctctcaccctgttcgccttcccccacgtaaagagctaagcagtctcctgagatgggtctgtgtcccttggttatttttagaaactctcccaacaataaagaaacacactgattcaatagtatctaatatataacctgttttcaagttcccttaattgggatagtttgttttcgatctgggatcctgttaaatgtatgcattgcttttggccatcatgtctttttcagtttcttctcacctggaacgttcattctcccacccttcccctttttatgtccctcttgttggtggcattttggcggaatctgggccagttgtcttgtgtaacatcctgtcctccaaccctgcctggtggcttcctcctgccctgcgagccccatgaggtgatgggacagtgtggtctacaggccccgtgtgtttcctgctctgcctctgctctccgaccccacacgtccagcttcatctctcagaacctgcttctcttccaactgtgggacttaccgaacacagagggttactatgagttcccaatgagatgactaaagggaaggcctgaacaattccgggcccacggtacacctgcgaaaaggttttcggcagctgaataggcgcaggagtgctgcccagagaggtgagaggagagccgggtgggccaggcgaggatgggagcagagagtgtcctgagtgtggtcaaagctagcaaatgcttaagagagcggttttgtttttggtttcctttcttggacttatcgtgctgtgatttggaatacagaggagcaatgtgactctgtaaactgaggtagcagattcagcagggctgatagagcaggaaagctccctttgaaggtagaaattaagtaaagtgctgatccagttctgagcatctggcaagtgctttctggaccttggggacgctcacagacctggggtaccttcacataggtgagaaccacactctcccttcaccaccagatggatctctctctctctccatttattactatcctggttatgccagaaagcttctgctgttgctgctgtttgtgttttcacatttactgcaagagcagcgaggtacgtacatagaaggttcctagatcttgaaggggtctcccatttggggcctcatgctgtcagtccctagtaggagggaccgctttctgcagggcaaggggaaagtcctaatccttcctgggcaggccttagttgtccttaagccactccagggacaaagactgactcaaataactggctgctggtcggtgctagctgttaatacatactttgtgagggcttgtgcaaaatgaaaatgctgggccccttattcagagcgcaagaaaaaatccctttaaaggtattaaaataaaaggcatgtttctttcttctgtggtctccttcccaacttgtcatgatgtttttaatttgctattgaatgttactctaagaaaaataaaataaacttttaaatcattagcatgaattttacctttcatctttatatagtgcaatgctagaggtttttaataaaatttaccatcttaaccatttttaagggtacagttcagtaacattaagtgtattcacactgttgtgatgaacgtcagttttaaagcaaatgtaagagcctttagctggtatgtagaatcactgaaatgacataactcgtatttcatagcttatacatgcatgtgtattgcattgtcaatagaatggtgaaacacaacacaaaactaactcagcggtttgtatctcatttctttacacatggacattgtccccacacccttgacttttggcttactgatgagtaaggaaggactaaaaggaagggtactacaggttgcctgatctttttctttctatgtcatctttggtgtaagtggttgactaacagagatataacacacttgttaagaaaggaacggatagggctccctggtcattcgtgttttatagaatgccattgccttctttctgcattaagagcaagttctgattgctaagagagtagattttaagtattctcaccacaaaaaaataagtacgtgaggtcatgcatatgctaattgatttagccattccaccacctatacatatatcaaaacatcgtattgtacaccataaatagctacaatttttacttatcaaaaaaaaaaaaaaaaaaggcaagtcctggtttgaatggaaaagagtggcctcctgaggctctcagcacctctgcggaactcccaggcttccctggtccatgggaagcttgcgctcatagggtgtcaagggtggccatacaaatggggctacaaggaaagcggtggacatgcacatcaccggatggcctctcccatgcaccatgcacgtgcgcctttaacccatcagacttcacttatcaaagataaaatagtgagagtggcaagacgggaacagcagagcccctccatgcttgggttctgtgtgcctgtcagggttgcacacccacggaggaggtcctgctcatagcagatgtttcacccagccctgcaggaagggaagatattggggatggcactgcttttgggagccccttaaatcaggccatttgaagtggccagtccgtctcccaaaggtggccctgctcccattcctagccctttcctcacattcaatagctctcccgctgctatcccagatgtaatgcgtgggtaccaagaggtgggattgggtaggctttattagtcagaatccatttaactaattcaaactgtttggggaatcatagaaccatacctttatgaaatatgtagcacattagtccccactgtgaatatgttattgaaccaactatgtgctgagaagtgcacataatcttcccaactaggacctaagcagaaggtgccatcacccccatttcacagcttaggaaatggaggccccaagtaggtaaggcagaattaggcattcctccattgcatttcgggtgcctgtattgtggtttcagagctttgtcaatcaccccctattcagagggctgaaggaaaacttcactctctgccaagagtcaccagccctctttgaaacagctcttgtttgagcacaaaatcgcacaggtaaaatgcactctggggtgtgaggcaccaggtgcgatccaagtagagaaaagtgctcattattttgaaggttacaaatggatttcaaacatgggactgttcttttggttacttccggagatgaaagtgcaattttcacaacatactttttcaaaagctatcagaagcttcatattttttaaaaacgcgggatgtcactccctatcgtctctgtggttcccttgtggttgaatattttaatcaggtgtttctgtgctttaaagattttttcatttgatttacaacttgtaggagtggagttgcagtgagtaattaggaagaatgccataaagaggacaaaaggaaggtgaaacccagcgttaataattcagtttcaataaccttaaaaggtttactgttcacttttaaccttgtatcccaaaaagcaagctactgcagtgaatcataaaaatgtttcttttaatttgcaagtcatttatctaagtaggcttacagggactgatgcgttcgtaaaacaaaaaggtcatgaaatgacagcagctgctccattccatcctggccatttgaggtcgcctagcctttgattggaaagatcttagggtttaaactctgtagagtcttgctttcaaaatttatagattagtacagtgccaaatttagtagcattttagttagtaccaggcaaatcaaaatagactcacactagtggagaggcaagaagagactagaagtgatttttgatggggacaaaatgactaagagatttacaggtgatatttaaatcctaacatcaaaaccagggggcaggctgaggttaggctcggcaaggaacttcgaaacacctgcaaactagaaattttacatctcaggaggcctgctaaattaacagagagatttttcacccagatctcattaccagccctattaaaacaatccctgttgaacattctactacgccattgcatagaaaatcaccaggtgcatgaaggtgtgctttgtttcataattaagaggggggtgcatacccccgctaaagtggaagagctaatggcatcttttgtggggtttcttcctcatctttaattaaaaaatatgtaccataataaatggaaccattttttttcctggagttattttctttctgctaatggagtttgtcagtattttgtttctcagtgtttcaggcattctctgcaacatttcctactgccaggcccctctgccacagttgggatatcagcctcctaagaccgccttctatgattgcccttgaaaaaagagggaggctgagattattgagaactccagaaaatgggttactagattttttcattttgattttgacataaagtgggcaggcccagctgaaaaagtgaactaataattcctatacctttaaaggattttgactttttagcgtgaacatttgaagtgagttcttcttcctgctctaggcctttaaatactatggctacttttggcccatcctgaaatcctgtgatgatttgaactatttattcggttttggttgatggacttggaatgcggatctgatcttaaaataggaatcttgatgggctattattttcaggtgccactgattatagaacagttaggttttcaccctttttcttcctctttctggttttgcatcccccaccccacacgacatccctcctcccccatgccatgtcccatcccccatttcccatgccctcctcatctcctgtcctccatgacctctccaatccatctttccactcatggctgattcttctttttttcttcctcttccaacttcttcattgctgtcacgaccttctttaaaataaatttgaaaacttcaaaaaaaaatttgtttttctcttggagaagtgccccaaatggcaaagtatttcccgcccttcccagttttaccagtgatttgctaagtagtccgtctgttacttgggcacatctcagaattgagtaggtttgtggagggttgggtggggacggagtggttagaagctagtctgctttaaatggggcttagagatactctcttgactcacatcttcagggtgatcatctgtagcttgttttttcatggtggttagttaacagaagttgattatgagatttttctggtcctatttattaatttattcattcagcaaacaatgacagagcaccaagtgtggtcctgtgtgccaactcctccaactcctatactaagaatgaaaagatgtcatgtgccttccatagaattttccagaatagagtctaatgggttgagaagtcctgagattcagagcataatttggaaactacaagcatctgaaggttaaaagaccaacagtcaggtgtgcatggtgttccttccttgtcttgaatctcctttgtgagtgatgagtgatgtttcagggacgtaggggcgtgcaggaggtgcctgtggaagggaggtagtattctggcatcggtcacaaacatgagcccagatgtcatgtcttcagaggacagctcctgccccccaatgtgtccagttcccactgtcactcttcatgacttcattatattttttaaggtatccgtcaatatctgaaactacattacttatttatgtaccttttggtgtctacctccctctttagagtcgcagagggaggaatcctgcctgtcttgttcaacattgtgttcctagtacctagaacaaagcctgacctgcaataggaattcagtaaatatgaactgaataaatatcccacgattcaaaatccaaaagcatctcacccttaggccacagtcatgcatgactgcctctgtacttcatgattacaaagcttctcctcatgcactgctttgtctcagtgcacgccacgagcatggttccatgcccgtctatccctgtagtctgctgtctgctccaaggtgtggcacttgacacaccggccccccatttccttatccatgaagtgggatcgcaccacctgttacacctctgtaacgggcattttaaggatgacagtaataatgaattagcctttccaaaagcttatccttatacatacaagtattgagacttgtacaaagggagtgtttttacaagggtagaaaatgatatgtacccttccttttttgataattcaaggacaagttgcaccaaagctgtgagcagtatcagatatttaacactctatcttccaagtgatgacgtgtacgatctagttctcccttcctggagagagacagagacagcgcaagaacaagcaagtgagagcacccagggacagggaagcagtgaggtggacatcctcccaccgagatgttgatgtctaaggcaggccagagttactggatttcacactgtgtcttccataccaacccacgatttcctatcacccacactatcacactattccaaggaagaagaatgatgctctgatggataagcgtttgaggtttcataaccacagaagtcatttgtctaatatagttaaagagacaaatatttatataaatcaaagcatttctttttctgagaagaatgtcattcaatgaggatggggatggggacagagtttaaagatggcatttgctaaaaatgtggacccaagcagtttcctctaaagtgtaattggctgtagtgttaatctttatgtccatagtcaaggaaatcaccattatagttttcacatgtgagggaagtcagacatgccttgtttacattactgccatttataaaacatttaaagcagctattctgctgaataaacattcaagagcctgaaggataagcatatcacttaaacttcttaagactaaactttccaaaccatttcctgccagagggacccaacagcaaaattgcaaactctgtgccctgagatgagataggctgaattagattaagcagcttactgttgacatgtctattgatctgggttcagtgcagtttcctgtctctgccagcagtcagattgctgtatacaataacacagtgtcctggtttatgtgaaattggggactccaagcatcaattactccaggaaggcagtggcactaggagataaggttaagccgcttgcagtgtttaagacggctaaaatccaagcaacatatttgctgtctaaaatgttgcttacaaatttgacagtgttccatttataaaatttccaaagagatcatccagtgttgttctctgcaggtagtcgtacaaatagcattatgaatgcttattgttaaagtggtatatcccacttgctcaattttgtgcatgtttcctaaatatttgcatacaaatattgagctgggtagcaggacatcaagaatgttgtggcgccatcttagaccatcagctgtgcccaaatgagggaatgcagttgatgtaagaaataagtgtcgaccatctgacttgggtattttcttttctctgggaccaatcaagtagattcagtcagctactctctttgtatttctaatacccatttatttgttttcatagagcaattatttttctaaatactaacaactacatatttaatgcaaaaagtgtatacaatacagaaaagcaaatgcaaaccacaaatgtcaccacccgatgacaattattttgaatttttggatgctaacagtattttaagtattatttttaaatacaccctcctccatccacctgtgccagcgtgtgacacacacacttctttgctaagcactcatttaactgcgaatataattcgctatcttttttgattaaaggaaatatggctttccttagaagattcttacctcttgcagtcctacaaacgttatagaaggatagaagttaagcctatgtttatgtacttctgaagagtgtaactagaagacatttttataatccatggagttggaactcttcaaaattcttgatgggtcagctctgttcatgcaagttgtccttaagtttcatgcttaaaatgtaacttcttatttctgtaaaagatgttcacagagcaaattccacgctttcttgtgaaacatatgtgctatgaattggattaaaggatagagttttgaaagtgacatttcagcttgcctatcatgacattttatgtatttttcaatacatatttatctcagaaatatctcccttactttattacaggtagaaacagagtttcacataaaacttaggaaatccctcaaatacagtactgatggaaaccagacctggaaatttgacaagtctgggcacagtttactaacttaattgtattttccgggctgacctcctgagattggtactgtcctcaataagcctttgcaacattcacaccattcttttccattttataccttccaagaatgaggcaaaatgagtgtatttaaagtgtatttagcgtttattggcaaagtttcaggttttatcttttaatgcaattttaattggttttattgcaggattgatgcaagatgcccggaatgccaataggtgagagggctctaataagcaaaatgggccactgcaattactgttgatctgacaacccttaacaaaactagcatgttacattcctgactgcgtctcacccttaaaagaaaccaggcctgatcattttagattttttttcaaggggcctagactcttcgaagtactgagaattcctctcatagtctttctttactgaaatgtcttgactttgtaaatttttaattatcttcaaaatgtcacttctgatgttatgcttctcctgaaaaagagggtcctctctgtatgatgctttcagatatccgttatacaatgatgaacccgatgtaaacaaccacactttaaaataatatatttttttttattttttgcagagacagagtcttgctacattgcccaggctggtcttaaacttttggcctcaagcagtcctcttgcctgagctcccgaagtggtggaattagaggcatcagccacttcttttcatttatatattggttgtggtgtctgcaaggaagagccaaagggaggctgcttttctctcccatgtgcccagaaacgggcatcaccaccccacgttgcttatgttgctcaaaaccataagggcctttgtggtcagtttagcttgtcattgatgatgtgcaaggaagaattattaaattttttgataagaatcacatgtatagccagactaataatggcaataacattattaggactttctgaaatcgcaacacccactgcctccaatttgtgaaccctgaagagctataaatttaggtactctacttaatcaaaagcatccacacatgagaattaatataaggccagcacgatggctcacacctgtaatcccagtgcttgggagcctgaggcaggagtatcactcgaagctaggagttcaagaccagtcttggcaacatagcaaaaccccgtctctacaaaaaatatatttttttaattagctgggcatggtggtgcacacctgtcattccagctactcaggaggctgaggtgggaggattgcctgagcccagaagttcaaggctacagtgagctatgatcacaccactgcaactgcactctagcctgggcaacagagcaagaccctgtctctaaaaacgaaacaaaaaaaagaattaatataaaaagataccctgcaaaaaatcaaaataagttgaaaaatgtataacagaaaaaagtcaatcgtttgtcattatcacatgaaacattcatgaatcgtggagcagcactgcccacgtcacctcctgtcctctgctgccaggcagtggttttaccttgcctttatccctggtatcatgtagccatcttatctctgctataggattgagagccctttgaaggcctctctcttttatctttacacctcccacataaccaaataggaaaccaaacccttataattgtctgtaaacatttatgtaatcattaactgagtcaagttagaccaataggctttccaggcctgagtggaatgtaagaagtgagaatgaaataaaggttggcttcatctgcgctgtggttaggacatagttcatccccaccaaaactcatattgacgtttgacccccaatgtggtggtgttgggaggtggggcatggtgggcgtgcttgggtcactgaggcagatcctcatgaatagattaatgccctcccataggggtgagttcttgctctggtgggagtggattagttcccagcaaagcagattgttaaaggagtccggcttcctcagtttctctttcttgctttctctcttgccatgtggtctctttgcacacacccacccccctttcactttctgccatgagttgaagcaggctgagacccttgccagatgcagctgcccaatcttgaaccttctagccaccagaattgtgggccaagtaaaactcttttctttgtaaattacatggtcttaggtattctgtgatagtaacacaaaacagagtaagataatgtgataaaacacttgggcaagctttggaaaggcctaagatagtgtggagagcaaagagaagccagtgaatttttagggtgactgaagctgattttaagagtgaaatagatgaagaaagatgaaggggcttcgagaagaatgttctgatgatgcctctgagcctgaggtttggtggcagtgttggtgaagataagttagactctcctggatgtttgcaaggcctctgaactggtttttaatcatgagtttctttttttccagttcatcctcaatgtaagggttttctgaccaggttgaactcctgatttattaatggcttttcaagctgctccacagaactccatccacctctgcggcctttgcccccctcagaaccccccctgccccaactgaccttcccattgttccctactccacgaggggctgtagggcgcaccaggtacagtcctggtcttgtctgccttgtatttttaacattttatggtgacacattgggagttatttccctaagtgagacccttttctgaatatatctgtgccctcatagcctagcagagtattcagacttttgaatgatggaaacaaagctgtgggaaaagagcagaatacaaaataacaataccaatttgagctagcagacattgctgtcaggggtcgggctagaaagatgagaaaaactgaagcctgcttagagaggtgttgacaaccaccagatccagaagaatgacctagataacagggcttcaagttctgacatgattttattagagatgtttcagaaatctctactggagaagttgtgggaacacaggggaataaagtcacggggatgggggaggagtcatgatggtaagtgttgatttccccagcatggatcacctgatagcatcatcagttaaattaggataatagcgatttgagcatacttaagttagtagatgcaagaatgggaggagagggcagaaatacacatggaagcaaaatagagcagaaatatatgggagcaaaaaaaaaaaaaaaaagttgagcactctgagattccaaagaagtaacatcttacgtgatataccaaaaagtggccttttctcttgatggaaagaaggaagtgtagtgtccccaaataccagaaagagccttgggaagatctttgggataaccctgggaaggtggagatactgatatgctcacagacagtgagactcctggggagaggaacaggcatctctactcctttttctttttctttctttttttttctttttttgagatggagtcttgctctgtcacccaggctggagtgcagtggctcgatctcggctcactgcaatctccgcctccagggttcaagcaattctcctgcctcacgctccccagtagctgggattacaggcgcccaccaccatgctcagctaatttttgtatttttagaagacgaggtttcaccatgttggccaggctagtctcgaactcctgatctcaagtgatccgtctgcctcggcctcccaaagttctgggatgacaggcgtgaaacatcactcccggcctccattttctaactagaactttgctcccttcctctgtcgtttctgctttccctttttcttctgccttctctctgcgtatgccccactcagttctgagcatttgtaagtgtatcctcactcccttcccgctggcctaactgtgatctgaaagaggaaacacacactttgtaggaggtgacttggcagaggcaagggcctaccagggcttggggtcacacgggccagaactgggcccaaatccttatgcagcccccttctaatctttacgaccctagacacatctccacatctcttggttggaggtgattgctctgccctcacagaaatgcaagaatgaagggtccagggaagagagcgaatgtttatcggtgcgtttcatgagcctgtcacaggctgaagagctgtgtatctgttctcaattctcacgtcaacccggtgaagtagattctgttaatccgtgttaatgagataacacatgcaaagaccttgacacagttcctcactcctcctaagcccataaacatgtcacctgtcctcccttatgattggtaggtgtcacctgaacaggtgaaaaacagtacgttcctttaatattgggggcacagggtcataggagagtgtgcagccaaccccttaccaccacactgtgttgaaaagtcaagtcaggaagcaattgtctgtattcctaaatgaccattgtgcactgaattctagttttcctagaaattacatggttgaaatcatcccagacaccctatttcctgagaaccaagtccaggctgtggctgtgatgatagtgatgtggtgaacttcctctaggagaccacagagttagagtcactcttgttgaatagtctgagcaccttcccaggtatcaagtttttgatcattaatatctactatgtcaatcaggagagaatgatcaattatttccactttgtaccgccggatgtatctcttctccttgtaagtagaaaggtcataacaccttgagctgttacgtatactccacaggccagcaggctccagtgcagaaggtggtgtctaaaagaaatactccccatcgccactctgcccaccaaatgtctcaaccaacatccacacgcaaagtatgtggggcaattcactagtgaaagagtggttctgatttatgttaacatgtcatggaagaattaaaccacaagcttactgaataaaagaaaactcaaatattcctcatactcttccaattcctcttctctccaccacctgcactacacacacacatacatacatgtacaatacatgtgtgagtgcacacatgacctgtttttgcattgattatgataacagagaagataggtgtttatatgttatatgttgggaagttcttagtcctggcctcgcattgagcacatttcataaagacacagtatcactcacatgttcacattttgttatgaattctaaaacttcctagccttgcaatgtatggctaattttataaatttacagcatataaaatatattagaaattcaatgagtctcatctccactaggtaagatttttggtaactgaggattaactttacatataaatattaaagtggtgacttattttggatttctatccataaatatcttacctgatacagttttatcattataacaactttgtgataaaaataataatgttaatgataactaataatagctaacatttactaaatgctttctctcccaagaatttgcatgcattttctcatttggtttctgtagcatccctgtgaggtaagcacttttttaaaaaaccacattacagtacacagaatatgtagaaacttggagaagtgactcagccaagaccccatagctagtaattggtgggaaccaagatttgaacctatgtctctctgacccgtttctttgctcttggttaggaaaactgaattgaggaatatttttctccatttataaaaggtgttaatttttgactgccccccacaacacactaatatctaacattaattttaatatcatttatctcacagaagacagaatcaactatacttggcttcttgaagcaattctcttcctcgctcaaactccgttactgcccctgatgacatctccacatcagctctgccttgttcatgtcgagaatatttaatagcatgacattaaaagaatccttggggctcctgctcctgataaccaaatcaacctccaactacatattctgctagatttttgatgagaaatttcctgtgaaatgaagtttgtttctcattcaaacaaccagtgcatttttcagtgaaagtgctgttcatctcttgacccaagaaatagaattaaaggaagaagggattctaggtcacccaagtagaaagaaaatctgaagtcatctttttccctctagttaaagtttactttgtcttacattttttattcctagtcagaatattatatgtggaattttagtttgcatgaaaatggtcattctcaaatactcttttcaccataatgtatctattagacaagtatatttctgaaagcttaaagaacttgaggtatttaaattcttggagtaattctaacatgtctgtttatttatagaggtttcaaacatttaatagtcattgaagaactgtgggctccctttttaattttttcaatgacatcaaaaccctcgattgttaaatgtctgaaaggaactcagaatgcttgccccacaccatgctgatagctacctggctgcctaggaatctgatggccctcggctccttgaggttcacaaagactgatagctgggtggtacagctcctgtttcctgaacgctcaccctgcatgagcagttctaggggaccgttgggtcacgcttaacacatttctgtagccatctttgcctacctctcttctctgcgtccttaaccctctgcaaaatgatttcacaagaaatcaactatagatgcctgtgccatgaggtgtgatctattagtaaacagccttgttaaaaacgtactgaaaggctggcattcccctggtggtcctggcaaggattcataagattgaagagacatgttagcaacattagatgagaagtcactaatagtgctgttctcttatagaacaattggataactagttatgcaaagcctctataatttggttctgctgcccccattcaggccacctgcagacagtcttcacttaggcaccatccttattgccaattacttttcttcgctgaaatacttcttctttaatgaatgttattatttacactttgcagagtagttcatgacaacctgatttgacttgtgtccacgacagagacttttattttttagaagacatgtaagaaaaaaagtaaatcatgtgttcatggttatgtctctaaaaaatgcaattctgctgatgtgtagctaaagcagcctattaattagcaaaggcacttaaaattgttttacaccacagacagtattcaagctttgagaaataaaaaggtgtgttctttgcatgagaagttcaggcatatattatccagagagagctcattacttttttctcttttacagaaagttagataacagcctcttttgacagaaaaatgtctattttctgacaaaggaccggaggcattcttcttaaaatcagtcattctgggttttctaacaaagcctcgatgttgttcattctaaagaaaattgtgtcaccttaaaaactagattcatgctgggttttcctatttaacatagggattaagagatttaaaacgaaactcttggtaaatatcagttggaatgtccataaagtttactgtgtctcttcattagtgggcggttttggggatttgtaaaaagggtgaaaatatcatcttggtaaaagaaaaggtagagtacacatttaacccttaaatgattctgtgccttatttgtgtaacttgctttgtcctgaagtgagtgaaacttgatccatggtgtcccagcctgcagtgacctctgacactccatctgaggaccagggacagttgttctactcccaccattggaaatgcttttgccagaaccccacggctggggtttcactttttctgtgtcctgactcgtttgcattcaattactttaatgctgagagatgtaggaaatcagctccatctctcagcagttagggtgagggttgcttattgaaaacacttgctgctgtgcttatttttaaaatatatttggttacctttttgtccccacccaagagtgacaaaacaaccaaccatttgaatgggagctaatcagaatactgaattttaactcatcatgagcccctgtgtgagataaaggaggaagtatttgaggcgtgaattgctgatgtaggcttgataagtcttgttttcctagttaaattgtaagcagagaggcctcacccatcccaaccaaacacacaggtgagcatacctgtgtgccagcacacaccatggcagatggtggcttaaagctgggcacacagtgacagctaggtgcttgtcagttgatgaagctgtgtaatctagagtccaggattgatcctgtgaaattataggtgatactgcttttctctggctgtatgggacaagacctcgatctagtagtgaggtaggaggtgagactttactccagaccagactgaagactggttgaaacagaagaggtgagagcacctctccataagacacacctaccagtgccatgttggtttaccattgctatggcaacacctggaagtttccactgctttccatggcagcaacctggaagttaccaccctttttctagaaatttgtaaataacccatctcttaatttgcatgtagttaaaagtggatataaacatgactgcagaactgctccgagctgcttctctccacccactgcccagggagtagctctgctctgcaggagcagtcagggagatgcaacactgcgtcctcaataaagctgtttccttctatcaccgactggctctggagttctttcctgagtgaagccaagaaccttcccgggctaagccccagttttggggcttgcctgtcctgcatcaataggagctgacaaatcttagtagcccaaggaaggccataaaaggggctcactccaggcaaacgccgcccatttcctatttcctacctgtgctggatttgctgaaaccgtcaccatagtgaatgacatctgagacctgtagtctggtttcataccccaatatgctgaagatgtgcaatgaatagctaggggcgctagagccctggaccagcaagcagcctgtgccactgactgccactgttcttgttcctcctggcccagcagccaccttccacacctgcactgggacctcccactgtgcctctcctcccttccatggacttaagtgaagaggtggtcaaattatgcttgactgctgtgatttatacatgtgaaagggttttttaaatgatccatgtggatctgcttttctctggctgtatgggacaagacctcgatctagtagtgaggcaggaggcaagaccccacacagccacaggtgctgcccctcctcccaacatcagcatcggtcctcagccatgaagtgctgtagtttagtggcagcagccatcagatgcgcagccccaggggatggggggactgtatccggagcatacgctgtggtggtctgcctgccgccaactacaatggccacagcaggaacaagtcaaaatcctaagatatgtggctttttcttgaccccagaggaagctaggaaagtgaagaggcaggaggaagtgcaggaggtgagtccctgcccatcttcaggcccagcctctgctgccgccatccccttcctctccagctcccaggctttcaccacacacatcgcttcaccctctccctggccgcccacttcctcttcttagagcctggcattcttctttcaaaattcaagtccctctgcttgccattgcatctgacaccttaccgcactcatacaggattaaggtttgtggatttgacttctgaaaactgataaagtgaacagaggagtgtttttcttaaaataattttttaaaaacactgcagatagatttgaatgctttattaatttgttttctaacgcatgaaaacatttttcatttcacccggcctatctagcatgctaagagaatttaggccagataggaatatttatcaattgagttcagatgtcagcataacaggctaaatacagtcagattaggcaagttcaacaaacaggtgttaaagatctcatttcctgctgattctcacctgaaagtcccagtgacctcagcatcagatgtctcttagttgagaaatacaaaatcaaagattttttttccagcaggtgtataacacacctaactgatttcactagagccctgaggctgatgttggtgaaatgtgcttatgatgcaaaggtttacagtgtgttgttttccaacttttttgatgataatcatccccagactcaaattactccctatagttgctataatgatgcaggcacaatcgtttggcttaattacggttgactgtctaaaactaccttcccctggagtcattgaaagttttattggagttctttaatatgattataaaaattaatggacttgtaattaggtataagagaagcacatccaaagtttgccaaataaacaagtgttctacttatgaagtcacacatttctgcttatgagcccataatatagataccacgaattcaaaatcttatgctggcttgtgtttacatcaagaaagatgatttgaaaatgaattcagatcctcttattgtaggggggaatgtaacgtaagcacacccttaggatgatcctgtatggcagatgcatctgaatatgtgttccaagttagggcatccaggagtagccaacccagagattcattccttgtctgtgaagaacatctgagcccccatcctgttctgttgaacacaagctgtatggaggattggggccctgagttttgggttaaatgaaggttgcaaggtggaggtcgttaaggggagggtgttaagtgaaaacgctgtatataaactgcatgctgtttgcaagtggttgtggttttcctacccagcctgccaacactgcgccgtgaggttatgctttccagcctgccaccactggaccatatgtaaggtggttatcttgtccagcccactgccactggactctctttcctttatgtaagccactaataaaaccccatgtgtcattcgcttgctctgggtctctcctttggcctcttgaacttggtgcctttcctattgaggttaatagaggttccacacggtacttgcaactttctttgaaaagggaatacgttatcattaacatcaatactgtcaacactatcagtaaatgttgatgtacttacctttctacataccttccatttgctaagtgagatctaggcttagtcaacacatttactattcagaaacctctaatcaagtgatagaactctgacttatgaaaattataactacaatctagctgccactgagttttaatcataacatgagaggcgtctttgaggcatttagaaccttctttgaaagacattagatatctcccaaacttcccttgcacatgaacaaaatgtcttcacattatcccttattttattacttgagtgtgtcttctgctgttgcaaaaccaggcattgacagatcaatagaactcaggtgtgtggattcctggtggtacttgtctctgaatatacagtcggccctctgcattcatgggttctgcatcgatggatttgaccaaccacagatcataaatacccggggaaaaaatgaatgaatgattgcatctccactgaacatgttcagatattcttttccttgttattccctaaacagcacagtataacaactatttacatagcatttgcattgtattaggtatcataggcaatctagagatgatttaaagtatacaggaggatgtgggtaggttatatgcaaatattacaccagtttatataatagacttgcacatccgtggattttggtatccacaaggtgtcctggaaccgattccccgtagataccaagagacaactgtatttggaaagcttcagaagctttgcagatgaatgcagaaggctgggagtcagtgggagctttcctaacctcagaacagccattcatttgatctgtgtctagaatgagagtttctctgtgtgagctatgggtgattaatccattttgccttcattcttcagtggtttggcatatagattgaagtgttttgcttttctatttattggcggaggcaaatagaaacagagctctctctctctctcttgcagtgtacccacactccaaagtgccataaaacgaccttcaaaactaaaccatcatattttcttggcacaggcagagcgagaaactggggatggggctgcagctggcagtggggccagggtgctggagtgggggtgttagcaaaaggtaactgtgcccatttggttgtgttcaagtgcagacctcagtgaattgaagttctagcctctcaggatgccagacattgtggctgcttctcaatcacagccagctcagtacagccattgtcactgagagggtttactgttgtatttttttctgaatctgagccatttgtgtgtcacagtaagggaaatagattcatgtattgtgcctcaagtattgccaggaaagcaacatattaagcacatacttagacccttctttttccttctgttattaaattggagataaactcatataaagagtagattctagaatgtaatttggctatattgatgcatataagaaatgccaccctttgcaaaatcaacagggagtaaaaggaagagaatgttttattgagttctcagatatgttgagcaaagttttagtctcttgcctggttcttgatcatctgtgtgatgtggtgaagtcacttagctttctgtacctctgttaacatgcctgtgtcgtttatgcagtgtgacatttggactagaaatgatgctttcctcttccaaagagtggctctcaatctcagtgggctctttcacacctcttatctgtaaaaagttgaaagtatacgtaatgaatatgttcagaagtctttaaaatattttcaccaaatgcagtgcctcatgcctataatcccagcactttgggaggccaaggctggaggattgcttgaagccaagagttcaagaccagcctgggcaacatagtgagatcccatctttataaaagatttaaaaattagccgggtattatggtatgtgcctgtaattccactacacaggaggctgaggcaggagtattgcttggtcccaggaggtcgaggctgcagtgagctgtgatcacaccactgcactcttgcctgagcaacaaagagagaccctgtctctaaaaaaaacaaaaataggctggttcgatggtagtgggttatcagaacttattaatgttagtgtcacaaaagttggtgttaaccccccactgctaaaatctgactggctaaaaatagtaaaaatgaaaacaaaaaatgatactttgcaagccccctgatccttttttccaagagcaatggtgcactggggtggggatcctgtcattcagtgtttcctccctggtatccagcacaaggtcagcagaagtgagtgctcagtgaatgtttgcgaaacagaacgacgtttcttccctttagtttttacgataatggaagctctgtatcctgatggtgtggttggtacatgaatctcttgatgtgttaaaattcattttattttttaacataccctagagttgcttttttgggtgaacaactccttgaattttaacacacagaacttcataccacaaaaaaagtccattttactgtatgttaatttaaagataaaattttaaaacatggctccccttttgaaagagtcactttcagcactctgaagagatgaaccaacaactgaaacttctctctccaaagcattctatgcccttagtatagatggcttttcatttccttctaattatagttctctttgatttcttcataatttatttaaataaactttttacgctgagataaggatctgcgtttgttataaaatactgcttttaaataatgagagaatactgttcccttccaataagtttttcagtggaaataaaatgatttcttagcctttcttgaagcagcaacgaacagaagtattagtgaacagcattcattgagtgcggtatgccacactgctagctcagtaacctgccttggttccctttatcctcagagctcccccaaggtacatgactgcatctttcttcgacagatgagaacttaaagactcagagtggcccatagtacatggtgatagagatgggattggaacccagttctgtctgtctctagatcccatgcctttcgtattccaagaggcctccctgtaaacagatacagtttataaagataatttggcaggtgcgtgtgtctgcatgtatacacaggcactcacacatacattggagagaggaaaggcaggcagtggggggcagggggttgccaaggagctgccagagagtttgttcagtgtcttccctgtttctgaaatagcagaagctgatgcaggaacagctacattcattgagatgcctgtgtcgaccactgcagccagctgaaaaaccatctgctcttatagccctggcgtctgcatgtgagcttttgttccataatgcagcaatatccctagagtggagagagccagtagcctagtaactaatgctttgtcccctccttttcctgttgtcacgactctgtgtctgcagctagtcctctattttttactgtccatctagtgagtggctggaccatcactgatgtgctgttgatgccttatcagggttcagtaagtactaagccatgtgatggatgggcagagggctggcaacagtttcctctttctgctacagactaagactccttaactagagatgaggcaaggaaacagatagaccccatctgctgccacagattcatttcctgacttgcatttcttgcctctcctgcgggtttgttaactcttcagtctttggcaaaagttccattgggcagcaaccacaaatatcagccatcccccaataagtttactgtctgcaggaaaacgaagattttttttttcctgttattgcttaagaggtgttggaagtcagcagtctcgggtcttgctctaactgcctctaattagctaggtgacattataccagttacttaaagtctataagctatattcttccatgaaagaagaattataaaactccctatcttacaaggttgttttcaagatgaactgagataatgaattgaagccacttaacataactagagatcaattgtgattatgattgttatttgtaaccaagatctacatgatcatagctcacaaagatagttcatttataaaaatccactttctttgaccatgatcttcacttaccaatcatgtttcatggctgtcaagatgatttcctctactttaccaaactcaggataataacacaatatcctggaatcactaaaccgtttttcatggatgtggtattctgtttttttggggtcgggcagttgtaacacattcgaatagtctttgttgctaaagaacctaggagaagccaggtagaaattgctctaacgagggacttgcctcattttatggcccagttactgatttctccggttctcattaatcacttgctcagaagggaaagcttgcatcctttattcttgaaagtaggaaggaggtgctcttgctccacaactagtaggaagtaaatgtttgatactcctatttttttaaattctattcatgcttttattcaggtttttcagatttgcttaacacagcaggccaggctttgctgaaggtaaccggggttgggggtgccgcccatggctgtagggcaaaacaaagctccctggtcaccctcatgaaaccatggccatgacctcgttaactctgagctctgccttcactgaccagccactggggattgtcagcttagggcaattaccccttagtcctcacaccagctccacgtgtgagatgcctgtggcttctccaggctaagccctgtcaccgaaccaaactgggtccatttgcctgttcacaacagaaagccaaacaccaaagcactaggtttttatagcaagcaaggttaattgtgaattgactgacaaggagacaggaagatatgctcaaatctatctcccaaagctggggcctgggttgcattttatgagcataggataatgaggtccgatctgattggattttgagatgaggtgatgctgggaggcacgatctgattggatcctgtcatggggtgatgccagagctccatcttattggatcctggatcctgccatgtaatgtccacttcttaattcagtcccattccttggtcccagtgcttaggttctgcccatggttgcatgcttggatcatctagggatgcccaggttttgtgacctttaacctgagagtccatggcaactgaaaagcaactcacagcttggttgcataaaagttgaaccagattggtctgacgttgttacagctgttccacaatggagcagggctcctgagcattaatgatcacccatcgtgacacagtcccaaatacatgggaggcctggggttaaatctgactgtttgactttccctctgtatttgcctgttttctgacacctttctaaggggttgactgtttggggcaatttttgtaatctgtaaaggacatcagggtgcacttcagttgactgttgtaaaacaaaatgacaggtagtgaaaattttctatcaaaatagaataattttaacttttaaaataaggtggcagcattcattataaatattctaaaatgcagaaaagtataaagaaaaaataataatgaccccactacccactgacatcttctaggatcatccttccagttatctcttcacagacacacacacacatacacacacacacacacacacacacacacacacaccaattagtgatttcagataggcattcttatggatttttaattaactttagttaaaattggtacccaggttggaacttagtgaaatatgataaatctgtcttttgctgagtcactaagtgaatgttgactgtttacagaaaaaaagacaaaaatgtgaaactcataatcaccagcattatgtgtgatttttatcttctttttaaaatagctgcattatcctgaatttaatatggttccttaagatcaaaaaatgaagtgattttaaaattggctagaaagtatctatttgcttggcttattgaattttttacaactttaatttctgaatcttgctgttatcattgttaatgttagaagctgcaatgtgaatagcaaggtccgaaaaccatttttcacttttagcttcttattaaataacagcagattcggccgggcgcggtggctcatgcctgcattttgggaggctgaggcaggcggatcacgatgtcaagagatcaagacctcaagaccatcctggccaacatggtgaaaccctgtctctactaaaaatacaaaaattagctgggcgtggtggcgtgcgcctgtagtccccgctgctcgggaggctggggcaggagaatcacttgaacctgggaggcagaggttgcagtgagctgcgatcgcaccacttcactccagcctggcgacagagtgagactgtgtctcaaaataaataaataaataacagctcacctcctgcagtaggagcaaaggttacccagcaaaatatagtggagaattcaaacgaagaactagttaccttgtgttaaaaatactttaaggtaacctggaggcctgaatttattagctcacgcagcatacacctagtctaagtaagagagaagggatggaataatttttatgtcccaaagtcattaaatgcaaattaatgatgtctacattgttgaagttttgacaaaggaacacatgctggaagcttggaggttgattgctgaggaggtttgtttggtgggaatgggcgggtggcctgtgtttcttctgagaggagaacgtgtagtcctaagtgttcattctgaactaggagttcgtggacaaaaaccagtcgggggaaggtttcattccaggcctggtccaatcagttccctcagattgagtagttaacacatgaagagcatctgtgaatactcagaagccaactcaatcttgagaagcaagcaagcatttttcctaaaaatagctggtatttggtcactgtgatagatcgtttaagattatgagctaagtgtgtgtacatacacacactttaaatcgggaggagaacacagtttttgaagaccctgcattcttcatattaatttaacttggttttgagctgaacattgctcgtgtagtgggtgcagatgggaaggcacaggatggcaaagcataatgcctccctggcctccagataccaccagccatttcgtgaggtggatggacagacaaagcttgcggttcatagtaacgccagtatcaaaagaattagcatgggaggcacctcgtgggctgtcacccagacacaggccttagggctggtctccttcttacctacattagcaatcagaacagaaaagggcactctgggaggccaaggtgggcggatcatgaggtcaggagatagagaccatcctggctaacacggtgtaaccctgtctctactaaaaatacagaaaattagccaagtgtggtggcgggcacctgtagtcccagctactcgggaggctgaggcaggagaatggcatgaacccaggaggcagagcttgcagtgagccaagatcgagccactgcactccagcctgggcgacagagcgagactccgtctcaaaaaaaaaaaaaaaaaaaaaaagaaaagggtacaaagtatttgtaactcaaaagacaatacaggcaaaactaagtaacaagaaatactactgtcatgaaaatcatttctctcaagcattgttcaatttaagatgggagctaggaccatcctgtctggtatcaaaaattgtcatcaacataagaaccagtgcaatataaggagattccaagatattaagaataaaggtgatttttttaagtgactctcaaatgagagtgctctttaactggagttgatggggtattaacaagcggagcttaaagcactctattcaaaggtattatgtattatgtcacaaagtggagatgtggtcattgtacgccacgtaaccctgcagagcacaggaatacagaactctgtctgggtcacttatttctagaaagctatagacaaaggagctcacaggccagcaacagaattgattaaagggataggaagagtcatgatgagagcaaattaagtggcagaagtatgaataattgggctaagaaagggtgaagtaagtttaaagtaaaccaattctattatagctaatatttcttgaatgcatattctgtgccccaggcactgcataagccctttacgtgggtttagttttcacagcatttcactttcacagcaactctgtgagttaccactgttatccacgtgtaccgtaccaggaaactaaggtttgaggtaatggttaaggagcttggcctcattttcatagctagcgagtggcaagattttcaggtttgcagtgatacactctgtcctgtgctatttgatgtcatcacatacctcttcctaaaatttggattgggatgtttgtgcccatccacatgactctaaatacatgttttcagtgttgcctctatgtcaccttctgtcccttctcattcttctcggaacatgtgatgccttatattcttagttatgtaaacatcttgtctcttaaactggagctgatttcttgaggatggagaatgtgtttcctgtccaatacataagcactccagaagtgtttgcctttgatgtgtttcttttgattatgtctgtttaaaggatttttctctgataagcacctagcatgttactgtgtgttgtcagttactactcgttttagtacgtgtgtgtgtgtgtgtatttgtagcaggcgttctgtgcatgtgcattgtattcattatatgcacagaatgccagttctaagtgccaggcactacttgaacaacaaagaaaagagtagacactttgctcagtgtggtgaagaaaatcccctgtcagccctgaggatcctattacaagtctgaaagtgggcatacaaaaataattaagtttgtcttgaagttaggattagaaaagatgaatatttattaaagaaagcataaacattggattaattgtgttcaactttttgcaacttattttgcagctactccgttaattattgattgcagttttccttaagagacattgtttggcatatttatttgtgaagtaaagcaatttggattctcctattaattttacatagagaaattacgttggtatatcttgagataggaaggtacaaaatcaggacaggcttattctgccaggcccaatgtggcacatctgttttataagtaaacagaagttgaaattttatcttagataaagttcatcaaattttacttttgctaatacatgtaatcacctcagctatatagtttaagtattcaatgacagtaaactagtaagtattcttaataaactataaactgttaagtatttaactataactatctaagaaactcttaagtatttttaagcatggagattgatccccttcagggactatgaataataacttacacatttcatcttcagtccatctccccattatccacctaacactgccttgaacatggaggggaaaaaaaagtgttaatttaagaaaaaaaaaaaaaaaaaaaagctttggcatattccagggtattcatagtgatgtcttgagttattttacgaaacagttccaactgatttccagaaaccacagttgatgcataaattccctaatttgtttactttagagagatcatctcaagtgcagcatctgttttttgctttctctgtgcgatcttggttttacatcaggaggagtgaggcacagggacgtacaagagcggctcgggccacacaggcagctcctgaacctgctgtgtgctgtgtcaggagctttctgaaacagtggtgggtgtgcctcctgttactgctctgggtgggcaacttccacgtctgccttttcaactgtttctcaaggataaactccatctgccagataacattattttacaactagaagaatgtcacaactcaaattttgcttagtatgtcttattttggagaagcagctttcttctgtgaagctcagagcagtaacctaaaattactctcaatatgtagagggagagccttctggaagtgcagtggttatttatgaagcttgggtgggggagctccctgccatgttccagtgaaatcggagagataaaattttaatgttggaggcttttctaccattttgcttcttctgcagtccttgcagaagcagctgctataggaaatctatttccagagccctgtccaagcccatgcccagggtcacaggaggaggagcaccccgtagtttgtgatgttagtagaaaattcagggcattgaaaaccaggaaagtatcaacagcctccatctctgaaaaatagccaactgaattttctctcataaagggtggcccacgctggtcctccagcttcacttagagctcttgtaaagatgggcaggaattattgtgaatataaattcgagctgaagagaagagagggaagtgcagaaaatccaattaactgaagcgaaagtcatacagaataaactacccattgctaaaagaaataggttttaaattgaatgaatctttagagcagaattgatcaaatatgtccttattgtatgagaagatgcactttgcaaataatatttgtcgggaggcatcatctgcttgaggatgtttcatcttcttggtaagaaggccgttagaagtttggagcctttttcatcattgttattaacttgcaggggaaaatcttcctattccaatattcattaaatggatctctttgtgtatacaaatagtaaaagtagttttgaaagtactataggtaagcaaggggaaaaaatgcactgtttgtttcttcatagaactgacatttttatttagggaaaaatccatgaatttacaatctctccctttctaggtttttcaacatttcttgcaaattgtatgtaaatgaatgcaaataagcaatcctcactagcaagctgcttagaagtgtaaaatgcataaaattaagatactgagagaaacgtgcatctaattaaggtagcatgtaaagaaatgtttaaattcaaattagatacttcagtggaaagaatttacttgtttaattcaaaaggtgttttgtataattctgagaagcttgtccttagcagtacttccatttccttcaaagctccaaaaatcagttttaggagcttgccctggttcagttaaactttaaaattgggtttaagctaagaattggaatgtcataaaaatacgttctagttttaatgcctttacctcaaaaacagacttagagaggcgggcatgataatttgagagtgagagtgggtggatgtgtggatcactatttctatcccattcatagaaatggcacgtggtacttggatttcatgggttcttagaaagcctggagataacacagatcacaggcatctagttatccctggatcttaagaacattctaggagcaagacaggaaggatgccggcctgtgccatcaacagcccctccacactctgacgtccaggaggtcacctttactctttggggccatgtgagtccagtccaacctccagctgtgccagggacagaagaggaggagaggaatttggtctcagtttagaagcctattgtttaagtagatgaaaattttttttacgaagcattaagcaacaagcaaagtactgaagaaatataagatctgtgtggagaagacagaaactgtcttctaaggttggtgctgtttctgtctcagacacaagaaccaaaagggcagatagaaaaacaagcagggctggggacggtggctcacgcctgtaatcccagcactttgggaggccaaggtgggagggtctcttgaacccaggagtttgagatcagcctgggcaacatggcaaaaccctgtctctacccaaaacaaaacaaaaacaaacaaacaaaacccacaaacaagaattagctgggcatggtgacatatgcctgtagtcccaactactcaggaggctaaggtgggaggatcacttgagcccaggaggcagaggttgcaatgagccgggcactccagccagggtgacagagccagaccctgtctcaaaaaggaaaaaaaaaaaacaagcaggaaagtggtttttgctagttttcagaatgcctgattttgaagtgttccactgacctccacttcttttagtgagagttcttgctttctaccagatggcatattcctccaatttcagctgagcccgtgttttagcctgtaagcctatagtctctatttgctggcctcacagaggagaaatcattcattaagttttgatcatgtgcagtgtacaaattctctcttagactcaggttccctaatctgaagttcctgtctgtgtctgagctggggaattagaaaatgacgctgagactgttgttcttcactggggagttggatctgctctgtctcttcagcggggccaggaatccttctgaatcaatgccagacttctttcatcctccctccccctaggctcccagaccccatcttcacccccacccccacccccaaggctgaagcacagaccaaaccatgcaggactgtgaattgaaaagcatcttctggctggtgacatctgtttccaaatatccagcaagtctacttaggtttaatcagaagggtcacagttggtgtttcctccttgggccaggagatttttctcctatgggacttgggcctgatgccttccagtcaattagagctcctctccctctttgattcgttgatactttcagtggctgcctctcagccagtgactggttgggttagtgattcctctacttatagcacagactacatctagctgcccacttcctggataccccacattcaccatagtcgacatattccaaaatcagctctataactttcctctatagtggcttattctccgctctaaatctctcctggttaatgatgccattatcagccctcttctccttgcaaattgccaatgctatcactaggccatttttatttcttacctgagtttatgcagtagcctcctagctgctctcccatctcatcacacacttcctcactcctttctccacaccgttgatgaaacagctttttcttaaaacacaaatctcacataacatttcctgattaaagcctttctgatgctcccttgttaagttttttcctgtcttaaggggtctgggctctatctaacattgcactcatatgtctcctctcctccccgcattccacacaccagcctagttgaactacaggacccgcgagatgccatgctgccatttatatttttgtgcctttgcatatgctgttttctctgctcctccccaccggcatcctccaagttggcctggaaaactcctactcactttcctactcctcagagagttttttcttttctcaccctcccaggctgaatttgtcacgctctcttttgttgcattcccggcctctggttacagcatttatcatgcagtacactgaagagttgtttcctggtgtatctcccatttaggccatgggctcccaagggcagaaattgtgttgggtgagaaggtgcccagagataagactacggcagtgtttctcaaactttgtggccccaggatccctttacactcttaaaaactgttgagaacctcaaagggcatttagtttattatttgggtaaatatctgttgatatttcccactgaaatgtaaactgggaaatttaaaaatcatttattccttcaaaatgaacaataatgaacttattaagtattattataaaatacattttatataaataactgtgcagaataaaaaattgtaagaccagtggcattgtcttagatttttagaaatttctttgtgtctggcttatgaagggaagacaacaagatcctcctatttgctcctttagtcagtctgattcattgtgttgtttaatgtctgtgaagacaatacaatctaattgcagatatttttctggatcaaaacttgacaagtggtagtttcttactagttattgtaatgtgaaacctaaaaccttagggaacttttcttacagctaccttaaaaccgctcatctctcttgcacctccaatagcccttttgcccatgaatgttttacttataccatgcattggtcacttggaaaatgtgagaccactgagttatgcaaatcctccaacagatggtacactctgtcatacaataaaaaaagataacagaaatcttaattatgcaaccatcaaagtcatgatggtagacagaagttttccaaagttctgattttcacttgaaagctcaaattttatcattggcaacaaatactgtcagtggttttcctcaaagggataggctcattttgctcattttcaagaaaatggctttttaaatgcctaagtctgaataacaggtttttgtcagttgtccttttttgggaaaagtggtgttctgtgaagcaggtggctagttcagctcacaactcaattgcacaggtgcttttccttgagacaaacatcatacttcagtaggtcatggaaacatgtacttgccttctcataacagactatttaaaagatacttactcaggatcaggatttaccaaattaatacttactgcctcatccagggcatgcctaagtgatgctggcattgattttccttcaagtgctcagaggggcaaatgcagtgaccactagtatcgtttggtgacactggctgccttgatctgtgccaagttgccagctgttttgccccctcccctatggcgtttgcaccaccaacaaagtgttaaccccataaagaaggaaagaaatgtcttagcagcatttttaaaatttatttttatttttgtaatgtagagtcttgctctgttacccaggctgcagtgcagtggcactgttatggctcactgcatcctccagctcctgggctcaagggctcctcccctcacctcagcctcacaagtagctggggaccatgcccaggttatttattatttttatttttatttttgtagagacagggtctttctatgttgcccaggcttgtcttgagctcttggcctcaggcaaccctcccacctcagcctcccaaagcactgagattacaggcatgaaccatggctcccagccaagaaatgtcttagtatttttatcaaatacttttgacctcgtaaaacctctggaaggatcttgtagacccctaggagtccatagaccacactttgggagccatgggactgactggagtgaagcagaggcccctcataccaggttgcagagtccatgctgtgttgggaagggtgtggggggagaagtgctgtggtcagatttgtttcttggaatgaccatggtggcaagagagtggagcagtggagcatcttctggggagttggaaaattggaactgaacatcattgctggaaaaaaaaaaagcgattttaagttgccatatgaatataggatgattatgtaagccccaaattcttcaaccctttggagtgatgttttcattccaaatcacattcaagtgtgtgaaactaggttgaagtattttctggtattatttcagaatagtattatttctattctgtgaatgaatttgggtgtgtgtgcacatgtgtcggtgtacgtaaagcttgtatgtgcatgtaccgttggctggtgggtatcctgggcaattcttttctggcccaggttgtctttgtgttttgtcatcagaagtgcattccttagactctgcatgttatcctggatcataagtaaaaaacgtttgtttaccctaaagacctcccactcagtggaagcgtgggagacacattcctgagttaaaaaggtctagatcaatataatattcagaagtaattgcaagtgattctaaccaacccagcagtgcttacttaggactgtgttcaagagcctccttgcctctttgttgatctctttaaataccaaacaaaagacaatgaatcttccaactcaggcgattccattgtgattgatctgagccaattttttgaggtaattgatgatattgccttagttgagtctgttagtgcaaataattattaatcaatatgctctcagctcttagttcagaagataattctaacacatgatttatgctgaacatttcaattgagctacctttacaagaggaaaatcaattggcgagtgttctaaagcactttaattatctgcagctccacgttcctccgcagccatatttacccagacagctagttgtcccatcctagaaagggtcacaggaagtttttcatcgccacggtagagagatagtatatcgttcatcttagattgactatgttggtttaaagtaatttagtggaataccttaaaatcaaagcattgctgctttcctttggagagcataattaacattgcccaggaaaaagaaggaacgtgttactgatctccattcagttggaaaacagtttgccaatgtggatagtgaatgtcatgtaagtcaatttagccgtaaaacgtgaggagatctgaatcacagaaaggaggttaaggtgtaaaacattttaggggctaaatttacatcactcccctaaactgttgtttagattctttgtgacttccttgtgctaaggctttctagcatggaatttgttgtttttcccttttagacaatgtcttgatgaatattgtggtttgatttttcccccctgtgagaggagatgcagaagaaattaatcaccactaggaatgggcctgcctttgttcaaagtggagcttccaagcatctgtttttgttgtacttgtggtgggtacaggaatgtgtgggctctggcctgggacttttggacatgtttataacagatggaaattttaaatgacagttccctgcattgtcatggtggagccacttcaatagcactgagatgctctgttatacttcttgcccagtactctgtctcttgctgctattaaagcatctctaaatggtaaaacgtgaaggcatttggcagctttcaagggcagttctttaacgtctccactctctacccccatgtacccctgggacccccaaaacttggacccaagacttcacgtagcaataaactgaaacaccactcattgttcacagctgggccagtgctggggctccagaaggtaatgctcttaagcactgaattgtgagttcatactatcaattaaacagcaggagagaggaaagggaggttttgacttgggatttttgaggagcgaattcagtaggcatttttggaatgcctggcttggagctagctctacagggaagaccaagaaaaatgaagccctgcttttgcctttaggaagtcacagtcctgttgggaagggttggagtggagaggggagacctcagccattaagaatacaggagagaggggctgacaccagaaggtctgtgggcagagacagacggctgagtccttggcacccagggaagaggaaggagaggctgacgggtcacaggatggcatcttacatggccttttgaggttgccactgcttatgtcctcctcctgttccccaactgctcccctcattcttccctgggaatggtagcttactctgggctcatcagagggaaaacaagaaactgtgatacataaattctgcaactggttgtggtcctggtgatgacttcttccagaatggctctctcagtccaacagtgaggtgagattgagggtcggaaccattagggtacaatggtccaaattccagcctgcacctgaaaatcccagtgtttgggaatctgattggggagcatcctggaggcaggctgggtttctttttttttttttttttttaagagggtctcattctgtcacccaggctggagtgcagtggtgcaatcatagcccgctacagccttgaactcctgggctcaagccatctctccacctctgccttccagagtgctgggattacaggcgtgagctaccccgtccggctttagggctgggttttgaggaagttgtgtcctcgtggcctgagctttccttttcttcctgcatctcctcccctatgtgatgcctcccccctgctcgttgtttgggttgcagggtgagagagagaaccttctccaagtcctgactgctccctgggcccaagttcaggctgagctccttcactggccctgcaattttacacatgccgctcaactccttggaaacaaaggtttcctctctgtaagatgaaggtgatacgtaacccctggggttgtgagaattaaaggaggcacattttaaagcactttttaaactgtaaaactctgcaatataatgtgtaatatggatattcctatgcaaatataatataatataatataatataatataatataatataatatagaagatgttactgtgttcagttttattattttacctggctgcctactcagggtcctgtgatgttctctgtaactgctctagttcagaaatgaagcctcgagtaggaggtgtgggcactgcctgccctggcttctttctaccaaagtgacttagatgtcttggagctaaaacatgagaggcaaaaaatatcttaaagataaatgccgtgtctgtgttgcatataaaattcaataaatatccagtaactgttgagatatgagcccatgaacagaaaaaagaaaaaaaatccagtaaatgaaggaattactttaaaagatttcagtcttttccttttgtctttttctgtttttaatatacatgaagactaatttaaagacccttttctctttttaagtatgtttggagatctgtatgacaaattggctcctaacattgtataatactaatgacaggatatgaaagacagcattctttaggacaaaggaatgcagttttcaaagaccaataaaagttggcaaagaaatttgcagatcaggacccaggacaatgcttacataacctctcaactgtttttccaggtttgaagtgcaaataacagagataaagacagaaactacacatgtaaacttgatatattaatagctcatccaatctacataacaaaataaaccaggggtctaggccctaaaagtgatagccgtggtgttagatttctgggcctcctttattccaggggatggggctctgacaggtgaaacacagcatttgtttaaacagaatagagaaagtctgcaaaacattcaagggcaggaagtagcaataaatactcctctgtgcaactgaagcagcacagagcttggggtgagcagaatgtcatcactcaaagtagaatttggccagggcctcccagggtcccaccaagggatgcagtgaactttctaaaagtcaagacctctgtcttatctcctccaaaagatgagaaagtgagatgtgaagctcctttctggagatgggatatgtttttcatggtaggttctgatctcttttgcaggctttgagcataagaaccaagggcacaaaaatagctccttgagggaaaaaaaaaaaaaaaaaccgaaaggcctggaacacaggatgatgtgcaggcgttggtgagctggggttgtaaatcgacaatcccttgaacagaggaagacctagttaaagagactttggttttcttataaggcatgaataaacgctctgggcagtctgccccattggaaaacagaataatgctaataatttgcatttatataataccccccggcttgtggatctacaagcactttgcaaacattaattaattctctaaaccccctatgagccagggggtgccatcagtaactaatcacgaaggagggcaagtgattcttgacagagtggatatgcaagttagagaacactgcgagcttgggagctgaagaggttgagtggaatttttatgagaaagaacaaccaaggtagaatgttgatcagactgtgtgggaaacaaacctggatattatgaccataggtgaaggctatcaactaacaattcagttcctctcctgttgttcgcctcttcattttcaaagctctgcttatacttggtcggaaacctcagtgtgaaggtctggattcagttcactattcccagtataaaaggatgtgcagactgagcacagtggctcacacctgtaatcctagcacttcaggaggcagaggcagatgggttgcttgagcctaggagttagagaccagcctgggcaacacagcagaaaccctgtctctacaaaaaatacaaaaattagccagccatgatggcgcacacctatagtctcagctacccaggaggctgaagttggagtgatatggctccgatgactggaggaaccccagggttcttggtttcatgccgataggattaacgacacgtacatacgtggagtggttttaaggagggcaaagtttaataggcaagcaagaaagaagagaacagctcccccatacagagaaaagggaggggggcttggaacaaagagaaacccagtgtgcggcagaaaagtggttgcttatattgggatgctggaggagacggtgtgttatttacgtagccccgtgaaaacctggccctcccaccttagacttttaatatgcaaatgcagacgccatgatgttttgaacacatggtgttatccgcaggtggccatgacacttggtacacctggtgagaagagggcgggaatcaccatgttggccgtgttaggtagacccagtttctactcgcctgcatttgtgtattaaagcttgccagcctggctcttcaagctgcctttctgttagaaaagaaacagtttggaggttgcttttattaaacgaaaaacccttatcaagaagtccttttaccctttctatctgcctaaaaattatttcttaataactcctgtattaggaggatcacccgagcccagggaggtggaggctgtggtgagctgtgatcaccccgctgcactccagtctgggcgacagagcaagaccctgtctcaaaaagatatgcagcagctggatcatactagaaatcagtatttctgttgctgtgttaatagtcagttcagagattcattcatgcgttgacttattcactcagtcactgctttatttgacagataggagtttttgagttcttgctccccgttagacttgggggttatcccccaaaggcttatatatgagaaaagcaattccctgctcttggtctagtggctcagtgatactttctttcttctctatcatgtattttttgtttccccagtctgcttatctgacatagatgttaggataattgaaatgtttttgcaatgttgatgtaatttatgagtaaacattgctgtatatatttgaatttctgatgagaaagacactatgcacagaggagagtaatgacctggcgtaagagaacccatttacaccaatagttacgtctcactaaatcgggcctgttagattaaaggactgttggtattcatgactttttttttttttttttttaagaaatgtagtttgaagctaaaccaacaaagtgccacttattggtggtactgagggagtttgcatttactgaatagataagatttgttcgtgatcttttggctgatatcacaatggaacagataggttacttttcaggtcctcaaaagttggatataccaggtgttttccgaaattgattctcattcttgtagatgtcccaaaaattcaagtaatttgcacaataaacctgtataaattagtagaaaagccaatttcactttagctctaagtggtaggaatcaatggtatatgaattcttgagatgtttttatgtacacacacatacatctctactaaagtgtaagtcagatgaagtggatctttttttgttaaatcatttttatgttactttcgagttaactagtatatgtagagaaatctatgtgtaaagaagtatcaatatttctcttcaagtattttgaactctaggacagatgatgctaatgaggcccgtccttgctggagctgcctgtcagaacagcaaggtaggcatggcctggggcaggggagctctgtctggtctgtggaccatcaatccagcgctcggactcctcctcccagcaagacaagcactttctttcaggctgctgccagctggttttgctgtgcggtagtgttaagctttccagattgaaaacatctggcttttcatcagcggtatagactcagaaagagagcagtgttagccgaagtaaattcaacaaattcttatctgacacgttcggtttatcctaatgtgataaactggggcagtctctgaggatgagtcctgtttccaactgtgcaccttttccctctatccttaccctgtccttggaagaatcttgatgttaaaatttgggactgtgtctttgttggaggcatcagatgcactgtcggtagcgatttctgaaagtccagagagtcatttgcatagaggtcaaacacaatatttcctgcaggaacttcctgaatgatgaagtttcagagcaatcccatgtaaccagatgtcagcaggttccaaaaagatgactggctacctgttgctgttacaagcaggagacctctagtgttaactaatttcagaggaaatttgtaaatattaagaatagaaaactgtgtatgtatctactcaacacatattgagaaaatgacagattgtggtgatgtgacactttgggttgtatctgccttttgaaagcatcctttatgttttctcactcatttcttctacagcactttatatggcttggtagggaaattctgagactaaaaattaatatcatcatccctctgagtttttgcatatgaatgcttttcaacttgcaaactggtcgttatacagatacgtatttttgaacagtgatttacaaacccaacttttgttaactggatcatagcttcccactgagttaaggcttcagagctggctgatcagtgtttatggttggtctggtgttgtcattggtctttgcactttagtttgaagtacctcaagaagttaatgacctgttaaaagaaaatccactacagaatattctccttaaaagatacaggtgtaagccaggaatatttatattgtggtagcagtaatgttgcacaggtatagtgtgtcagttgtacatcagcacaacagtctatcaagatggtagtaattagccccatgttacattaaggctcagagaggtaaagtagctcacctcaggacacacagctagtcataagtacctgtgtttgttgctcccctggtgaccaaaaatattgggctttgctcctgttccacaagcgcattgggtgttgctccagggcctttgcacttgctgtgtcttctgtttgcagttctgttttctcatgttaaagaagtcctttttgtcatttagaactcaactcccctctctttagagagctcaagcaggccagcacttagactcctcctcccagcaagacacgagggcagttgtttccttagattcccattgatttagattttccacaaatttgcacaaaactttataaattagtagaaaagccaatttcagtagtctagctttttccaagttgtaggaattaatggtatgtgaatttttgaggtttttatgttcacacatgtatgtttctactacagtatgagtcaaatgaaatggtttaataattttttcatgtgttaaatcatttttatgttcttctcaagttatgaccatgctgtcacagcaaaatggtgtctcaaacccactcaagagagactccttcctgcagttacctagaaccagcctgtctcatctctccgcctccattattgctatcctgtattaataaggagttttataaacagtgtaatttggattgtttgcaactcaatggaaaaatgcttgaaggggtccaggcgcattggctcatgcctgtaatcccaacactttgggtggctgaggcaggcggatcatgaggtgaggagaccgagaccatcctggccaacatggtgaaaccccgtctctactaaaaacacaaaattagccaggcgtggtggcgggtgcctgtaatcccagctactcaggaggctgaggcaggagaatcgcttgaacccgggacggggaggttgcagtgagctgagatcgtgccactgcactccagcctgggcgacagagcgagactccgtctcaaaaaaaaaacaaaaatgcttgaagggatggataccccactcttcatgaagtgcttatgtcacattgcatgcctgtatcaaaacatctcatgtaccccataaatatatacccctactatgctcccacaaaaattaaaaattaaaaaaaaaataaggcattttaaccacagtccctcctaaagcacacctgctacctgcacatgtgccctttctcctcttttgctttttcctaaaggacatggttgagaaaactgctctattaaaatataatatggttcagtttggtgtatattgtgattattttatttgcttttttaccttggactcagtcttctcctttcataaacctgaatatgcatgttgtgtagcttcgctggattcaaattagataatttcatttcaaacagatacagccaagcatatggtatttggtatgagttgtgcaaagaaagtcaagttaggttatgaacaagtgagttctgagtttctttttagcgaagggacatttatttatcttggattgttacagcgattttctggactatttttctgtaattaccttgattaatatttaagtggtatgtttacattttgagttgatttatatgaagctgtgcttttcctccactgaaacactcaggtatctcatattaccatgatgatagaaaccattctctgctccttgctttcccaatagaagaatggcagtttatccacgggtatttggagaaggagcagcattcacacagcagaaatgttccactggagggctatccttccagagccccttgctagttatagatacctccacttagggcctctgtgacctgcaataaatttaaaaatacagtctctaaattttatatgtgtgtgtgtgtgtgtgtgtgtgtgtgtgtgcgcgcacgcacatgcgtgctataaatgaattccctatatgctatttctgtgttagaaggacagggagaaatattgacgtcttttcttcctattttggtattttcccttgctttcttctctgccttcctcagttcccctgggaggtgaggcatttggggcagggtcagtgtgtttgcctggtggtctgggtgaacttgcagaggccgtcagccatgactcagcatcaagtcctgacactaattcttgtttcctgtcacatcctaaccaagtcatttatcttcttggaacctcaattccatcactggtaaggcagttatgataatactctgggtccttgttaaagttatgaaagcattctattaggtgaccactaagcaaattatgggaagttaaaattattgtatccattatcaccaaattgttttttctttctaccacagagctttctttctttcttggagctggcaaatgtctactcctttgtaggtcccaaaccctgtgcctaaaggtttagcatctctgtgatgagtttaatggaggcaggaccagtctgttctccgttgtgattgcagattttgaggagctattttgaggaggatccaggaggtttactttcttatccctgtttttccttgggatcaattcttacgctaaaggtcaatgtttgtgaaacatgctgtccctcctgcatttcttttttgcccagggacatttaaagtcattatcttgccttgaaaagattaaaaaatgttggcacctccgtctttgtggtgcaaagtgatcttgggctgttgaccaagctgacttgatccctggaatgtcttgatctaaattcatcttttcttttgttgctgaaagtttagggtttccgcttgctgaaattggatttatgaataaaagaagccaactttgctgtaggtaattatgtcagaggcaagttcatcggtgtcagtgttcattttattagagaaggcttagcttattcacaatgcatcttttatccccttgtctctaataaatgcatgattttcagagatttgcagccaaaagtgtgttattccaattaggttacttatgtcaaacataaacctttcctgtatatatgttatttttttacagctaagttcagtagaaaatccttatgcagacattgatatgtatattttaggttatgttttcctgcaatagtatgtctctggaccagtgatagtaatttgtgtcaataactttataaagcgagaagcagttgaagaaattagaacggctgagggccagaagtcctcagcagggaaaagaaacacacgtgcagcagattaaggggaaagggccaaggaaagcgaggacccccactttctggtgtctctctggtaactggaagggcggatatgagcggttcgcaggcaccagtctttaaagcgcctgtgatgttctcctgactggcgtgggcttcctgccctttcaagagaactccttgatcatgcattctactaaaacgaggcagccctgggaggcgagtcttgcgttctaattgcccagtgggttgaggtttggggacaataagtggatatcaaggaaaggtcagacttgaaagctagcaacccagtgagcagaccaaatcggagagaacgaagaatgactttttttcttcttcttaattactttgtctaaggtagagggtttccttcttaaacattttgaaatctggctgatgaatacttgtcaaactgatttggggggtatttgtctaatcttttatcttattccatcagatcatgaatgaaaatgaaagctctgaaagagttttgctcccaatggaaaaaaataatagcacaggagctgcatagggagatgaggaggggctggaaaagtcatggggtcaaagcggtgcacagcacatgggttattttttgctactaccttccacatctgctgggctatggtgaaatttgaaatattttatattttttaaatattatatatccttttgctctttcttgccttcagcgtacctgtatatgttagccttaaattgtaagaccaagacatttataataaaagcaaaataatagtataggttccttcaatgagagggtaaatcatcccatccaaaccaacacacacaaacacagaccccacaccgacacacaaacacacatgtacaccacaccacacacaccccgacacacacacataccctgacacacacacacacacacacacaacctgcttctcctaaggaaggactttaaagagaaaaacactcttgattgtgcacaattacaaatcactttccattgacaattttgtaaccaaggaaagccctgggagttcagtggctttgtcatttagagttttaccattggctgactttgatctccacagcacagccttgcttactcctttgcaagctatattttttgtttgtttttaagtgtagtcattttctgatctgattgcaccagcctttccaaaacctaagtctcttaacccagaagtccaggcctctttctaatggtgctggaggaatgattggcaagcctgagatccgggagtggagattatagggaacggtacaggtggcaggagctgccccagagacaaagtcaacaccactggggccattattttcgttggaaatgcgtaagaaaaccattcctcaaagtggaaacaataaacacattatctacttccaccatcagctaattgaggctgtctctcaataaacaagtggattttctgctaacaagcacatctgtctacaactttaatctcctgtgcttttctgccctgtccccgttttatttatactcattccaatttttcttaataatgttacatattagacttaaagtctctccttttgcatcctcttggcttagaagtcagtgactgccattttattgtaggacaatttttaaaattgaaattaaaattaaatttgtttaactcttcattttcttggctctaatacgtcaaagaagggagcccaaacgcatagaaaacctagtaattttagtggcatgataatagcctcctttttttatactgacaccttatggtaaaaatcatgtcaaattagaatgatcacttttagttcaaaaatatgaaataaagttttagagaaacatatttgctaaactaattacctactaatttatctatttgtgaattgttctcagtgtgtgaagaatgctgagtgactgaagtcaccatttgaaaattgtctcaattcagtaagaagggaagagattgttatgagtatgatgcaggtagcttaggaacgtaaacacctgttctgtttagcaatataagggggtttgaataaactgacatatggggatttaacacttaaattgttcatataattttactttaaaattctcagtcatcccataaaactgattgttttaaactccctttcctatatcctataatattcactttgtatttccttctaatacaagggaaagtacttgctttattagcctctttaaaatccagaacattcatttattataaattgtctgatacttgaatgtctaaataaaatatcccattgcttgcctaaggaatatttttccccaggtgaaaatatattttactttatgtgactgtgatgataaaattgcttagtatactttttgagtcaaaaattcatgtagacaatttaaatgtgcaagtttatgatccagtctctggggcccctgcattggcatatggaagcatatttaagtttatttttaatttcctttatggctggcatggtttctttgggttctgacacaggcataagcacacacatgtacacacacactagcagaaagcataaacagggctttcccaagttatccaggcaattttctgaatgagttgcaaaactgaaattaatatctatctttagagtcttcaaggacaaaagcacatcatctgccagccctgctcgatgcttagctctccatgaagttaatgtgggttttgtgtatataaaggcaaatgattcttttttaccatgtgcagttaaatcccataatggtacatgctccgatttaattagttctcatcatataatgggatgcagccagattgatacaattaataatgatgttagtaaaaacttccccattctagatacgaggaactccaggtgtcaaaataagcatgtattaattttaaaatacaatgaattggccttaagaagaaaaaaaatacaatgaatcttaaattaattttgaaacgaattgtattataaataaaataacagatactgtttttcctgtgataactaaaaagatggtttcccattatcagtgtcattatttttttccagtaaaatcatatatacaaccataatatagaagaacaatcaaaacaatgttagtttactagtatacatttattttaaggtcaaagtcaccacatttatttattcttaatatcagcctttgagaatattgaggcacctctgtagactcatagaattctgagaaatattgtttgaaaaattatcatcttctggatagaacccaagctctttgatgacttccttacttcatccacaacctaaatttttgcctgatactgtcccttttatgccagccagacaggtggcctcactgtgcactaagcaccagggtttcaggactccacgcccccgaccttgaatgctcttcccctctttcttacacatttttcctgaccttcaatgtgtaacacaagcatttcttttctgtagtgaatacagtttcataatatctcttgcattgggatccttggctctgtaaactacttacctgcttatgtgtgtacatcttatcttcccatctagattgcaagtgtcttcagtaaaaagtaagggaaaaacacttgcactcttctcaagctcaacctaacgcagtagtcatgcatatagttgttaattctcaccggatgaatttatgatggtagtatctttccgaaagtctgttttgagcagccccactagaatagagcacctaagtgtgtttctagttggccacgtgtatgctgaagtacattttcctaatgaagcatcgttatgcttggtgacatccctgacacagaggtttaacggtccatccaccagtcagcacatgttgctttcatgaccaaccatgtaacatgctgatatgaggaaatcatatcagatcttgccttgggggtgcagcagtgtctaggtaaagctcccttggtgatagggacctagggccttgggatttggctgtagcaaaactcaaaacagagatgggagatgatagctagaattcctggggccacattcaccagttaaacttcttcatttgccttgggcatttggcaaatgaagccaggagctctgatgtggaaaattagggcagtgactgggtggcttattcagtagcaggtgtgtaagctggttttctagaagctggtgatgacctgcccttagagaggcagtcaaatcagtgtcttcctcttagaaaagtgagaatgatggctgggatgttggagggtttgataaacacttttcctagctttgccattgtgatatacaggtgtggtatatgtaaaagttagtttcttctatacttcagtttactcaagaggaaaattatagcattcttcatcttaacaagatccctgtaaagttgcatatatgaaaaatgggccaggtggaggaaaaaagttacaatatttacatcaagcctgtggataagtattacatgtgttctcagatcattggatgtttttgtatgcagctcccaaagttcattcctgtcctcaaaccttgatccccactgacaaacagaactgcatttattacaacctgaacaccacaaatcctggtaccgtggacatgggtttgcttattgcatggccttgaaatattacaagctgaggtttgccagtactctggttattcaggatgtacagtttatttcacagtcaaccaggaagccatgttgcaagacttcggggtttttcggaaggaggaagacacagccgatacccgcacagagattcagatgtagttgtgaaaataaggcatccatatgtgcaaaattaatgcctgcaatagggctagacgattcctgactaattagtcatgcggtaaacaaagaagtgcttgaattcaaaacaggcaatatctctgatgtctgaagtgatttggaagatttcataaaaggatttcccgatggagtaggatataaactagtagcagagcaggtagtgatgaatatttactgtttcttatttgttttctcattgttcatatgtaataatgaatacattactcattacttctaatcagtgaatattgttatgtaaatttcacagcaattatctgtacctttttagcaggatattttaactcccatttatgtcattttgcttgggtgggttttttttttgtttttttttttgttgtttttttgtttttgtttttgtttgttttttgtcgccaaatgatgaatctcagaagatttgtaacagagcataaactgacttgtgcagtgagttgtgacatacagcatgggggatctgagtccttgctactcaaaaggtggtccatgcacagcagtctcagcatcacagactctcacaccccaccccagacctgctgaatcaaaatttgcatttttaaaaggtccctaaataacacacgtgcacattacatggaagaaatcactcgtctcagatatttgcattaagcctttagtgttccattctcattctgttatgttggagctttttataaaattgtgaaggtgggtgtttaatctctacagatgtaattttctctgagcatgacacattatttagtagaatgaagttttatagtactatggatgagtgattctgaccgtagttaaaagtttagtgaatacctaaactattttcccagcacttggagtttttcaaaactcaagtcatgttttggaaaacactattttcccttttatatctaagcccatatgaattcaattttgtggaaaatttaagccacatgtttctgattcgtttacacttaacccttgagaatgttgtgttgcaacagcaattgcctgtccaaaaaaatctctttttagtaaatctttcacaagggtagagagattgggaaaaagagaaatgggaagaagtcactgaaaagacccagagaagttgggggttgggttgaggactctgaattttttttttttttttttttttttttttttttttgagatggagtctcatctctgtcacccaggctggaatgccgtggctcagtcttgactcactgaaacctccacctcctgggttcaagtgattctcctgcctcagccttctgagtagctgggattataggcacacaccaccacacctggcttatttttatatttttagtagaaacgggatttcaccatattggctaggctggtcttgaactcctgacctcaggtgatccaccctgcctcggcctcccaaagtgctgggattacaggtgtgagccaccgcacctggcctgaggactctgaatcttgatacaggactgtgcagattgtatttgtgaataacttcttttctgacatctgagggaggacaggaggggtaggaggaccatgtagtctcatgcgttgaaacagtggacgcacagatcctgcaacattgtcaaaatccatgtttttactaaacatacattaatatttctttctcttacttctacaagttaaattaatatcactttgtggaatttttggttttgggctccagcagagatctcgtccatatttagtattagccagcgtcttagcaatgttgacaaaaggtgagaggaaaaattgctgaacatgatgctgcaaaagcctctctctatgtgtgatgaactgaaaaaggcaacctcgattatcttttttgagcgtttcagtttgagctgatgcataaccagggaatgtaaaagatccgttaaccttctttttgcctttcagtaaagcttgagttttagcttgtcaaattatacattcaatgattgtatggataccatcttttttgatggatggatagtgtgtataaacgtgtgtgtatacatgtgagactatatgtcatgaataaagagtgagtgtttatggtggaggaaaacaatgatcaaattaatcatgttttctatttagacatctatccctaaatttagtgagtttgtttagataagacgacctggcttgattacagctctgagtagccattggtaaatgaaagagcatttgaattccgcgtctagcacattattccagggagccagcaaatacatattcatatgacagatgcactaatcaaggctgaaggtcttacttaaatattttaaaaagcaaccttggcagtagaaggcaaatagaactagtctagatggtgtttttgccagtttccctcttgctgtaggctttctcataatcctcttttgttgtgacatggaatgtctttaatcatgccatgccctttatctagaaagatggcttttctccccctgcatcagctgcctctttccttctaggatcaacccagtgtctgtctgtggtccttccctgggcccctctgtctagggtcagtgtctacaatctgtgcttcccacacactctatgcttacctctatcctgatgtttgtcacagtggtatataattaactgtttacatgccagtcttccccagggtagtctctgtcttgtgcatctctgtgtctaccacctaactcagaggaggcactcaatgaagttattgaattaatagatccatgactgaagaagtttcctaagggccaggcatggtgggccacacctgtaataccaatactttgagaggctgaggtgggaggattgcttgacaccagagttctagaccagcctgggcagcatagcaagaccggtctctacaagaaattttaaaattagctgggcgtggtggtgtgcaactgtagttccagctacttgggaggctgaggcaggaggatctcttgagcccagaagctggaggctgcagtaggctatgattgcaccactgcactccaacctggacaacagagtgagaccctgtctcaaaaaatagcaacaacaaaagtatcctaaattagctctgaaaagctataaacgtctaataatgtcaaacttgagtttgtggattgagtatatgttaaggattctgcaagtgaatctagtgttgtcagctcatgtcacacagaagctgagccttgcttctctggttacaatctgggctcctctttgctgggcaccctgcagatacatcctgcagggcaggggaggctgtctaaaagaagctggtggccccctgtggccatcattcttagagagagaaccccaggcagaggtatccagggaaccttcattcaattgtcggaacttaatgccataatgccttaactgtggtttccatgagtctatacgtgccatctttcactccattctttaggttgttgaaactgtatcccagttttaaagactttcacagatgacatcttcatcgtttccttctctaacctgttccatcgtgtgtttaataagtctttctgtcagaaaggtattctttttctctcatctaaatccccacatgcccatttttctccatttggtccctagtagtgaggaggaacagctgaccacctcaaagttttcttctctgtccatcccctggctcatgtatcatccccttagggttttcaagtttctcattatatttgtcagtaaaactaagagatgaactttcaactccaagtttatcaccagaatatccagcttcttttgtcatctcctgctctcctgcgtgtcttctcccaaactattttctgtttccttttgtcaccatcatggaaaacggaacttattctttcactgtgctctatattttatcttcttgtgcaattgtaagcatcttgagagtaaagattgtacagatcttctttctatttcctgcaatgcacagcacatagaaattgaatttcctggcagctgtaactgtctttgatatacctagccccggtttgtctgaaattgatcaagaaatgtagccagtaaacttaattcctattcaaaggggaaagtgtgtactgtgtacagaagaggcattttacatagagaagctcagcaccaaaatctaatgtgcaaaagcaagatgcagagcagagaagattctgtactctacatttgagagctctttatttgtcaacaaggcagcagatatttctaggtagcgttggtgcaatccagtatagaaagtggatttgttggtattacacataattaggaagcaggaacatcagtaattactgtgagaggattttgtatggcataattaatgccctcaaactatttagaaattcttagatgaaagaaaatacagaagtgggaattttggtgttgaaaagacaaaggcaaactgtgttggaaatatgttaccaaacatcatgttttatgagcacagattggcaaaacatcaggacacagctgttgattatagctgctcttttcagtaactgcctcagagccaatgaatccttcgcggggagggcctgtcaggacatatcagagtgcagctcctcgccctcccaatgacttaccaaatcacacgcctgccctagagagacccaccagtgtcttaggaagtattggctaaatggaaccacatagcaatgtgtggccttggatatttaacatcaaaatcatgctttggcaagacatgttggcatcactcatcaacaggctctcagttctctggattaaaggcaaaaaataaaataatcaaagtcactttaaaattagtgacatgttttatactaagataattttgcagaaaaactgccattttaaatcaaagtacgcagcaagggagtgatctactaggctttcatatcaaatataaaactaccactaaataactgtttctgaaacttcatgtgtagtttatcatatattaaattattaacatttctgttggaggaggtatttttcataaaatatttaagcttcacatctcagaacactatttcaacaacagataccaaagctataaaatgaatgttacagttctatcaaatattcagccttttcattaaggaaaaaaagaagaaaagaaaaaaaccatattaagccattactatgacacgacctttgctcaaaaaaaaactcatgtttcaacataaccctcttgcacccctgggaacatgaaggccagaggtcacccttttttttgttcatggtagtccatgatttggggacatagggtcagtggatatttcaattagtatcaagagttaattattgtatcagaggacacaaatgagaagctatcaaaataatttaattagaaaacaaattagaaattaaatacatcttataaaatgaccttccattcctagggcagagacacgttcaagcgtaaacaagttattctggctgaagttgatagaataagcttagcatatatcaaagaaaaaactacccttaagcaaaacgtttttctattttattcggttctgctttccatatgcgttctcatatttttttcatttcagatgttcttccttacatatacctaaatattaccttttgccattttctactgctaaccacagaagtaacttcaggacttgagggttttgggggctttggggtgttttttttttaatgtttcatatttcttcagagaaggaaaaagtcttgtcatttatggagcaccttttcacgaaaaccacgcagtgctgttcctagtgtagaccattaaagtgaaaaagcattactggcagactaattgtgtatggtgtagcatgcagtctatcacagtaacccatcacacaccaaaatgcacatgccggcagacccgtgcaacgatggttgatgttcacagtgaccctgaggtgttctgtgtaattttgagctaaggatactttattatagtcaaactttttggaggtaaggtctatatgaatacttattagtgaacagcatatagttggtcattgtgggtaagtgggagatttccttgacaggttattccctcagacacacagacccaggcccgtaagcggcagatttagacagcagaaaatccaagctcgacgctgcagcaggcgtaactctttagtggtacagcaggtttacatcattactgcccagacaaattggtcatgcgtctttaatttgttctcacaaatcactcccttcactagtgtgatagttttgttttgcaaatagtgactctaacagagtgtatagtttcagatagaatatttggcatgttgatgctgaatcatgccagccacctttccttaaggagaaatggaggaaaaaacacaccttacaacaatctttaaggttctcgtttagttggtgttcttaaaaaagaagtatttaaggagaattataggttggctattgtgtgtgttgtgggggtgcttgcttggtgttttgtgagtggacactcatcctggaagaaggaaggggcatcgggcagtcccagccagggtacatgggtgtagagtcctttctgaactctttttttttttagacaggatcttactctgttacccaggctggagtgaagcggcatggtcatggttcactgtaggctcaaattcctggactcaagcaattccgcctgcctgcccccgccttagcctcctgagtagttgggactataggctcaccaccatcccccagctaattaaaaaatatatattttttgtagagacaggatctcactgtgttacccaggctagtcttgaactcctggcgtcaagcagtcttcttgccttggcttcccatagagctgggattacaagtgtgagccacctcgcccaggcctgagctttttttaatgcacgtgagatttctggtgtttgcttatgtcagggtcaaatggaactttgccttgagactcagagaaagaattaacatccatcaagacttaagaaagcatagtccatgctttggaacacaccaagctctattgctaaatttaattttgttttctaattaatttttttccaatagaacaactttttcaaagcttcatattttatcagcaataaagtacttcatatctgtaagtccaactcagtgaatctgagggaaggtttagggaaagaaagaaacaagtgactgattttaaaaacagaatagcgatagcattaaccgataaagggataatagaaatagaggaaggttagtgagaaatatagctctttcttgtatatgtatatttcaaaatgttgtcaacatattcaggtgaaacacttaccaggtgattagaataatggttgtgttttttagatgaggtagatttcactgcatgaaaatgaccattgatatgggatataccagccaatgaatgagaacggaacaaacaaagagatgtaaaagatgagcagtaatttgggttgctcctcaacaaacatggaaaattaacgttttagtcaacaaaggagagccagcagggtcaagttctgcaagaaatgtgaagaccaaaaacaggccactcactctattaagctgttagaacatcatttgagaatgcagtgggagcttaaggccaaattgttgggtgttgagaaggcagagaggggtggcactggctctgtgcattagccttgtgcaagaacaaagcggtttttcctcttggggcacgaggacatttgtctcccagtggcaccttgcaaaatgctagacattgaggaaaattccagtaaacacatggttctggctcttaaaatttcgaagtgtcctgattttaatataagaatgttctggcatgctagagatagtgatggcaggccacagtaaaatttctaatatcctccacattcaaaagggaagtgaagaagctggccagctcagcagacactactgaagggatggatgtgagactccacgtaagttaaaattgagatcagttcagctcagaaaagagaaaactgggtgagacctagttcatattctcagaggtgcaaagggttttataaggatgagtctgacaagttttccccgtttctccagagacccaaataaagagaaattagttgaaattaaaggaaccttttttttttagtctgtatcttagaagataatgaaatgttagggtggtcttctaacaggggccacaaagaatctttaagagaaaaaaaggagagtctagtatcaatcaacgttaaattatcttacatgcagttggctgaagtgacaggtcatggccaggtgatttcttgagaaccttttcagtaaatgacttgattactattatgaatacatttagtcagtgcgcttcagaaatgctattgcttgttttcgctcatccccaaaatgactatggaaataattgtatatgtgtgtatgtgtgtgcgtccagctaggagggaaactacaagtagtactttctgatttttgaaaaaagaacaactttacatacaattcagttttacattgtttctgcacaggaaaactgcatgtcgtcttctgctgtaactataaaacacatccacaaaagttgtcactggaatttgcttaaatgtttctcaaagcagaaaaagaaatgactggtctctggttcattcagacgcctgcttatgatcacaattctgttgtcttacgttgtcatattctgctgagaatagttcaacaaatactactcttagttgaaagctttagaattttcctttctggaatatttacagatgtgacaaaatatatttgttataaatgtattcttatcatatcaaatgacctgaaatttgccatttttgattaattcctggagattacaagaatgatgagggcagttgcattcagaagttgcatacagttgccctttgcagaagtacatggtgcacatgcttcagtgtatttaatgatgttaacagttcattgattaaagttcaccttggaaataaacaaactttcctattcatctttcaaagttgttacaaaaacagaagcaggttttttttatggccaattcttccttttcttccttagttggtggctctttgttttgaattcccatagtagctgtttatttttccgctttgcacaatgtctgtattagtgatttactactcgctgtctttcacaagacctatgagcgtggtggtttaattaaccatattttgtgcatgtttactcttgacattaagaaaataataataattgcttaaactaacaaatggaatatgaatccagttgagttactttgctccttgttacctcattccctcaggtgtttattgctcttgtagccatttgatgtgaataacaagaattcattatttcagagtattaatgttactcattggactccttccttcttccagtagatccttgctgtaaaacatcctggattctcattcttctgcctgagcagttcccccgtaacggtgcgtgagcagatcacatctctctgacagaagggtttgcaaactatgcccacagaccagatccccagggctatttgtttatgcatttcctgtgaccacttttgcagtatgatggcagagttgagtagttgcaacagactgacccacaaggccaaaaatatttattattagggcctttatagaaaaagtttgctagtggttcccagttccgctgtaaaggattttgtccctgtttctttctagtgtgatctccactcttctctctttttccgtggttgagtgttctgtgtcccagccaaaccgacattcctttctatttaactacaacattttgcctgtgctatcttttcatctcatgccctttcttcatcttttcaaattctgcttctcttttaagaaccagcatatatgccacctcacccaagaagccttatctggttcctccagcttggatggctctaatcttagtctaattgttttctcccacgccttgtgggtgtgtcctcccccccaccggctgtggagtggccgggaacacaagcctcctccccaagacttaacttcctaggtgaatacgcaactccctcccaggagtggtggccactctaagtcctaccaagggtattggactgaaacgccattgtctttcatgtagtgatgacaagtcatttgtttctaaagtcaaaaataattacctagtgtaattaggtaattatttattttttatgtaattatgtaatgtaataatctacctatatgtatagagcattcactcagaaccctacttgctgatttttgaaccatgtccagccctgaaattatgtggtttcagattcccgtgtggtggtggcatctatctgggcagctcctccaggagttgagggagtgggtctgaattctcacagtcctgttggaagtgtgtggccaggctggttcctttaactgcccattagagtacactttccttccttgtggggcccttctagcctatcaggtcaaatttttgtggagtttccttactagtcatttccatttagttcacaaaatcagaattcaggtgaatgtagcaagcttagctcaatcaagttacactctcttcttctctttcccagcacataacacaattctagttgatttattactagcacagttgttctgtaagggcaggaagcatactcttctagtgatcactttatgcataacacatagcatagtaggcactgccaaaatgcatataataacacgaatatgtgtatatacatactcacatgtgtatgtgacacaggattttttaaactccttcactcagctagttccaggttcttgtctcacgaccacgaaaaattaggcatgcggacatcgaagagtgagtggaatagaatttattaaacaaaaaggaaagctctcagcaaaaagagggatcctgaaagcaggttgccagttgccccccttaacagttgaatacgagggcttctatatatccaagctgatggcgctgggttccctgtttgtataaggtttgaattcctggtggctccaccccttccccccagtgtgcatatggtcccttagtctgctctgggcgtgttcaggcaaactccctgtgcaggttgccttatctgcacaaaacatgtggtataaatacttggggggtgggtcggagattcttcagggacccttccctatctgcctaggagagttctctgcctcctgcctctatcatatgtacatatatgtcatgcatttccaactacaatgactatgtttcattcatatttgtatttcctgtaggcataacactaatattactgacaaagctggtcccacccaaatgggctctttccctgtttggtgcttcaaagctagtacacaaaactgaaagcgtcgagcagtgcaggctttaatcggatggccatggaattgagtgggcacttggatcacagatcagcttctcagcctgtgagagccaggaagtcacagatatagggcatctttaatgaatgggttgggcactaaaagcaaagggaggaatgttcgtgtcttgaaatgaacagcgaatttcttggaaccagagttgccactttcctttttgttcttttatgtttttttccagctattgtcatagtgattgtcaaccgtcatggtgctggtggaagtgtcatttagcatggaaattagattataatgaagttagaggttcttcagaggtcaagtgggccagcatcttgggatttccaccagtcttggccagtttggttatgcaggggatttgacttcaggaatggtgtttcctaaagtaaagcagaattaagaagctgatctgtgatccaagtgccctaggtcatgtaggcattacactgagtaacagtgtaatgtttactgtacactgttaaaatagttgaattaatccattctttactctcttagcattgaatttcagttgagcactccctccccactcccctcttctccccatttcatgctaattctcactcgattctcttctttttttttttttttcaagacagggtctcactctgttgcccagcctggagtgcagtggcacagtcttggctcactgcagtctcagcctcctgggctcaagtgatcctcccatctcagcctcccaagtagctggaactacaggtgtgcaccaccatgtctagctaattttttaaactttttatgtagagatgaggtctcactatattgcctaggctggtctcaaacttctgggctcaagcagtccctcaaagtgctgggattacaggcatgagccaccacacctggccttgagtctcttttctaactataatacttcttcctagttggcactggcctaaaacttaacctcatatgggataattaaatcttcctctgcatgctccctcagacctaggtactataaacaggttccaaaggcacttcactccttttcagatgaggttgcggtaagttaatggcgacactgtcctttagtccagctgtcaataactgcatactgtgaacggtcaaagtttacatgttggtaagaagtctggggatgtgcaccattgttctcttgctttatttttccattggaaagcaattgctttgagcaccaccaacaacaaaaaaaagattatagaaaattataccttttaaaggcaatctctgcatcttgtttaatgcaagaacacagtctgtaaaatgtagtgtgacttgcacagcaattattcactgtgttagatctaatttcagaatgtttcaattgcccattattttagcacattttttaaaaatgtaatcaacagcagtgttgaaactgaagttctcttgaaggctgatgtgttggtgcctactgattgtacaaagctgtatactgtctcttgagtattagtgcttagaggacattgagatcaatctgctttgttaattgaagccttattagttctacatgagtgtgcagtgtgctcaatacagtgaatcatccaaataaccaaaacttactacttttaagaatcaaagtttttccctatatttaggatttaatgattccctgccttcttaacagtgcattcgaatgataactgaaccttactttatggttctaggccatctatttgcattgctgcattgattattctgttgagttaataagacataaggaactgattgtccctatattaaataactccaaaatgttaaaatactttagtctcttttgataatattctatctactttctctctagtcctctatgatttttcagttcttccaatgcacccttgatgctattaacatgcttattttaaacacaagttcctgggtgaaaatgttaagataactgccctcctcatagagtccactcctcgtatcaaggcagattcatgcagggatgaaaagtatgcactctgtttaattccagcactgtttcctagtagctgttgatcttgggcaagttacttaagctttcaatttctctctcttaacctcatctataaaatgggcataatagaactcacctactagaattgttgtgaggcccaagtgcctagaatagagcctcatgtatagaaagtgctaaatagctacattagctttgtttgttgtagatacactaatggataaggaccttgttgaaactgtcttttagttcagagaacttctgattttgaccagccatattccagctttcaggacttactagttgcctagatgttagaagttggaacatttgctattcagattatcctatctcccacaattttttgattacctcaacatttcttgggagttacagggatgtaaaatgaataaacttggccttctttctacctatgtgatttaatgggtagttatcctaaggcagagtgaaagagttatttgcaaatctgcctgagtgcacacactattgactgttgtgaataactaccataaaccacagcattgagtgctttccctacttacaccaactcatttgctactcaacagcccatgagtagcagtagaagctaaagagaacacgtataacctcctccaggtctttagcgaatcagtgacaatgcagaatctaaaacctaggtctttccaaaacttcagaatgaactagattcttgcctcccctcaagttaaaagaatatgcaactgtttgtacagcacctttcactgaagttctagttgaaaggaattgtttattaccagtgaatacatttcatagttgaatctctgtggttgtttggttccataaattcttgtttctttttcaagatttgagaatgcaaaatgctgcaattcagtcttcatccttggaaatatctgatggaaagatatgggcagcatcaatgtcttcaaattctgacttgtcccaaagcctttcaacctcacttctcttacccatctttgataggttcaagggctatgtctgtccacaatggaagtcacagccacatttggctctttagctttcaattaattaaaattaaatacatctaagaattcattcctttgttgaattagtcacacatcaagtgcttaatagccacttgtagctagtggtaaccacagtaactagtgatatggaacacttccatcatggcagacagttgtgttggacagcgttctaggagaatcatcacagagatagttgccatatacacactctttctcactagccagggcttgggacccggtttcttatagatgggctggaagtcttcctcttgcctttctgaatgaagctgtactgacccagtcaggcctgggcagcagtcgcttctttagatctccatgggttccaccctgcgtcttgcttagctttcaccctagccttagccacatgggtaacatgaaatggaaaagaatcgtgaatcaaacacacagaagctatccaagaaaaccacaggagtggagatgccaaagagagaagaaatggaaagagatgacttcagaagattctaggttctttaatgcctcccattaaagttgtctcctacctcatgggtcttggtgactctaatttgtcttttctctctctctcttttgtggtttttgtttgtttgttttttatttggagaaacgaagtcttgcttcattgtccaggctggtttcaaactctgggcttcaagagatcctcctgcctcaacctcctaaagtgctgggattacaggcatgagttaccttgcattgtcaggctttgaaattgtctgagtaggctgacatcagcaatgtttaaagagaatgaggtaaaaggaatagaaaatgtttgagtatgttggaaatagaaatggttttatttcataatctgttgcagttttatatttatgtacatttgtgctggttgctacatgaaatatagcgcttttattgtaggttgtggtcaaagtttgaaaaatcctgggttagaattgtagttaacacaataaacagaattctttttctaattttccaacatctctttccataacagtattatgcttgttttgtcatatgttttatgtcaccgttttatgtgtatcagaaccatgaaaaacaagtgcttcatttgggcatgtgtcattgggaatagggaaccctctataggaagcagatgatggtttcagattttaaatatgagtcacaagtttggtagaagaatcacacacaaaacagttttattgtgaaatttgcagatttgggaatagggaatccttgctagttagttttatggggaaaattattgtacatggactcatgataatctgtgttaggaggtgcagagaatataaatacttgtaaaagaagaaaaaatggagaaaaaggtgcacatggctggacaatgtagatcagaggtctttatttatttgagttcatggggcgcttacttgtctgacactggcatcagggctaaggaaacaaaggtgaatatgactggctccctgccctcaaaatctgacttcttaattccggagagaggcaagtccagtaaacaaacagctacaacgcagcatgaatctaagacagctgagcacagagggcactcagatgtgtggatgcatctgactcagccagcagagggatattttcatccttggaaccttgccttgtccaagccaggatcttctgcccccgcatcacccttgtcttccctagcaagtgtgcagatctctgccttgataacgcgtgttcttttgtacgtttgctgagatccatgtacaactattctcagggtttttaagcagctataaaatgaggtttttacaattcagtttgaatcttctcatacaataatcatgttcatgattcagcacaggtttttacatgttgcattcctactcaagggcagggttttttttcccctccttttttccactgaaagaatgccaacaggaataaattgagtgggatgagccttcatggttaccttttttcttcacttgggtatttatagtaagatgaaatgtgcagaagctgttttcctttcatataaaccaaagatacaaggaatttactaagtgtctgggcagtcgtttggtctcatgagaagagcatggaagctgcaggggcctgggcgagctctgggaggctgctcctcaaagtgggaccacagtgccagcagccgcgctcttagtgagggcttgacttaggggtaccatgaggaactttctcatgcaagtgaagtggtgactcttgttcatcgcttccgagttttcttgtgggagcacttgcaaacaaaccctttccttttaagttcttacctcctattgaccattttgttccaacttaaaaaacttaaaaattatacctttagtttgaccatgagccgtctctttatgagcattagagtattggaaattgtgatgttcagcaaaatctagaacacatggctgctttataaaaatatgagattcatggccaggcatggtgactcacacctgtaattctagcactttgggaggccaaggaagcaggatcactggagccctggagtctgagacctgcctggacaatataacaagaccccatctctaaaaatatgaaaaaattagtggcttgtacctgtagtcccagctacttgggaggccgaggcaggaagattgcttgagtccaggagttcgaggttacagtgagctatgatagcaccactgcactccaccctgggtgacagttagattctgtctctaaaaacaataataatcagaaaaatatgagaatcagtcatccaatttaatacttatctgtagccttgaggtcacatggcatgcataggcttcccacttcctgctgaaagtactgtcttaaaattatcagagtgggagcagcctccagatcaggtgggagctgtgacctctcagactgtgctaaatagctgtgtttgttgtactgcttttgtaagtcaaccaagccacaggttgtgcattgtgagtggaccgtgttgcatctgcctcctgcctctgaatacagtggtcccagcaatagatgctcaattctcagagcgtctgcatgaccccccatggtcagtactgcttcactgtgctcctttcattgatcctgttgttgctgccacgagagcaaaataaaattaatataaatatatatgctacacacacacacacacacacacacacacacacacacacatttttagagggcttgtggtttctgaagatgatgaaagaaaaaaaagctgtgaaaagcaaaaatgcccaaaagttcatcttctgccctgacccatcacccttcttcagaggtacccagtacctccaattcccaagtctttctggggttctgctgaaccaacacgtagccgtttatcccttcatgtaagcttagggttctacattttccaatatgctaactaagccccatccattagccttacagctcctaaaatgttatctttcatttgctgtagtctcctctattgttattcttgttatctgagtgatttgaagactttttatgtctttgctggcattttggtggggttttagaagagcgtcgaggctgcatagatgtgttcgatctgtcttatttatttggacatttcagcagcctcttttaaaagaataatcagtccccagtccagaaacccctggaaccacttggtacttcttaaacctgccttcccttcacataggctgaccgctcaacctgacttcaattcctcactccaaacccagcccaaatttagggaacctatggaaatgcatctggcctggtctgtaccatttccttaagaaatgatcactccctcctcttattttccccaaaatcatacactaactttatcacttaatgtcttgtctattattgttacctgaccattgagtataggaaccattgtcacacctctgtattctcaacaatttacataatgcctggcatttagtaggtgcttagtaaataacaatggtaattgtcactacaaattacaaaaatatgtttatagtagttctaagtctcaatcagtcttcccaaattaaccgggaaagaaacatgctcaggcagaacccatgagtttcaacacctggaggtagttactacattggcagaatagtgttgcaggggaggggaagggatggatgcaaagaaataaatctctctgtctctctctcgaaacgtgagaggtggtatgtgaaagatgagggcactgtctggggagaaacaaaatcttccatgaatgcgctttagtcttctacagggcaagtatgacctagatattcagcaattggaattacttttaaactgctcacctgtctactgttgttccttgttgatgaggaaaatcaggtgatgcttatcttaaagataaggtgtttgtatcctcccttgctcaggatccaagcaggcttcattccaggcatcattaagtgagtctgttgccaggaaagctgcagtgtgggcgttcaccatgactgctaaatttgcagcatttcttttcattcaaactcatggatggaggagagggtctcacttgtatttgcccaacacgtattattagtagtattattgttttacatttctgcagtttttttcatggaagcctcacattctactttccagtctcacaggccatcctcaccacgatacacatgatcatttagtagcaaagtctgttcatcagaaaactctaattgctttatgtgtgagaacattaaactgcaataaatttatggatgcagctgctccattactggagaacaagttttatctcctaataaattgatgtttctttttagtgtcaactaaaaccaaaatttacacccaaggaattgaaccttaacattaaataattacttcaatgccgctagtggtaagaaagggtactcacttcccaattctaaaaggccggagtgagggaaatggttttttcctctgttaattgtttcttgaaagcataattgcacaagggctttaattgaaataagcataggagctatgcccttttaaagaagatactgtaaatagtgtcatcatttggtatgagttacaccataaggggaaacactaaaagccttatttatgttgaagggtaagggggaaaaaagaggttcactttggtgttttgtctgcagttccatttaagataatggaatagatgcttaaaattctctggactttgatgaatatttaattcatcttttctacaagacgtttgaattaaactgactactgataaaagatacagtgtggacaatggagttatgtaaatttggcttgctctgaggggatctgaatttaaatggccaaaggatggtttctttttgttgtttatgataattcaaatgtactaatcttgtaatactgtacattaaggacttcaattgtctggtcccatgtgaaataagaaatagtatcaggtttactttatgttcatattatggactaaaagtttattatacgtgtgtgtgtctctgcactcatgaatatgtatgtgtgtgtgtgagggagagctctcccctaattcaaatatgacacagattaaaatggctcctggacaggcgcagtatctcacacctgtaattccagcactttaagaagccaagttgggaggatcacttgcggcctctcaggaggctgaggtgggaggattgcctgatcccaggagtttaaggctgcagtgagctttgattgcatccgtgtatactcagtgtacttcagccagggtgatagaggaaaacactgtttcaaaaaaaaagttttcccccaatttctgtgaatcaggaagactttagcagttgaatgttagaatattagccaagctgaagtagccctgggcagggacctatacttctgcattgctccaagtcagccatctgcctagtttattagctttgtcatgtcactggatctctctgggcctcagtttcctcatcagtaaagcgaagaggttggtcctgataatcacaaggctaccttatcattggaatgctctttaattctgtcactcatcccacaacatataattaacacctacatcttacttttctctgcctttaaccttccattcagtgctatgtacggccagttgtctgcatgggaaaacaggaaagcaaacaatccaagtacagactggatactgttctatgccagttctatcaattatctgggaaatgattgaataatccttttgaaaaaaacataaagtattagatgccatgatagagatcagcacacattgaagtacttaatgatgcaatctgtgacctggctctagcattttggaatacagttctgtgccatataaccacatgtcagtcaatgacagactgcacatatcacagtggttccataagattataataccacatttgtactgtaccttttctatatgtagatatatttagatacacaaataccattatgttccaattgcctgcagtattcagtgcactcacatgctgtacaggtttgctgcctaggagcaataggctacaccatacagcctagctgggtagtagactacatcatctatgttcatataagtatactcttatcatattcacatgatgatattgcctaacaacccatttctcaggatgtagctgcattgttaaacaatgcaagactgtagttctaaggttgatggaatttttttttaagtctctgctagctacagggaaatttttccaaagtaaaagaaagatcttgtgaaaaatcacataagaagcacattgggtctctggggtaaaattaaagggttcaaccagaagacatccttcttcctcttcaagaactcggatctaagacctctgcagagccatttttggtcttttaagaaaaggcaaaagtattataatatttagttattagcatgttcatttgccaaagttctaaaaattccttagtactatatatgtatattttatagaatcttgaggtctcttgaataagtaacagaatatatttaaagccgtcttgtggtacttgcaatctacttttactattaaagttactataaagatttagagatattatatctttgcctgtgtgatccattgttgccatatcatggagccaactccttggtcagaaacataacctccaattataacattgctcctatgggaaaatctgatccactttatggtgtggtttctaagaacacattgtggtgaaaaggagaggatgcctgtatttttttaaattgaagcttttcaaccctttataacatcagttatgacttggcgagatgtgaacaatgtgtcgtttatggattgaatttgagtgtggtctcacgaccttttccctaatgcatacaaaatggataaaaaatgtatacctcaaactgaagctttaattggaaaatttggagctgtacatatatacactcatgtttttagaataaggattttattacaactgttgtaaaataaaatttaaaaaaaaacctctcttctctgcagtgccaaacatcttgattttccaaacatcgactaaagccacagttattgataacaaatcctgacttttctctcaaaaattcaaaaagtttactgtcctttggctccttactgtcattaatcagactacgtttcttggtgaaatctttaattacatctttaacttgataattacttctaaatcctgcacagaatcatagtcctaaattataagggcaaaaaaaaaaaaaatgaagcttacaaagtttttgtttgttcgtttggaaagtattggtgtatattgaagatgtccaatcagctttctttgaaaaatctctttcacaatactattcactgggccttagaaactgcattaactaaatagttcatctgcaaagaaatcctgaggatatggtgaacttggtcaagagaaggatacaatttctttccctcttttcatgagaaatctagccagactatagaagggacaaaacatgtatgtgacagcaggtattcatctcacattgaggaagtaggaaggttagtcttagagatggacttggagaggataattatgataatactttagagctgtcatattttatgaatttaaacaaatttttaatttactttagagttttttgtaactagtgaaaccttagcactcatagaagtaattggattggcagcccctgagaagactgttcaccagcaaagcagattcacctgccatagcccaggtattccccaagcctgaggcccagctggagggagcagcgagattcaggtctcccacctgctcccagcaatgaatcttttgcggcagagtccggcacgtcacctcacatactgctctcaaacccagcacattgtaacatcccacgagatcccgacttcatgagcaagccaggcttcttttttgcttctctcttgctgtgactcaactacaatgaaaagtaaaaatcgttattttctaagaatgttgttggttgggtttatcatatatctccagccctcttctccatattctatcactgtgatttcatccacttccatgacttacattacacttgtgtatatgtcgatgactgccaaagctatatcttcagtttcacttctctcctgagctgcaggcatgggtttctaatgacccactctatgtctctccctagatgtccttattcttcatcgtattgagtgtttatgaagtgcctcttctgtggtcagcactggattagatgtttacttgtatctcatctcatattattcacatatacttgaagccaatatgatgatttctataaggggtatcagaagaaattattcaaaatatgacaagaaactctgtgctttatatttcatacttaacaaattggtcattgtgaccctctatgagttaagaccaccttatttccaaaaaattatttgaagcagcttcttaaaatagctgttcaaatgaagtttacaaggacacaaaaatgatagaaagaacattacaaaattgatatgactacctaattggaatgacagagtaattatagttgtacatcagtttaatctcagagtttcctggcagccaaggcaaaaagaacaacatcaaatccttaatctacgatcagaggaaatatgttagttcatgtggagaatactttcactagtgctgaattctaggagtatttttaatatacatacttgtaatagataaattgtgaaacagaataagcattttcaaacaaagacttgtttgagattcatgaattttcttatgctcaattctttgataaacgtgagatcatctgtagcaacaccttctctggcattaaattgtgctgtataatttcactgtgaagtctatatacattatagaagaaaaattatataacaaatcaaataacattttttaatatagcttgcaaagacacagaaatattcccattatgaccatttgtcatattggcttttggtcaaatctgaagatatatcattacattgtaaagatattttcctgggatttaagttaatagaatttagaagtatgcagctttagaggtcaatattcttggtcttattacaaatagtaacatgttcatagagaattttgtgaatacaagaagaaagaggagactaccaggaaagggggaagtctgtttcaaacctctctcaggataatcactagatgatttctacctaaaactgcaaaatcagtttaagattcatgtttttatcctattatttatttaaaaatactcaaatggtcatcaattatttttattgctgtttctggtagtgctaattttaatacataccatcaccatttttaatcaattataagattcagcttttcagaatttaaaatccctgatatcaagatacttattatacaatggcattttaattgacagcattttctgtcttcttagacatttataaaatgtgtcatgatcaacggtttcttaaattcaacaattaaaagggttatagttgtttacttcgtaaatacttcctacagttctgcaacacaaaattcagaccatattcattaaaaacaaacaaaaaaaaacttgattctggcaatagagggatagaggattaattctttgaagtttttgacatataaaagggattgtggggtctccttttattggaaagacagagaattaacaccttaactgaatccatattgtaataaaccctaggacttggaaacaatgttgcaaatattaagtatcgtataaatttatctctatggaaaacatcttcaacttcattaaatgttctgtatgatgccacttatctatttcatgcacccccataccttctccaaaagttctctagacaatgttgcactgagaccacagagatggcatttttaatgtcaaaacaaaataacgtagcagaaacctatagaaacaatgttgtggtgacaaaatgaaatgtcagtggaggtctgttgtaacataatgtcaaaacaaaatgtcagccaaaatccatggagacactattatgatatcaaaatgaaacaatgtcagcgccagtctgtagagacattacaatatgagaaaagacaaaacaaaacggtatctgtggaggcctgtgacttctgaggcttaatgtagcttcatgtcaggtggttggcttgtgcaaacgtggctaatatttcagtatgtattttctaaggcttttcttttccagctcaagaaaaggaatcccaaagcggttctttagtataagtggctgggttaggcaattgctgatatttatatctaaatctatgcctgtgtccgtatgtatgtcagtgtgtttgtcagtatctctctctattcattctgggcttctgatgcttccaaacacatcattagtcccatttggtcttggcttagtttccctacacaccagtacttggacatcggttggaagtataaaatacaggcaaggcagtgttccaatctgcttgggaagggtcatgctgagttttagcagatgttttgctccattcttttctcctctgtcctcaggtagaagctggcactgcccccttccttactgagccttgaggcaccaggtggttttgaaatgtgcccctgaattcctgtgacctttggccctagagctcatgatctggcagcaccttggctgggtaatactagtactctgttttcccagccctttcataggagctgaaagatttttttaaaaaattatatatataaagagaaaaacaaatattttaaaaatctataatcatattaagttgggatttttttccaaaacaaagttagtaaagtatcaaattaaagtagatatcattgtgagacaaattttattatgtagaggcaaatttagacattgtaaagggaaaattttactatatatataaacttataaagatcaaaaggtttttatccacatattaagcaatttgagtctggaattaaatattgatttgtttttgttttagaaatttgaaaatccctgaaattgagagaaaaaaagtcaaactagagaaaaaaagaaaaaactctgccacaatagtaaagatatatttttctcattttaatcagctgcagtataattttaaaatcatgtattaagcaacaatacaataaagtctcaattagctagaaaccaagcaaacccacagttagccaatatgtttccaaattacacttttagaaacaagaggtagatacctataaaagtgctgttatcggggtgaggtggggggtctgtcagaaaaatagtgagaaaccaaaagaactcaatttcgtcctttttttctacaaagtactcaacagtgagtcatgaaaatctcaaaagttttttttttttaagttaaatatccattattccttcttttcaagatggatgagacctttattactttctagaaggattttcaaacacaaggattgaaacaaaaaaggctttcagtaaacctttggctaatcagcttaccactcggttcttctaagactgtgattttcagaaactttaatcaggttcagtttacttgtatcgatttgcacgccttagccacaaaactacaatatctactggtggggatgtgctggagcctgaaattgtattcttgaggcatgcgcttccatagtggtgataggagcatgcagtgggaaaagtgggaaacgttctttgtcaccagcatcagtgggatactcctgagagatcagaataggagctggtcactctttagcaggagaacgaagagtgaagaccagcaaagattgaaacagaggattaaaaattgtatgtcacagtcaccatattgaccagcagaagtaaatgtgggcaaaaactaaagccaaactgtgattttcatcacatgtcaaagaaaggaaaactagtttgagtatagcaccaggtcatgtgcttgggagaaaaagtgtggaggactcggttaaatctttaaaacagtatttgtatttggagctttgtagattacaaactcaatgttttaaaaatgtactccctaaattaaccataaatattgtaaaaaagtaatacagaaattattcctaaagtgtgttaggaagtggtggacataattctgtaattataaccaatagctgttaccattttggaacatttacatccatgtctttcgtctacttaaaaaaatatataagcatccatataccagttttattcttgaaaagacatttaagctatttgaaaataattgagaattaagaataacagaaattagaaagtctaacattagagagtaaagctatttcttcctcttttccttttggaaatcactccaaaacaagaaacagaatgagatatagaaatagtaactctatttttgtgaaaatggacatagttaatatagaatgacagaatcacactggaatgtcaagaatcaagcttatgcaccccgcaccaaagattgctagattctcttcggaagacatggaattgccctggaaaaggagtccacatacactgtcatgagaattcccaaccaaaaaagtgacactctgcccagccttcctgtccaccatttcataaacccccctgaagcacacagtgactaatctgctttttagtgcttcactcttaaatataaaagggcagaaaaacatgtgaaacatttcagaaaagccataattgtggaagacagagtccaaaacaaacaacgtttgtttgttttctttaagaacttggaggaaacataaaattaagagaagagaaaaatattaaggaattataaacagtaattctgtgaaatagaaatgatgttaaaaccatcaaagatgaacaggaggctattgaaaggattattgagtaaatgggaaagaactcttagaaaataataaatacaatatcagtattaagaaacacaatagaaggcttgatagatgaggttgagaagtttcccataaaggaaaacatgagctataggacaaagagcagtatagtgagaaagaaaggaagtgaaaagttcattctgggaggtccaatatttaaagaaaacaatttctagaaagagagaacagagataataaaggatagattattagagaaataacacaagaatcttttccagaactggagaacttaagattccagattaaagaatcacctagtgctgagcaaaatcaatttttcaaaaaggacagcattgtgaagttttggaataccagaaagagaagatcctgtaaaaaaaaaaaaaaaaaaaatatatatatatatatatatatatatatatatacacacacacacacaatgaagagttgagaatcagaatataatcagatttcttcacatcagtcttgtaagctagaagataatagagcaacacattcaaatattgaagggtaatgttttgttacctgaaattccatacctagccaaactgtcagtgagtggtaatgatagaatacatacatttaaagcatgcaaacgcaaaatattttagttctaatacccttttaggcagccaccgaatgtgtgctttaacaagtcccaggacttctgctgtgcagaaaaccaggaagcaggcagcctagattggcgtatgtggtgggagcttttgaggttagagggctccaggaaaaaaattgggcttaataagccatgatagacttgttctcctggaaatctgaaaaatcagattgtaaaatcattttcatataaattttgctataattatattgggaagatgtggaagatgggaatttggagtcagaatttggatttgagtgtaagagagctaatgcttcatctacctttgtaggaagtcaacaggtgtgtttaacagtaataaatcaggagatagtgatataaatatattacccagaaatgtctaaataccagaggaatttggttagacatggcttattattaaattcctagcttttgctttgtgtaatagattcatactggcaacttacatttaataatattgagcatggcactttcatcataactaaatgaaagtaagcaatgaaaccatcactagcaagagtgtatcacaaaccaggaattacaatggattcattctgagtatctcaggttgagttaaaaagaaatgtcatagaaaacgactgaaagctttaaaagtcttggggttgggtggtcagagagacaagatgtgatgaagcagaagtttcatttaagaagtttcttttaatgattcttttaaggcttttagcattttaaaatataaactatgcacatgtagtattactttgaaaaaaaaatgtaattgacaaaagaatgttgcaagccctttcacaatctatcagtaactccaaaatctgtcaataactccagttttcaaaatctatcaataactccaaaccaatatggtcacactgtttttgttttcctaatataataatttaactaaatctgaaatgagaagttaaattaattaacatttctatgtcatttattccctctctccagataaataatggccaagttgtaaatagaaaaaaaagctcagaaaattattaatgaataattatgaagttcatcaagagcataaatagaagtaaaaaaatcaatcaggaagaatattttaatgatctttaaaatgttttaaaaacagtaatacaaactcttcattaatggtttctttttagaaaactggttattagatgtatgtttcactacttttattctaattctcaaagaagtttcagagttagcctcttatgaaacttacaggtgatatatctcttgttacattatttaatattctgagtcatttcaagaaagtctgtagaatttagccatgatttagaattatgacatgatttggaattaagtactgcattgcactggaattttttcttttaaaaaaacatagcttagtttcgtatagtgttttgcaattatgctgtcattaaagacagaaagcaaaaacaaagaaaatgttcgccttgaattctttgtaatcatttcatgattaaagaattaaaataatggttctataattagtttctatgcctgaatgataaaacctttctaatatgaagaagaacatgataatcattttattgtgtcatcaaaacccatcaggttttgtaatttaatttccattgcctttttatttcagttttttgttgttgttgttgttgttttgagacagagtcttgctctgttgccaggctggggtgcggtggcacgatctcaggtcactgcaacctccacctcctgggttcaagcgattcagcttcccaagtagctggaactacaggcatgcaccaccacacccagctaatttgtatatttttagtagagacagggtttcaccatgttggccaggatggtcttgatctcttgacctcgtgatccacctgccttgacctcccaaagtgctgggattacaggcataagccaccgcccccagcctttatttcaaatttttataatgtattcctgtttttcactctttttagtttgtcaagatttttcacctgtaacattgaatttcatttgctctttaatcagacacctaaatgtatattttagtttgaggcacagacttcaactgtgggtcacaactggctgaactttgtatccccagtggttttattgaatgaataatataatccacaaactttcttcagttctctaacctattagaatcccttacacgtccttgccatttgttagagaattcaagaaaatcacactatgaaaagtaagtgcactttgggcattaaccattataactgctttcttgcattgtgccaagaaaaatgatgcctgcctgccttcctgccttcctgccttccttccttccttccttcgtcctttcttccttccatccgtctttccttctttcctccctccctccctgccccccgcttcctttcctttcccttgtttcttttctttgtttctttctttttctttgacagagtctcggtctttcacccaggctagagtgcagtggtgcaatcatggttcactgcagcctcaaactcctgggctcaagcaattctcctgcttcagccttccaagtagctgggcctacacgcaccaccacacccagctaatttttttttttttagagatggggtcttgcgatgttgcccaggcttgtctcaaactactagctaaagcgatgctcccatcttggccacccaaagtgttgggattacagggataagccccggcacccagccaacattttattttctaaagtgcatttaaattcataggtataccccgaaaacattttctctcatcttttacttgcttaaatctatgttaagattgcctgctagggagtcaagagacttgggaggcccagacctcagcccctgccctttgtccacgtacctcacagggtcttgaggaagtccaccatctttgaggtttaaagctcttaacacacattctcacaatagtcactcttattcgaatatggtttcttaaaccaaaaccttgataattagtttgacaatgataatttttaaaaacttgctaagcagtgttactttagtgctgagttttcagtagatgccccattggaggtatggctgtgatagattcagctgtccttttgagtagagaccagcttggatcatttttgtgacactaggtaagatcagctacctagggctttcttgtgtgtatttattgctgggtcctgaaattatgtatgtctttgcgcttgcatgttctctgttgctggaggacttcccctcaaaaagtaaaactaaatttttcttactcctgcctgagaccaatgacaagctaataaggaagagtgatgaaagtaataaaatagggcgaggggtacattcctgaggttttgttgcttataaaatgatagtcctgttacccagagaccacagagggacttggagtaagatctagtcctgaggctttccgatggagagatgacctccctgtgatccataaagcatctggagaactggagctatcacatcagaagcaaatgcaggattaacagctttggagaccacctttttaacccagagagcatagctgtatgtttttaatttgttatgatttattacactgaaattggtgtgaaatggacaacaaatcatgggtgtcagaatctggaaatgaattttatcagctgagcaaagtgagtacctttgggatttgcatgagtttctcataattctttttatattacagatgatgagtaaaactgtgaaaataaactgaaaatgacatgatatttcctaagtagttaatttcacatgtatacatagacacatataaatatagccacttagcctcagtttagactttctctataattcagggtgatttgtacataaccacagaaatatttgtctaaaaacctcaaagtcagtatcaagaccatttgtgcaatatcataaatgtctgggattatcatagaaaaatgcaaagactataacaagatatttaccaactataatttttttcaatgttcaaatttggaaaagagagtttagacttacataccagtatacaagtggtaagattaaagaaggatccatcccaaaatttcagatgttataaataccctgaagcatcacaaaaaaagcggcccttgttagaaactaactttgcatgcataattaatgtgggcaccacattcctacttcacaaccagaagagaaattgaattcaggtgtttggtgaacatatgggggatttactgtgaatttatgacctgtgatttgagtgtaaaaccccaagatacttgctgataaaacttaatgaagcttgcgcagaggagctatttttatttgtagtttgataattgatacatttcttggtttaaccctcccacccttcctccattcctcataagtcttccagcctgagagatagagccatagtgaatagccacagtctttttagccagcttggcctcatgcttaactaatttgaaagttcacagtttgcttttctgtgacattttagtctgttctttcccttctctcttaatttagcgattaatactttttcacaaactgtacaggtgatacaggtgacaggaggcacaccgtgtgctttgaacaggtaccgtgggagaacgtgcaaacgctttcacagggggtgacatcaatttactatttcttaagaaagcaaagataaaggcataatactgctcatcattaaaatttagacaaatccattgccatttaaaggttttttctccaagaagaaacacttcaaggggcaggaacctgccacacatatcctgaccatgtctctctgcttcaatgtttttatctaggattttatcaagaatgctcctgatttgagagccaggagaaaaatattctaaaaaaaaaacaacgaaaaacaaaagcaaatgacaagtgttccattttaacacacggggtgtaatgggtttaatgagaaacctgtgtttgctcactaatttacagcaattaagaactcagttctgacatctgtagattagaactatttatctagagatcaggcatattttatggaattgctaatcagtatagaaaaatatctaagtgggaagcaggttgtttacctgcctctctgaatggtgtcaatatctggtagttctgtatcataggatccctttttagttcagtgacatttatccccccaatgctttagtcatcccagttcaagaacttgtttgtatccactttgtcatgctgacagtctgtctgttttgaaaggattacaactctgtacatccatggatgacatcacagtaagacattgcttaatgatctgagacgctggtggtcactgctggctgcctgttactacggcttcatgacaggtctgccctacatctgtttctcccggagtcactttttgcctactccagtcctggtgtctgctttaaatgacatccatgaaatagctgaagtttggacttaaccattggtacaagtaaaataacccagattatttttttcccaggatacaagaagaattagtaattgggcaaggaaggaaaaagtgctctcatttttctccagtgaagatgaaacaatgttcttggaaagtgggttttttactaatgggctggatcttgagttcttccatttgtggaactatgaaggaagttagtaaagagataaatttttcttaaatgaggggactgaagtgcaagaacctcctgtgaagattgagttgttacccaaggacatcatcaaggcttggaaaagtcagggttgaagaaaataggatctttgagtataagtgaattgagtcttagaagctttaacctactatcttctcctttctatgtgtgctgagatgcagaccatgatgatgtttcttaagttgtaggactttgaatgctggctggtgaaagagaaaagattttcttaagcagagagcttggcagctagcagaactatagaatttttttctgccctgtgatgtgtacatgggaaaactgtctgagtgatagaaatgtatcaataggaaaaagcttttttcttttttttttttggagtgtggtattgcattatttccaggattgttgatacaatttggaaattaactttttgaatttttttttaattgggaaaagaataatgttcctttttcatctgcagtaattggatgccaagtgcaggtgtgaaattcactagcatttggaatagaattttgtacataggccaaaaagtaaattgctagggctgagaagtagatagcaaaaagaaaatggccaaatgatataagctgatatggttaacaaaaaatctttaccatgtacctgtgcttttgtaagtagtggatttgaaggggcatcttttaagtcctgagctcttggcaaactaagtaaatcaaatgttaacagggattacctttttgtgagttgtgtgtttgacccagatcccagcaggtcatcaatctctgccagaaagagaaaccagtaatgagcccttgagttcagttttaccgaatcacctggttggcaggtatattttcaccaggctccaggaaagcactcacattcttgccttggtctctcaggaggctgactttcagagatcacagagccctagtgaggtgttttgggtgcagtagcggggaggtcgacaaaaggtatcaccctaagcaattgaatagatttccatgggacattcttgactatagactggtattcactggaaagcacatttgattggtttcatgtattaagatctggcagtgagcatttttcagttacatcttctgcaatagtatttactttgtgcaatttttcccagagaccagaactttgcagtgactaattctatgaatgatcatggtaaaactcgctcgtaaaatgtgatgcctgtctttgattccactcttctaacaacatgcttttgcaacaagcaccatttgtttggttccacttgtgggcagggcctatgtgtttctaggacattagggccaccttaaatccatccatactttatttccttgaatttaacaagaatgtacagcccccataatgctgtttaaagtgatggggtggtagtattggtgtgggggcggtctgaggagggaggtctagaacgtttattgctgcagtgctgtcacatagcaaattgcctaacctagtggcctctaataacaagcattgattttttgctcagacatctacagagaggctaggggttggctgatctaggccaggctccactgggcttgacttataagctgcaggttggattcatattcactccatgtgtctcttagactgtgggcatgttcttgttatggtagaagtcaggagcacaaagaatacacccagcatacaatcagtttcaaactccttttgtgtcacatccacaaacatcctgttggccaaaacaagtcacatggccaaggccaacaacaatggagtgttcgttttcttttgctacaaaacaaagtaacacaaactttgcagcttaaaacaacacatattgattatatcaccgtgtctgtgggcctggagttccagcatgactgagctggatcctctgctcagggtctccctcggggtgcaatcaaggagtcagccagactgggttctcacacagaggcttctactagggaaatatcagcttccctgcttccgtcattgttgacagcattgtgttccatgcagctgtgggattcttggctccttgcgacttcagtaccagcaaggagagagacagaggcataaagagggacaccacgattgtaaccacaaacactgcgtgatccctgctgcatttctcattggttagaagcaagtgcacagcaaaccaccatgacacacgtttagctaggtaacaaacctgcacatcctgcacatgtatcctggcacttaaaatcaaattaaatcttaaaaaaagcaagtgtgggttctgtccacattcaagggtagaggagtgcataaaggtgtgaaccccagaaggtgtggacattagggccaccttaaatccatccatcacaaatatttgctgatcaatttgttctgccacagggaagtgacatacaagatatgtacatgttgaatggctatgatgaaggcacaaacctaagagagaaaagcccatacacatgccgattctggtaaactctgtaagtcagtatttgggtcaggggacaattacaggtgaactgaaaggaagagatgaacatgggctggagtagtgaggaaaggctgcaaggaagtggattgatgtcttagacttactggtagaatttggaaagatggaagggaaagaagagggtattaaagaaagaaaaacctgagcgactgtattttcctctcttctttggcagcttttcttctcctgtaccagagtttataatcatctctgccttctgaacaatgtggagagcctgccacaattcatttcctcctcctgtctaccttctctcttccttttctcccccctgctatgggaagcatagtgtataccgagaccaccttactttaaaaaaagagtggttacttctcctttccattgaattctggatcttaaaactactctcttccaggtttccagattccttttgcataattaaaaatgcaaatgttaaagcatttttaatccatgaagaattaatcagtcacatcacaaactcctctctttcagcatatactgctctgaatagataggtgagacttcaagcctgcaaggaaggatacccaggttcaggcttaggcagctgggaaggaggggacagtttaggagaaacaagactatctggacagtgcctggttatcagttttaacatattttgggggactgttactagagcaccaccagccttattattttggtgcaatgaaagtaaatagcctggagaagcgacagataaaataggcagcgtctgcagaatgtgaaccagtggttacaggctagccaacaatggacaaaattgttatttggcttacctagaatttcaaaagtaaagtaagtgaacattttaaatttgggagagaaagctgtctttctagcttctcttaaataagaagcaacaccaggccagcatcccttcatggcagtagtctactaactgcaggcattatcttcagagtgttgtccatatacctgcagtatgttctgaattcatatacgtgtaagttcttgggccctgcactagactgactcagaatttctcaaggcaagccttggcaatcagtatttttttaacaagctctttgaatggttctcatatacacagtgcatatagatgagaaccgctgttgtaaggtttctgttccctctcatcgtacctaaggaagtggttgagttggcttgcctgtggggcacaggtgcggggcaggcttcagtgattccctgcagataggctcattgctccttttagcctgaatgggtatccttagccacattcaggaagcacatagtagtatccaatttgaagatgtagaagccttgtacaccgcatggtctgcctctgacatcaaagactgcaatccccgtagtaattatggacgttccatataattcagggtcacatagttctgtgcacgctgggctaggaatctctgtagtgtgtgatcctaggtacccttccttaaacctgtcaggaaaaaacaacaaaaaccaaaacccagatcattactgaaccaaaagcaaaccctcttcatttagttagaacgtgaaattaagttccagttgggtacaaagccaatgtgttggtggaggctgagtgttggtattggactaaaactgtcttatagctgtctgtgtggatgttttatacagaaagtatctctctgttcctctcagcatccctgtgtagatcccactcatgtggactatctgtaaattaggatttctgactcttcattaagggttttattgtctcacccatctgatcaacttggatggtatttttattatatttctcacacaaaaaaatcatgaccaactttaagttggcagtgaacctaaatataagttgattaggatgtgtagggatgagtcactattgctaatgaatatttaaaatttcctttagctttcttggcagaagagctcaccaagaactttaaaagtccaaatttgaattattggctcattatagactggccagagagacagaactgagcaattgtaatggtttcatctctcaaagccagaatttcaccttcagactgccaattgttgttccccaagggggcttgacggtcttccagtctttggaaatcatcatccatcatgaaaaccattgcagcctgttttccaacttcagccattaagtggttttgccagtcttagacaagtcagccagctttctctagagtattgggagagaaagagcagaggaaaagggggtgaaaccaaaggtctgcctagctccccagatttggaaacaagggcaggagtgacttccagaacttatcttttgctgtgaaaaacaccagtgtcaccagaatttaacattgaggatactcggtcaactccctttgtcgggaaaacagactttcagtgaattgcaaatagtaggaggtcagtttttatcaatggtttcaacttcatgatcctaataattatgggcttaaaactctctgtgctgcatgaaaataacagaagaatacttctggttagatttgtaaaatactttgtcagtcaaacctcctataatcctcccataaaagctataaagtatgccaggaacaaaaaagcacaggtggaaaaatgacagtgagattcgggaatgcccactttcctgtctcttttgtcttatgaaggtaaccatcctcactcatgcctacaccattacggtttcacataaagaacagagtgctttttagattggacagtgcaacaatataggacactatatatttttaaagccagtaggaataacaacctgcctgtctcaaaagtgtggagggacattttgaagtgacgtggactgaagccttgtgtcgtcaagcagcccaatttacagacctgttcacctttaatgttccaggccaatcagttcagatttgtcagaagaaaagcaaagaaagacaagcttttattgactgagaaaataatcaaattgaatgtattgacagtatattctagaagctctagtgaaattgatacatgaaggtacaggggcccctcccaatatgttaaatgatgaaagactattccatatttttagaagatgttaacatgatgatcctgtacatgaacatgttcaattttagatgcttaaacctttgagattcttcaaaatatgtggaattatatgtagacttatgtccgtttgagaattttacgtactctactgtgacagaatttctctttccaagctacctctcacaaatcacatcacgcaggaggggtgcagccagcagaaccctggcacacactgagtaaccagggcaacatgcttttgtgaagagacctgatcttccgaatagctttgcagctttccattctgctagcagcttggagggtatatatgataagaagaagatgtggttcttgtcctcaagaagtctgacgttctgttgtggaggcagtagatgcctgatgggcttgaatagctttcctgatgaaatgagagagttccctgactcccctcacaggacatgcagcaggggtgtgtggcttgtctatttgactgctgtgtgtgcccaaaccccttaggggagggggagcatgcagatgtacaggtacgggagccggggttccagccccacggtagtgtctgggtgtgggtgcctgcagctcctgaagctccagtgggcatgttgcagtgctcttttagctctcctgtctgcagatggcttaagtgttaaccagcccagtgccccccttggtacccaggcccttgtctggcatccaggaaaaatcaggtcccacagggtcttgtaagatggtgaatgtggggattttattgggtgatggaggtggctctcagtgggatggatgggaagctggaaaggggatggggtgggaagatgatcttcccctggagtttggccatccagtggcccagtctcctctccagccatccccagccaaactcctcttgacattcagatgctccttctcgtctcccttctctgccgcaccattctgccactcttctgcccttctgtttgtctgttcatggagcctggggtttgcagtttatatgggtgcaggataggggggcgtggtgggccaaaaaggcaacttttgggtgcaaaaacaggaatgcctgttcccatttagggttatgggtttccagacttctgagggtgggacctttgctgaggaaccgccctctcctacccagtatttccctgtctcccgtccacgtcactgataggatgaaacttactgctttagtgaatggcatagaccaaaagtgctgtgagatttatgattgatttaattttggtcatcaatctctattactcttggcgaaaatactctttttaaaatttgtactttacaaatgaagagctttggagcctgatacatgttttacaaagtgatatgcatggcatagtgaaatgagggttggactgggagccagaaaatctggattttggtctcactttccccactggccagctgggagatccccaaatgaaccacttatcttctttaaatgtcagttactacatttgtaaacgtgtgcgtaggtgggtgggtgggtgggtgtgtgaaatactaccttctgcacctatcttataaggtatttctgagaataaaacaaaattcaatactatacaaaaagaaggccgtattgttattaactagatggttaaatgaaactaccacttgaacttatttttaaaatgtttttcatttttgctgtgagaattgcattttatttatagacctctgatgactcataaataggaacctcgtattatgaaaatattgctgtgcatttgtgcagctatatttcatggtgtcctctcacttgattattacaactcagatatttagagtaaaattattatctctacttcatatatttaaaaaacttcagcttagaaacattaagtacgttagtctaagaaggtacagaagctaggaccagaccctgttgtttctgacttttaatgcaatgtcctttccaaaaaaacttccctgccaacaccttgccagattacagaaaggaaatgaaacttttaaagaacagtgcaaaaaaaaaaagaatatctaaaaatattgtttaccctctcaaatatctgtctaaaatacctcaataagccttaatcctaaaaccaaaatgaaaacatattttaaatgcccacatattgttttaaaaattcactttctcttaaatggcgtcatttcacagcaagttgccatgttttgctagcaactgcagttcacagataatatttctgaagggtattcactgctgcctcatctctctttcagtaacagatcaactcctagcaatcatgatcggatacagcgtctgaggcaagaatttcagcaagcaaagcaagatgaagatgtagaagatcgtcggcggacctatagttttgagcaaccctgggtaagtaattggttcttcagcacggtgaatggtcctacaacttccctgcagcaaaggccactaagctatgacctcaatgctctatgaaacgagacaagatggagccaaattcctttgacctttaacatattgaccttttcctcatttccatctgggtttcatcattgctaatttcattttatatcttgttccaccatctgtccattgcctaataggtttcactagccttatgacaagacatagcaaaagtattctcactctcaactaagcattttttaaatttagtaaatatttttctgtagatacatattctcagaatcagagccaaaattaatttgttcagcacttctccattgtgcctgtaatgtacaaagtacagtgtttagtaattcttttttttaaagagatgaggtctcgctttgtcacacaggctggagtgcggtggtgcgatcatagcttactgcagccccaaactcctaggcttaggcaatcctcctacctcagccaccagagtagctggactataggcaagtgccaccacacctggctaattttttagttttttgtagagactgagtctcactatgttggccaggctggtctcaaattcctaggctcaagtgatcctcattcttcagtctcccaaagtgtcaggattacagttgtgaaccactgtgccaggtctagtaattcttgattctttaatcttttgcaccccccatgtgtgtttgttgaatccatcttattccagttcatccccctcatagccaccagagtgaaaaaacttcagatggctttctcagtgccagaactgtgttctgatcttgtgtctcaccctagagatgacagcacttctgagagtggaggggttgggacagattttttgagatgatggggagtttgaagaatttctttgggagacttgagagtgagtctgttagaggtgaataaataagctgcttaaggtaggaaactctagcatggggtattaggaagtccaggcagcatggtaatttgacctaaccggcaatgcttagaagactgggaatagaaggaataaatttgtggattaattctttagtgggggttggaagatagacatggcagaaagccaagggaggtgctggagtcctaccaaggatactggggaagcatcgtgtggtccaggtggggtggcaagtatagctcaaggaaggattagcctcacagcctagcagtgtgcaagagggctcaggatctaggggttctcaagcctaggaagttgtggtcaaaacagtgtattttttggactctaggatcttggaagtagaggcgatagttcagacgatgttgaggtctaaggcctgccatctttgcacgtgagttacagaagtagagcggagattagtgtccataaagttgacaagttcagttcagacaaagtgttgggaatatcatttactagatatttggaagagtaggacagaaggaagaatggtgttataaaaggctggaggccaggcatggtggctcataccatcaccccaacactttgggaggccaaggcaggagcattgctcgagcccaggagtttgagaccagcttgggcaacatagggagaccccatctctacaaaaaaaaaaaaaaaaaagtttttaattacccggatgtggtggcacatgcctgtggtcccagctactcaggaggctgagttgggaggattgtttgaacctgggaggttgggactgcagtgagaccctggctcaaaaaaaaaaaaaaaaaagaggcttgacattacaaaaaaaaaggaacatttgatttgaggaagggtaaactacccagctgagaggttggttatgttgaagggaaggggagattaaaggtagaaatgtaggaagagccttcaatgctagattgaaagtttgaagagaaatagtgctaggaaagaacactggcccagtagccaggtggcctggctcttccggcctcagttttcttatctctcaaccaagattagaataaatgattgcaggccaggcacaatggcttgtgcctgtaatcccagcactttgcgaggtcaaggtgggctaatcacttgaggccaggtgttcgagaccagcctggacaacatgatgaaaccccatctctactaaaaatacaaaaattatccagtcctggtggcacatgcctgtaatccaggctactcgggaggctgaggcagaagaatcacttgaacccgggaggcagaggttacagtgagccaagattgcaccactgccctccagcctggacgacagagcaagactctgaatcaaaaaaaagaaaagaaagaataaatgattggatgtcagttactaaacccttggatgaaatgaaagtttaagaagaagctaaatgtaaagcagatgcaagtagaacccctctagttgactacagaggctggatcctgttagctgctgctgaagatcagagcttctcaaagtgtggtccacagaacagcacctttagcatcacctagaaacttgttaggaatacatattcttggtccctgcattgaccctactagatgtaaacctttacgggtggggcccaggaatctggtttttaatgagccttccaactcattctgaaacaagttcaactttgagaatcactgttctaaagtctagacgatctctgaggtcctttttggtcctgaaacccaatactcacaatatattactctacataaagcaagaaacctataaatgctgctcattaagggatttagtgaccaaattagggtttgaggaagattaattttgtggagcaaaggcaaagaggaaaaaatgggagaagcagtactaccgttggcccttaaacaacatgggggttggaggaccatcccccttcctcctcacacacacaatcagaaatccccatgcaacttctgacttcccgaaaacttaactactgcactaatatcgcactgttgaacagaaaccttaccagtaacatagacagttgattaacacacactctgtacattttatgtattatatgctgtattcttacagtaatataaactagaaagaagatgttattaagaaaatcataaagaagagaacatacatttccttttctttaaatggaagtggatcatcataaagatcttctccattgtcttcagattgaataggcaggggaggaggagaaaggagtaagtcttgtctcagagtggcagaggtggaagaaactctgtgtatcagtggaccctcaaagttcaaactcatggtgttcaagggtcaactgtagtttgaagagctttaacttagttcaggtgaggaagatggggcaactggcaatgtgggatcagcatccaggtgtaaaagcacctcatgaaatcaattcttgcctaactttgggaggttataaaacaagttccctggaaaatctctaattgtcttctgcaacaatattactattaatggcatttttctaaggtatttagttcattttcctagatgatcaagtacattgagtcattcccatgtagcaacatgacagaattatgttaatctgcttatattgtttggcataattgactcaatccattcctactacatttcttgaaacaggattcttttgtgatgtgtgataaattcttaactatgtatatttacacaaagaggctgaaaagagtaatgagcatggtgtcaagctgaaggagaaaacagcagctgaatatggaaatagttaacacacatgcacacagttccaacctggcacagccccgcctgagcttatcattctccataccatgccatgaggagcagtgttcgccatttgactttgcctgggaatgtggattccaaaccagcatcttgacatttactctttaactaattatttaattcatcaaattcattgagttcttactatgtcccaggcattgtggttggtatgggagaacaaagatcgaaaagaaaaaatgccctcagaactctccagtagaactgataaaaaataaaggaatacttggtaccatatagcagaggtaggctaggggtgtgcatggggtgttgagaaccacggagctgtgaggaccacatcagtgtgcggtggtcagaaaaggcttgaaagaacccctctttgaaattggaatatattttaaatatataacagagaagcagacatatgtctttgagaactcagattgatgagtttatttctggtttctgacattgtatccacatgcgagacctccaggtttgtttgaggctaaatgagtatttcctacgtcttagtatctagatgtttttcattgggaaaagtgaaaatgatttgaaattcattttggtttctttataagattttaactttgaatgggaacagtgaataggctggaatgcatttctatgttatctacttaatatgaacaatcatgttagggaaaatgtttgaaaaaatcttgtacatttggaaactcaactactgaaggtcatggaccacattattatatatcaaaatgccatagcaacttcagacagacaacttggcttgtattagcatttccggtaatgagtgagcagggaattatttggatgacaggctgattaccttagaaatggaatcatttcctaaattatgggtcacaagttgaccttttcttttttttttttttttcattttcaagaaactgagatcttgctctattttactgatcatgtaaatgagcttaaagtgactggaattctacttagtgtattaattttcataccaattcttatggttaccttaggaagagctgctcagttgtttaaaatgtagcttggtctatggttttaattatctgttttacaaaatgagctttttgcatcttggaatccttctcttctcttatgtattctgaccttgaagggtcactgtatttggaagggatgggaccatgatctcattctttggaatggtttgtaatcattttagttttaaggaaccacaaactcaccttcaagctgtgtgtacaactgagcccatattagttgaaattgtcatgcttgttagaaatgcccacacacaaagtgcagccagatgtgtcacagagaaaaatatgtaagccaattactttacatacagagcaggatgctgcggaaaattcatccaagtagccctttcaatctacctattttgaaaatgttctctataagctctagcagtacagaatgcacctgttcctgggcctttgttcaaaataatgtctgggcctgagggagctgatttgtggcacaaaaggtctttagatgagcagaggcccagaaaatttccttagctccataattgaagtgaattctctcccaagttgagcaagagaagaagaaaaggcaacttcttcctcacgtagtgccaggtgcaacataaataaagcagcaagttgctttaaatctttcttaagataatggaacaataggtgaggttagggttattatcacagagcttcgatatggacaggacttagtgttgcttttaaaagaactaaattgcaggctgcagacgtaagtacagtatgccgtaaaaactttgcagatacctgagtgttgccaacaaggagacttgctggctgagacgactgatagatgggataatggagcctttaataatagctgtattgctaaatcctttccatcccaggttgggagtgactgaaagtagtttagtccttcaggtagaaaattgatactctgcaatgtgaatatcctcttctccctcaagcttgcttgtttcctagctgtccgtcattcaatgaataacaaaatctgtccttttctcccttttcctgtttcagactttaatagctctccctgccctcttagggctctgcctgctttaattggcaaggcagtcatagcacacagccactctgtaccactagattgcctccctgtgcctgggcaatttcagaaaatggtggttttcctttcgtttccatcttttttaagacttaaaaagtatctgctctcattttctcctagcggcctccatgccttgactcaaaaaatgctgccttagttgacagccttgaaatgagtatgaccctagctctagttgggtggaaatcacctcgcatagaaatagacctggagggccgggcacggtggctcactcctataatcccagcactttgggaggcccaggtgggtggatcccgaggtcaggagttcaagaccagcctggccaacatggtgaaaccccgtctctactaaaaatacaaaaattagccgggcgtggtggcaggtgcctgtaatcccagctactcaggaggctgaggcaggagaatcacttgaacccaggaggctaaggtggcagtgagccaagatcacgccattgcactctaacttggcgacaagagcaagactccgtctcaaaaaaaaaaaaagaaagaaatagacctggagataagccatctgcagagaggtgcccatcacacatggagagagcctctgtactgtcgcaaagtcagcactttattctgccctgtgacctgtccctcagccaaaggctctgtgactcatggccatgctatgctcagaagccctgtgtggtaggaactcctgaagctaccttgggttgccattagcccagatactaaagtgcctggcttgttttgtagagcaacctttttattttcagtgttcctattgcttaagatgggggcggggataaaagatctaagcactggtgtgaaagatgaggtgaagacaaatacaattaagaccaaaacattcatttctaaaaacttcatgagggaaacgggtgtgctttgcagtcttttcagccattactcacatccttaggagcaattaagcttttcaacattcaagacccacaagagttcagtcaatagttacataattatggcatgtgtgggtgggtgcggaaggctgggaaggcacgatgggtagacaaaagttaacgttgttttgattaaaggttgtacataagtctactgaagaaaataattaccaatattagcactggccacttttcaacagagtcaacagttgacactcttcacatgatttaatggcataaaaatgatttctgctccctaccaaatctttaaattgctactcttatcagaatatggaattcctattagggtcacagctcatgtgaattgctaaagtaaggattgtgaatctcaagggaatgccattagtctttttgtcatcagcatcattctcaccatcatcttcatcacaggttttcatccaaagtgcctgaatgttttgtattttactttttgttttctatatgtgcccttggacatacaaaattttgcagatttttatcattcataatttaaggagaaaatctgctcaaagtgatcctttataaaaatattacatatgtgtgtggatatatatatacacgtgcacacccacacatacttacacactattttccttatctataagaagaaaagtgatagattatttgaaattattgaatattctatgtatatgttaatataacaatgattttatttcataagtggcagcacactcgcatattaagctgtcaaagtcttacagtattacctagttctaattagtactgaaactttgtactgtggatattcatgtttgttctttactctgttaactgtctattaaatatttcgttttgtattttcatttttttctatttttattttgaagcaatgattttatttaattaagagaaatgcttaaagacttaattcataaaacaccgtatgagaccattacaagcatgtaatctccagcactttgggaggcaaaggtgggaggatcacttgagagcaggagttcaagaccagcctgggcaacacagcaagaccctgcctctacaaaaattaaaaagaaaaaaaaaattaaccaggcatggtggtgcatacctgtagtcctggctactgaggacagcttgagcccaggagtttgaggctgcagtgagctgtaattgtgccactgtactccagccttggcaacagagcaagattctgactctaaaataaaaacaaaatgtttaaaaaaaaaactgtggaaaatatttttttatattttaccctactaaatgataccaacattgtatagcttcctcaagcttgaattattatccctttataatctatgagaaagacaagtactttgtagtccacttacaaaaaaaaatacatatttttcacttgtggttttaaacataggccatgaagagatttacatatcatggctctccagcatcctgtgtaatatatactcgtgtgtttatttccatcttacaatctctattgttattatggctctggcagccatgttttttttttatttaaaaggtcattgcttgtaaccaatttcatcacagggttatttgtaatttgcactgttagaacagagcttcgccttgttctctggtgaatctccagagttattacagttatgcctgcgcaggtatttccctatgtgggtgttactttgtcgctgcagttgttgatgatattttatttgaaaacatacacttctctgtgaggttacaaattacctcttttcttcactttatttttgtgcttggactcagatacattattttgttcatgccatagggattgaagccacagtgtgtaaaattccagattgccattgtaatactgttcatccagtttttgtttttaagaggtcttcatttaaattgtgaattagaggggtgatttttattcaggtcaagtgtcaaacttgccgggatgaacttatttagttgttgctctgggctggtcatgtatgcaatcttccttgaaatatgtgacctgttagagggttttatcttaaaggtaagagtgattctgtttagtaacccacccttttgcaagttctaaaaagagaaatggagtaaactattaatggtgaagccaatgtttatgtttcttcctggtgagcatgatagtatgaaatatgtcagtttgctgatcccaaactcattcactccttttaagttttcagaccccatatgctgataatgtcatcattggaatgtatccagatccaactagatacttgtagctgataaagtttgaggcgaacagtgtcagaaaacacacagcagagaaaacaagtccttcaacttcttttttctctgtcagaagcaaattttcaggcctatgggagaaacaacttaaaaatacacctgaaatttctacaagaccttgcaatttcccttcacatctccacaagcagcttgtcacagaacagcacgagcttaaaaagctggttactaaatcctgctgcagaatgccagatctttcaagactgtttgacacatgcatatagtttacactgagtgaaaaggaaaggaaaatgtggttcttttgagggtgtaaaggaaatggtgtagtgttttctttctgtccagtggtttatctcaagcttcccattgctcaccgtgacaagaaaacagctcagtttcctttttggccagcctcatcaagtgtaatggaagaaaatgtctgtctcttttaatgcagttgatgaacaattgtttgcataagcagaactcgctcagcgaagtgtttttcttgctgaaggcctcactgatgtgttatttgaacggtgttgtgaagcgggtctctgaatacacatttgttccagtgagtgtggttataaagcccctagtagagactggggtattgtaaagcctaatctcctcacacattatttttgtatcgggatatttttaatatgctcactaactaagcccatatgctttgaaatgtttgtcctgtatattgcttcattactgcttatcaacaagtaaggttgtgctggctttgcagaaagagaacaatagatgatgcttgatttctttctgtgctggccaaagccaaccataggagccattcttttggtaacaaggctacctgttatcttacagctcgccaaatgaatgttcagactctgttgttttagaaaatcattatcagggcaaagtctaccattagctttcaactctaaaagaaaatcaataacttgtttcaaacagacattcctcactcagactatgcctgttgcacaacgttgcataacagagggggaactgagggtggcgagtactgaaaaggatcacttaaggggcctactgctgatgctgtgacaaaccattgggatgtttcataaatgtagaggcaccattgtatattttgagcacagctacttttatttcaaaaggccagatctagaaggtaaggtaaccattgtcagtgagaaattgaagcatcccagaaacctgatctataccatgcggtatacacgttcagtaatctgatttcggtgagaagcaccaatcaccagatgacttgctgaccaaagtatgttttttcttttctttcttttcgtttttccttttttttttttctttttttgagacagggtcttgcaccatcacccaggctggagtgcaatggcacggtcatggcttactgcagcctcaatctcctaggctcaagcggtcctcctgtctcagcttcccaagtagctgggatcacagacatgtgccactgcacctgactaatttttaaaatttttttgtggagacagggtctcactgtggtgcccaggctggtcttgaactcctgaaatggagtgctaaccaaagtatttagttagaaggattgaagtgttctctataggggatgattaacttaggtaaattgccatttcctaataactaaggtaaaatgcattacctaataaccaatttaagtagcgagtagcttttgggtttgttcttttgataggcatttctgttccctgtttggctgccatctgtggattgcaggagacctgttggtacctagtttaaactaatcttggcttaaaatttcactgtcatcctgtactagaaagggaatcagctatactgtatcctgctgtaaaactaaaatatatacctaccccccaaaattcatcaacatggccacctcacaggtgtgcactcctggactttccctcttttgagagttgtagcaaatttttatttatttatttatttttggcattaacatcttctagtttttggaagagcctcattcttattgtatctgctctgtgtattctggagagaggtaaatggtgtcttatgtcagcatttaccaagcctcattataaagactagacgctgggtttagtggcttacacctgtaatctcagcactttgggaggctgaggcaggattgcttgaggccaggacaacatagggaaaccccatctctaccaaaaaaaaaaaaaaaaaaaaaattagccaggcatggtggcctgtgcttgtaatcccggttactcgggagactgaggtgggaggatcacttgaacccaggagttcaaggctgcagtgagccatgattgcactactgcactcctgcttgggtgacagagtgagatcccatctctaaaaaaaaaaaaaaaaaaaaaaaaaaaaattaaagaagactagaaagtttgatctcttcaatttaaaccacatgccaaagccaaaatcacagtttaagaaaattgagtgtttatgggctcataagagcaaatatatgtatgccacttttctcaaagaaacgattttgaaaaacaaatcacagaattttcaaaattttcaaagtcaattcataagaatcgaaatggagtcaaccagttgtgtgatctgtacagaactttctggttaacgatgtgcttgtattttcctcttccagccgaacgcacggccggcgacgcagagcgggcgacactcggtgtccgtggaggtgcagatgcagcggcagcggcaggaggagcgcgagagctcccagcaggcccagcgccagtacagctctctgcctcggtatgaggacgcttggccgagcctccagatccccccggccctttaagatcccccgccctttaggaacgcgctccttcccaagtcactggggcctctccagcttgcccctggtagcaacagaggaaccaataaatgtcccgtggctactgttccttagcgtggggggctgtcgtactgcgaggccaggggaaatgcccattgcaggagatgccagtattttcacccacaagctccctaaaaaagtgaagcgactcgtgtactggcttcttagtattggctctcctgcttcctgtgtggacaagacagtatcttcatctgaaaaatgggaagataacccttatttggcttagcacatatggttattagaataaatgatacttcataaatccagagctccataaaaggatcgagagtcagtgctgcatacgccgtggttgtgtgggatccatggtcccaaacctcactctcttactgtcccatcatcactgctctcacccatgtttaactttagagggtctcagggatgttgagcttgttagctgggaaccaagcaagaaacccttacttgcctgctccccaggggagacgccttggcccagttctccgacaaaggcctgcaagggtctcagggtgactgagtgccagtacattgaaatagtaactatttttccatcaaagtttttcttccaggcatagtaaagaataaaaatgttgaaaaacattcagctttttaaacttcccaaaacaggtgactcctgtagtcacaattcttataggcatttgttgctgtatttcaaaatcaggtgacaaagacatattttaagtgggaaaagattcatttgccatgttgatatcaggtagacttttgactttgagcaaaacagttttagggagttaggagacaaatgcttatcttgactgaccagtgtagagtgatcttgatcaatttctaataaagatgagtcctggccaggcacggtggctcaggtctgtaatcccagcactttgggaggctgaggcaggcagatcatttgagcccaggagttcgagaccagcctgggcaacatggcaaaacactatctccataaaaaaatacaaaaattagctgggcttggtggcacatgcctgtaatcccagctccatgggaggctgagatgggaggatcgcttgagcctgggaagcagaggttacagtgagctgagatcacaccactgcacttgcctgggtgacagagcaagaccctgtttcgaaaagatgaatttctttacatgttaaataatcactgtaacaaccacaacggacttcaccacatggatacaggtcagccaaggggacatggatgtgaatgagtctccatggggataagtgccatctattgtagcagtttattcattcagttgttctttttcaatccataaggctatataaaacccctttgagtactaaattattttttcctttaaagaggagaattgccaggttctttagcctgctgtaggtaagagtcattaaagttttggtctttataggacctttgagataatcttatcttacaaggaaacagctcagagtaagtaaatttcccccagctcacacagctagcaagtcattttgccagcattcaaacctgaatctgcccatgccctaaaccatgattttataaggcccgttgctatcaagggcttctgttcccaaattttttgagacagagtcttgttctgttgccccggctggagtgcagtggcgcgaccttggctcactgcaacctccacctcccagactcaagcaattctcatgccttagcctcccaaatagctggggttacaggcgtgcgccacctcgcctggctaatttttgtatctttagtagagaaggggtttgccatgttgtccaggctggtttcgaacccctggcctcaagtgatctgcccaccttagccccccaaagtgctgggattacaggtgtgagccaccacacctggccccaaatttgggatattaacaggtgcaaagttcccctcagtgctctcctgccctcagcatttagaaggaggtcactgtgtgaatcaacccagtgaatcaaatgcctaagcacttgaagaattagacatcaaggttggtctgtgtaaaatccaccctatcccccactccgctacccccctgccccctccccactgccctccagtctgtgtggctgcattccatcggaagggtgagctgacagtgtggacgaattggcccacctggcatggccctccctgcacgaccacacgggtgggccagggcacttcatagcttgtgtggatggtgttgtcagggcaggggctgtgttcttatttttattggccagttgtttggcttcatatattttggccgtgcctgagagtgtctctaaggattgaaggagaaacataacaaagtgtgtataatgagagcagtgatgtgggagctgccaagggctgagaaagggaggtgggagagagagcggtgggcgggccgggaaggcagggcagttgccagggagaaggggcacttgggtcccagtcctcagaagaggcaaaagacagaggcaggtgcttccactgaatttctcctggttgcattccaaagtagctcatgcattcccgccgaacctttcatcctcgccttcccattcctctcccttctttactctgagccccgacatctcttcccttctccgcctctccctgcggaagcgcctggtagagatatctatatttacacgcagaggagggttgcagccgctaccgctagtgcctccgctgttatttagtggtgccctaaataactacagctttccctctgggttaattgtagctccctatttttagtcattttatcctatttagatatgagaaaagcagacatcctcaaattaaagagttatgtaagtttgggcagcggaggctggtaggtttctgcagtatcttcttgtcttcctttagagaacaatttatcaatgagaatcttcctgtttgtgagggagattaggaacatagaaccctgcgttcggcttgatgccttgcaaagcagccccactctgtggcaggctgtgtgcagagatctgagggaagggaaagaaagcaaacaggaggtcaggggggactgcaaccacctccgtgagcttgagtcaagtccaagtttctgacatgtgatattcttcaaagacacttgacctctgcttttcggatgttgacaattaacagagttttgtctaaacaagttggtatggcattagaaaccaaaaagattacacacagaaaaaaagtatagttacaaagtggagcgtaaaataaaacaaatggtctgggctttgtatccgttgcattagataaggtggtttgaattagaggcatgtatatgagaaagagtggtttgtaaattctaactgtaagtaagaaactctatggacagaaatcaagttacattttggcatgtcaatgagaaacactggccaggtggtaacactagttggcaggaaaagggacctgtgtggtggccccacactcagttctcaatcagaataggatttttgtttgtttttctttttctaaaataatttattttttattataaattataggctgggcgtggtggcttacgcctgtaatcccagcatttgggatgccgaggcaggcggatcacaaggtcaggagatcgagaccatcctggctaacacggtgaaaccttgtctctactaaaaatacaaaacattagccaggcttggtggtgggcgcgtgtagtcccagctactcgggaggctgaggcaggagaatggtgtgaacccgggaggcggagcttgcagtgagccgagatcgcgccactgcactccagcctgggcaacagagcaaaactccgtctcaaagaaaaaaaaaaaaaagaaaaaaattataaattgacagtttataattgtataatttgtggggcacaaagtgatgttatgatttatgaatatagcataaaagaattaattaagtttaatcaagttagctaacatatccatcacctcaaatatttactctctcagcagctgtgaaatgtacaatactctgttattaactatacctaccatgctgtgcagtagaacagaaaaattgctcctctgtcattgagatttgtaccctttgacatcatctttttttaattcctaaattagtttctttccttaatatccaaaaggcagcccccaaaaggaatagaggcgtgcgtagtcacaggcactggtagagagaaataaggttcttggtttggtgtttcccttcattttcttttcctgcctctccatttcttcttcatctttctcccctccctcggctccgtgtctgctgtggtctgacttcctcgaaagccttgtatacctcaccctccacgctgtgtctctgcaccctcccgcgttctctccacgaggcccatttgttatgtctccaatctacttcccaacttcttagcctcgctccctctgtcttcctccttctgtctgtgtccccctcatcctggtggcttaatggctttcctcgggcatcagatctttggtttgagtcctctccatgctgatggtctccaggccatgttggaggtggttgtaatctttaggtgataatctttaggtgatagttattgccaaaccatggtacgtggtaagtgctttgagtggatttagcaatgtccaggggctcactgcaggaccaaacaatcctatatgttggttataaagaaattcaatgaaaggagattgatattttgttgctgttgttacccatggccttagccaagggctcacaggacagtgggaagaacatgggcttccgtctgatctctgcagcagtgtgccaaagttgccctcgcttagtaagggttcctttctcctctgatgcttttctgtgtcttggcatctctactcaatccctccaaccaaggaagggaaagctaactttaaaaaacaatttttggccgagcagagtggctcatgcctgtaatcccaggactatgggaggctgaggtcggcagatcacttgagttcaggagttcaagaccagcctggtccaacatggtgaaatcccatctctactaacaatacaaaaattagccaggtgtggtggtttgttcctgtaatcccagctacctgggagcctaagacagctgaatcgcttgaacccaggaagtagaagttgcagtgagccaagattgcaccactgtactccaccctgggcaaaagagtgaggctctgtctcaaaaacaaaataattaaattaaattaaaaacaattttcttctttggtcaaaaagatgcctccctaagtcctgagcctttttttctttttctcctcttttagagatgaggtctcactttgttacccaggctgcagtgcagtggtgcaatcacggctcactgcagcctcgacctcctgggctcaagcaattctcccacctcagccacccaagttgctgggactacaggcacccaccaccacacctggctaattttttcaaaacatcttttgtagagatggggtctcactatgttacccaggctgatctcaaactcctggcctcaagcagtcctcccacctcatcctcctaaagttctgagattacaggcctgagccaccacacccaggctcagagcctaatctttgaaggcagagtgactttgtcttcaaactactcctccgggacctattagtcaatcacttactgagtgcaagtcacttttctaagcactttacatgtgttatttcatttctttctccccacaacctttcagggttagagattatgcctgtttcataggtaaggtaacttgagcccagtgagcagaactcgcccagtgtcacacagccagccagtggcaggctcaggatttgaatctacgttgctctaagcctaagccactcccaccttgcccagctggatgcttagtttcctagtgtaggaaactcttattgtctgtttccttcccttggtctctacaattggcccatttctcattctctccttaatcaagagcatatagatactgctaacttccttaccaaggaattgtgtgtgtgcgcatgtgtgtgtgtgtctatgtgtgtgtgtgtgtgtgtgtgtgtgtttctgtcttatgtgcattttacccacatatcttacttcagacctcagggcagtctgcttccttctctctatactgattaatttgaagaaaattttagctacaaaaaattggttctcccacattgttgtaatttccatccctaacaaacctttagtgaattctccctgtttaaatgtagaaagactgtgtcttccggggatgatgcagaatccacttagggtgcacagctgccgtagagcgaagcctggggctccatgaagctggggaggaagggggttggtggatcttagtaggccagagatgaaaaagaggtgaaatgtctgcagcctatttctgattatcttcaaactgataactcataaaagaatcccatttttgttgctgtaatatcagtcacaagttccttgttttaattaaagtttcatgattaatgtcaaatccctggtttcatgccggcattttccaacagtcttgtctctgggtagattaatttatgacttaagtgaagataatcagtgctttaggcaaataaactattccatcacatctaaggattcttgcctgggctgactgtacaaatggtgcagtcttccgttaaaagagacagacatgctatggaatgctcatccagtcatcgtcatagccagaggtgatgctggacattatggtcattttctttactgaaaatgttcccaactacattttaggccatatggaaaatgggtgcatttcactccaaaccatattgatgcaattgtgaatgttcaaaaatgcaaattgcatcattcctgcgggagatgcagtggcttcccagaccttcttttccttccgtgaaaatctttgtgaacattcagctgtgttgtgtgtgttgatggagagggttgagcaatacatactgtcgccaaatgattttcttattgataaatggagcaatatactttgttttattactcaattgtctctccccctcttccattttcaaggcaaaaaaattagggcatgtcttcctttctggcacagaattgttttatttcatcatagccaatcttattgtaaattcataaaaccatctagagacttgatagtaaattaaagatgtttcaaaacaataatgtttcctggaaatcatgcccaactctgttgcagaagtgggaagaatttgaaatttccatgtgactctgatttacttgcctatcctggggtgacagaaagcaagttaagtaggtcaccctggcctttggtgaaggtaaatgtataagaaaatagtgcttactttacagacttccggactctccgtccaatctggatgagcaggtatcccggagagtgtaagttgctgacatacacaacttgaaagccagagctttaagggactgcctgttgcattttttatcataaaggagtctagacttaaatctttcataaccgaactcatactgtaatccattacatgtacttcatattagctagcgcttctggcattatggtggcagctgtgtaaaatatttgttgtgcttgtttagaattgaattgtaatgttctaaagcgagcaattattcctaccatggaagctgccaaacctctaatacttctatactttgccagtgtgtctaaattgcaggagatattggtaccctaagcagaacagacacaaccttctcagacacaggaggatgaccctgtttctaaatagctgcacagtctagttctctctcctgtttactcgttgttagtttagttgtctaagactatgcgcttgctgaggacagtcatttttgaattctccagcccctatcgcagtgtctggcatgtgatgagagaacaggaatatttgttgaaaagtgaaaatgcatattccatcccatcctgccccctttcctccctctccctccttcttcctaccctcacactaacctttgggttttgctttctaggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 38672 - DNA, 16361 bp, Homo sapiens
gagcccggcttccgacgtgcagcctggcagtgcagtggtgagttggagcgcagggccgttggggattggggtcattagggccgttgacagtccaggccagagggcgagtgagcgaggttgggcccgaggctgcctgtaagcaggtccgttcagggatgctccaggccctggggcctgagggtggcttccatggctccatttgccctggctgttcctcggtgtacggggcctgaggggagtgggggaggcccgtgggtggcctccttttgcgtcctgagaatgttctgggcagtatcgagattagggctggtttctctgcggaggagatcatttatccgtagctgggagggctgtattaaccgaagttttccagtagtgggccacgctgtcttaggtagcgtgctggacagatacagacatcactggacgggtacagacagaggctgggttcgctttacgccaagtaccgtgcaatactgtgggctgttgacttgcctgagtagtttcatagaggcatctgtagtgttccttggaaacactgagtcagtgatgaattctgcctaggaaatttagggaaaagtttcccaaagagagaagatggcaagagagggctaaggtctaaagtctcttagctctgaccttcataagaccctgaagtaagaggtagtgtatcttggtagcctatactatagcttgtatccaccttttagtgtcccttggggaagcttccttaaccgcttctaagcctcccttttcttactagaaaagtggaactgataataaaaaaatagtagttccccccttatctgcggggtgtacgttccagtggatgtctgaaatcttggatagtgaaggaccctgactgacttaccgtggtttgacttacaatttttcaactttacataggtttattgggaagtaaccccattgtaagttgaggagcatctatactgtgttttttctcatacagattacacatacatacctgtgattacttagtttaattcgtaaattaggcacaataagagaataacaacaataataataaaatagaattataacagtgtaataaaatgtatgtgaatgtggtctctctcaaaatatcttactgcactctactcacctatttttggactacggttgacctctggaactgtggaaatcaaaacctcagctaaagaactactgtacctagtaagcggggttatgaggtttcagtgagctaaatctttgtgtattacttaaaataggaccggattcattgtacatcctcaaatgtgcactcattgatagaatcacacccttgtcttttggagcccgggtttttggaagctggcttaccgcaagccttcctcctttttttgtttctatccattgccaaatgtgaggcccagaatgacagggaagaggacaagcctgtgcttcagcaggcagaaggctgtgctgaagcagaggttgaataccattcccattagccaaactggcttgagcactttcctgtctttcctaccctgggcagaaagaaccctgttcatgggtcacaaatgaataaaacactaccaacctgtctgtaatcccagcactttggaaggccaagacaagaggatcgtttgaggccaggagtttgataccagcctgggcaacataatgagaacttgtctttacaaaaccaaaacaaaacactaccaatttgagatcttcataggcaaggattagttataaattgtttgtttgtttgatttcctgttattggaaaaccttcggcagctttttaggctggcagatttaaagaaagtaacctgaacctggatgccttaactgtgtggtcccttaaactgccaatgggtagaattgcgagggccgtgaacttggctgagaggaaaaattgcatctttatgtttcctaacctccaactgaaatttagcattttcttccactgtgaatgtaggcaacaaatcacattattagcagtgtgactttgttatgaatataaattatagatattttcatatcatgatattgtgtaagctcattgcaacttcgaaattatggtagttattaaatttgcttctagatcacatatataatgtgtcagtaaagaagcacatatgtttttgtattttgataaaattttagcatacagtctatcctcattatttgtggattctgtatttatgaattcacctacttactaaaatttgtctgtagccctcaaattaatacttacaatgcttttgtggtctttggaagacatgacattttttcacgtgaaaaattttagttgcctgatgcacatgttctcaactgaagtcaaacaaggtgacactgccttcttgtcaactctcatattgtaagcaaatgtcatttttgcagtctttggtgctacatttttctcatctttgtgctttttgtcggtgattccactgtttgagatagcccccaagcatagtgctgaggtgcttctaaatgcaagaagattgtgatttgtcttatggagaaaatatgtgtgttagataagctttgtttaggcatgagttcagtattaatgaattactaatgtatattcagtaagtgcctttaaacataaacacacataaaacatgattatgtattgattggttgacaagaatgtgcccagaggctttcaggaacctgtttccccaaggaacagtggttctgtgttggataatttagtgtctgtagcgacttcatagaacataattgttgtgaataatgagaacctactgtaattggtttcatttctaaacctgtgtattttctgtaaagacatcctgagcctgagtctggtggctcatacctgtaatcccagcactttgggaggccaagacaggaggattgcttgagcccaggagttcaagaccagcctaggcaacatagggagaccccatctctacaaaaaattaaaatatccagacatgttggcacgcacctgtagtcccagccactcgggctgaggtgggagcaagacttggcctgggaggttgaagctgcattgaccatgattgtgccactgcactccagtctgggtgatggagcaagaccctatctcgaaaaaaaaaagtccgccaaagggggtctttggcacacacaaagaaataagaaccattagcccttaatgtagcctgagaaattagatctatccttttttttttattttttatttttattttttaagatggagtctcgctctgtcacccaggctggagttcagtggcacaatttcagctcactgcaacctccgctgcctaggttcaagtgattctcctgcctcagcctcctgagtagctgggattacaggtgtgcgccactacacccagctaatttttgtatttttattagagacgtggtttcaccatgtcagccaggatgttctcaatctcttgacacgtgtctccctccagcttctgcccttatttacctgcctgttggctcttaaaggcatttttggttgagacttttgcatgtaaaataagaactttgccatctttggattcccccatgtttgtttgtttgtttttaataaataatatttaatattaaaaggagctgtggtttttttctctctaaagagcaggaaaggacagagactggtcgctctctgcagtcacacttgaggtgaagaaaccatgggatagaattagctgttagttgagtccctaggttcagaggaagaaagaagaccataccacctggtagggagtgcgaaggaggttccagggactgatccatagaagggtgtcagaacaacttcataataaagagttgccttattttcttggtcaaggggaacttcctgtgtgccttctatcctgatgacaccccctcactgaaatcctggtgttgtttccacagagctgtctggccttttgtccttgatccttggttaaggaaatgaccaaccaggtaagacctgtgttgaagggaaaaacatcaattggtctctttgccaagttcaagtccagtaggttttctggatgtgtagtcaagaaactagcatctcattcttgcctggctcctaaagagctgggtgaccctgggtacctagtcaccacagtgttaggtgggactagtgaaatgcaaatactgagaggaggattggttcatccaagtctttaccacaatttagtgagtaatagaagaagcttaaaagatgttgtacaaaaaaaaaaaaaaaaagatcagaataggagatagaacaggagaaacatatctttgtaataagattagggacaaagttaatagacggttaggcaggctgtgtgttcttattgcagctgcaaaatttaagctacaaactggactttgagcttccttggtgatcagaacagaaaaagaaaacataatttattggtctcttgttgagtgagtttgggtagtaggaaggaggggagaatgtcagtttctttaagaatttttttctgatatgactgtacaaatcttgcatgaatgggaatcaaggagcttgcgggatggccaggttgacagcagaggaagtaactaacactgtggtgactctgtctactcggggaggagtgctttctggaggcaatgtgagacatctgaaatctgaccatgggtttaatgtggcttctgttcttttttagtacggtattctcttcaaacaagagcaaggtaagtagcctgcctgtttaagcaattcatctgtgaaaaaaactgtgttgtccctggtttaagacttttgtcatgctgaccagacatgcagttttcaagtatactcactttgcagaagaattggcagctgaaaacaaatactcttaaaaaacagacaacaacaacaacaacaacaaaaacctgaacaaccagctaaaaaaaaaaagcagtcatcatgataggttggggaattctaggctgaggaaaatttttccacctgaggaagacatgatggagcttcccagctgctgaggtggaagaaggaaatgctttgaggctcaaaactctgttaatgccggctcatctggggaggtgaacgtgagcctttttctgaactcagaacttgctttggcccttaatgaaagtgaagcctataatagtgaaatgagtttctcttgaggccaccgagtgcatggggagggctgggagctgtgcagcagtggcagtggcagggatgggagagcaggtggcaggtcagagtgggctgggattgtaactgaccagtggtacagagctttgtacccaaaaaggagccatgtttgtgcatgggctactcacccatctcatttcttcactatagcctcgatgagtttgagaaggcctaaggaatttgtggaatgcctaataaaagctcttgctctctaagtaggtgacatggaggtagtttgacgtttaagccaaaagcatcattcaggttagctagtgtaagtaactagtaggctaattgggcatgccagtcaactaccttatatgtagctattgtcatccaggtggcaagttagcaggcttgagttaggtgaggtttgaaatggaagccacaacgctgtctgtggtgcacagctgttttaagtttaatgcctttatattcatattttgggaaggtatcgctggagaattgttgccaggcaggggtaaagcctccatgtgcacttgtcacgtttttacatccacactgggtctgcacatacaacagcatggcctaccaaatatgcagcttacagacttagacttaaggtagactttaattaatagagattggatttgaatcctagcacctctcattccttgtctataaaatgaggatattaatagtacccacttcataggattgttgtaatgtaataattggcccattaaccataataaagatacttgtggggaaaggcaacttaatatatggaggctatagtaggtattttcttttagatctatactgtttagaattgaactgcctgcttgtttcgaaagatcttttcggagtatctgttaccgggtttaggccttttcttggtaggagggggtcttccccactggttttacttgtttttagccaagtgatagccattgtagactcctatataccagatagcatgctaaaagaaaggacactggatttagagtccgaagtactaccttgtcgcctggtaaacatgagatttagggcaagtagcttcttcagaacctccaattttcatatgtggccccaaaatttcaataaaagctgtataggaaagcactttgtaaaatagtaaagcaaatacaaataaatgttacctcacaattgttgaacagtatctcggcttcattaagtcgtatgcaagaagactttataaatgaagcactttccattctagcccatgatgatgccatttggtcagttgcttgggggacaaacaagaaggaaaactctgagacagtggtcacaggctccctagatgacctggtgaaggtctggaaatggtgagtgcctctcccctaacatacagccttggaaaattgggggctgaggttttgcttctgaactctccagttgcagtccgggaaatacttttttctaggcaagaaagcaatagcaatatggtggtataaaacagcagcttatttttcccacttgttttcctgttactctgtattaaagccctaaagttaaaaaaaaaaaatcttaaagtcctacatttaaaacctggcagcatttggtgttctgtagctcattaactcttctctgattctgtatttcatagaccattggtattgcatagtcacagggacccagaatttcagatgccaggtaaagtgtgttctttgtgaagaaatccatttctctgtcccctgttgaaggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctggtaagagttttacttgtaggggagataatagaggttcatgatttcttttccaaaatctttagggatagaatgtgttttacagctcagaattttttggatttgagaggggtgataatgtgtgcatgaactgtatttcacataataccctcagtggggctggaaacagcactgtaatgaaagactaatacctctgcaagtaaacatgaatgtttacactaagggagataaataaaggctataaatagccttatgtcaattcaggttagattttgctgccaaatgaattttggtagtaaacctgtagaaaaagcttgtagtttccagagctttttggatttcaaaactgctggtttggcgttgacctgtattttgcattttccagaggttctttatttgccatattctgaactgattcattcactgccttacggaaacctagaatgtaaagcatggggtccttatagatctgtatcatggtcatctctactaattttgattaaagggtgtgattcttggtatgtgatacatatgaaacttttaagaaacatcaattttttttgttttaagtactgtagaacagcataatcttgtccatcagcctcagtaaacatcatctgagatgacagaaattaatgatgtcataggctgactaatgtggagcagcagaggacatttcaggattcttttgaacttcacatttacttataaatggctgcacaacattccccagcagaacctgctctgccagaatgggtggtaactgctagagggtgcagatagcctggcatttctctggcacacccctttttgggttgatgatagaagagctgcttaggtgttccatgaacacagttcccttgattggtgccctggatggattcgcctcccgccagttatgctcagtagccactctaggctgttcctgtattggaaagaatgatggtcccagagtttttaaagaggctgggttgtctggaaactgagtgcattttccctcagaagcaatatttcttgtctgtaattcttaccactggagctcttttaagaatatgcctgcccagtccatattttggatccactgaatcatagtgttcagagtacgtggggtgggatatgtatttggaaaaagctacccagacgcaccctgactcccctgatggttgtctttacatgtacccttaccctgcttacattacttacagaggacttgggtccccaaactatcctgcaaagtctattaagactccaatatataagcatggtcttaagaaaagaggaagagacagaactgtttctaccttttcatcttgggcgcctaagctttccctgggctcataatgctggtgttattccatgctggttgtagccctgggcacaaggcagctgaagaaatcagtgctggattggttccaagtaaaaggatggcgtatgtatctagctcactttctctgataaacagtaccttttactggatattctccaagtgtggcaaagttttaaaggttactgttatgaaagaaaaagaagaggccaggtgtggtggctcacacctgtaatcccaacactttgtggggctgaggcgggtggattacttgaggtcaggaattcaagatcagcctgaccaatatggtgaaaccctgtctctactaaaaaatacaaaaaattagctggacatggttgtgtgcacctgtagtcccagctactcaggaagctgaggcaagagaatagcttgaactcgagattatgccaccgtactccagcctaggtgacagagcaagactcaatctcaaaaaaaaaaaggaagaatggggtctgagagttggatttattttctttttggataggactctgcataaaactagaccaggccattaaacagccaacagttatttggtccagtaacaaaagcaagcattgctattgacagctaaagagcagctaaattcatctgaaggtaaaactccttggatgaatttgggtctaatgaatgtagggaaaatagacacttagtttctacctatcttgaaaatatgcatggagaatctgaaccaccacacaggaagagaaaaagagaagagagacaatccccagtcgtggagaagtaaggaagtaggaggaagcgaagaccatgagtgtaccagtctttgtgtggacatatgttttcattaggagtagaattgctgagtatcatggtaagtgtttgttttcacttaagaaactgtcaaactggttttcaaagtggctgtgccgttttacattcccaccagtgtatgaaggctctggtttctccacatccttgctaacacttgatattgtcctattttaattaaaaatttaagaaacccttaaactaaatttaaacttgataaagaattagcatctttacaacataattttctgaatcaggacactgctactccgatttaaaaagatgtatcctttggtaaaactttagtttttaaaattaaggccaagtcttttcacactgtatttttgtccttcttttttctgttcagtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatgtaaggaaacattgctctctgttctccttctgattctttcagtttacccttccagcctgttgcagtccttgccacagattctgtcttggtctggtcaggcagctgctgtctcactggtgtggtttgccaagtagccagttagacctgtagatagcaggaggtttgcttgtgtttggtagggacagcttaacaacacggagtctgaaagtgctaatttctccatatgttctctgaacagagtcctgatgggaaatacctagccagtggagccatagatggaatcatcaatatttttgatattgcaactggaaaacttctgcataccctggaaggtatatatcatcatcttattttgacaaactgggttatcaaatcacaaaggaagaattattctttcattgaaatgccattaaatggcaaatgggcattagatttacaaaatatcaatctcaattggaaaactgaaatgcctccaggttttagtcttgtcactatagttttttttgtttttttgtttttttgtttgtttgtttgttttcttttagagacagggtctcgctcccaggctggagtgcagtggtgtgatcatagctcactgtaaccttgaactcctgggctcaagggatcgtcccacctcagcctcctgggtagctgggactacaggtgcacaccacgatgtctggctagtttttaaaatttttgaggagatggggtcttgctgtttcccagactggtctctaactcctggcttcaagatttcttcctgctttggcctcccaaagtgctgggattacagacatgagccaccatacctggcctgtcactatagatttaacctagacatactagttcttgtaacagtgttaagtgcttgtttgggtgaacagacttactttttatttattatatcgtaatctatcacattatgtatgtgtgtgttaatatatatttgctatatgaatgtctcatttctgttattttggattctgatgaactttgtgattggaaacaactttttgttgataatttgaaggtggatgaaagtattgtgcccactgtccacaccggtggcctctggaaaggaggactgggtagctaaagaacaggggtaggttggagggagactttattatgcgtactgttgtgctgttttgaattctaatcaagtgaatttattacgtcctcacattgctatagtttatcctttatactataataaaggatttgatagggaaataataccttaatttgttcaaccttacaaatcaggagcaatgtatatatccttgtgtggccatatttgtagtagaaaagttatttaaagcaatgtatgctgagggcagggaagggaactaaggagaaatggctctgggaggagatactggggttatgtggatgttttgagaacattaagaggaaaggcccaatcagaactcttgcttttctgcctgaagcacctgagcatttcaactcagtggctcataatcattaaaaggggcattgtcagtgggaagctgagtgaggaggcagtggttcaccagattaacaagggcctttatgaatttcaggccatgccatgcccattcgctccttgaccttttccccggactcccagctccttgtcactgcttcagatgatggctacatcaagatctatgatgtgtaagttaccttaaaggcatctcccttactactgatgcccatcttgtccctttattgttacaaggagccctagggaggagccctagtaaagacctgtgctcaagtcacatcagacaccttgactccccaggcggtcctcccccgttcagcgcccatttttagtgtgtgtcctcaagggctgcttggaggaggatgtgcatgggttccctggtaggatcagatacttgctactttttctcaggcagcctgatttttgtgagcttactgatttcaaattctttgggataggtaagtaatatacagatgaggaaatggagccatgggctgtagctggcccctggggacaggaagaaattagagcatccattttcaagggtagggctgttctagcagacatgcctctgccctagttagggagcagtcagtttataagccgccctgctacaggcctagatgggagcgtttttggttttggcccttgactgcgagtatagaagcaagttaatcatcctctttcattcacagccgtcattgtaaatctgtgcggacccctatgtcttcttcttttcccccatcatttttagtcctgactcctattccccactgaggtatcccctgtaatgtgttggatctgtgttcttgatactatgactcggtgctatggtcagctctcactgccaggcatgcctctggctcattgctcccgaacatggcattctaatccactgcatgtacatatcacactccaaccttagccatgggtgccaagacctcctccacctgcatgtactgcaaccctgaccatccatgtgtgtcctttcaggggcctgtgatagttgcttgggagtttaaacctcacagtagaaacactgctccttctagcccacttctggttaaaatgcagttttttctggcaaaaggttatcagctagacatagaattctaactgcagtttttaactgtaactgagtgagggtgctgtagcccagaggggaagatgtctctatagagttatacttgcctgttagtggcagaggcagtataaatgcagcagttccttacatttgtgactttatgatttctattgccactgttttattgatcctcccagcaaccaatgaggtagcagcacagattagtgtccccattttgcacatgagaaacccaagctgaggtggttgatttgcccaaggaggtggtactgaatgaagacccaagaatgtttttttcacccaatattgatgcattattattaattaaagtctgtagtttacattagggtttactctttgtgttgtacattctatgagttttgacaaaattatgtgtagccacccctaactacagtgtcacgcagaatagtttcactgccctaaaaatcccctgctctaccaaatcatcccttcctcctgccttgagcccctatcaactactgatctttttactaaggcccaggactttttaccctcccatggtcccactgtatcccacctgccccctagcccctaactgaggtctgctccactctgctgaggtctgtgtttaggggtaaaattgctgacctcagttaggtcttatggtggttctcctgccagaggtggttgggtttcatttttattaaaaaagtgaaaatagctgttgtaattagacctgtcttgttcttgattaggtttaaactggtctctccaagctgcatctgtcataatgaatacatcttgacactttccttggactgggagcactggccccatacggaaaggctgctggtgcaggcaggagtctgaacctgcccttctcctcagatggcttccttgccccgttggttctcaatttcctcatctgaggggttggcttgcgaagcctctgtagtgtggttctttgttcattttgagcttcagctctttgcttgtgaaggattttattcttggcttttggtggtgtcaacacattatgggttaatgctactattaaaatttgtctctaatgcatgaagctacttcattgaaagaggaatttttgatatagtattcatggtcattataaggatagcagatttggtccagcttattggcagagttaataatatactttccacttcagtgattatactgtagaaattaacatctcaattttgtttgaaactttcccatttcagacaacatgccaatttggctggcacgctgagcggccatgcctcctgggtgctgaacgttgcattctgtcctgatgacactcactttgtttccaggtacttaatgattcttagcagtttctaaaatgctggggagatgagagcagtcttcttgtatagattgccttaacatttaaagatgtttgacccttttttattcagttagcctttcttttctgcagttcttaaaatttttatttagtgatgttagttgaccttagctggaacaaaagtcaacaagtaatccttttaaacagtaaaactcttagttttttcattataaattgaggcttctaccaaagtgactctaaggtagacttgtgttccaatggtaacttaaaatatgtaaatgtttgtaaaatgttgtttatagatcccagtgttggtcaggcctgggatggccaagacagttggaaagcaggagatggacaacttgaaggcattgcacagtgctttagaggcctcctgcgagccttggttttgaagctttaacaggcctccctcccatctggaaataggtagctgtgtctgagactcctggagaacaattaatatgagggccaggcagatcacaatttcaggaaaatggctaccctgtgaggagagaaagccacccaatgatgctgatacctggccatttcctgtaccgaggcatggggttggggggtctgaagttagaagaatgtaagtcatcaaaggatttttggtcgaagtccttccaacttcaaaccgatactaatgttcactttttaaaatagttcgtctgacaaaagtgtaaaagtttgggatgttggaacgaggacttgtgttcacaccttctttgatcaccaggatcaggtatggcattattatttcatctttagatagtcggggttgtttgaccattgtaccaaagagattttcttttcctgaccttgttgcttgagctgtggataccagtagatgcctgggcctgagctgctctatctgctcagtcatccatgtagccagagttcctgtgcagagtctggggtgcagaggctgggatgtgctgtcagcctagcaactcacgaggcatatccccacataggctggaaaacatggtgttagccccacagcctttaaatgccgtctttggaaattgctgcagctggtgtctggggccctctcctgggggctgctgcgccatggcaggctcaccaaggaccttcctcttcaggagattccattgcttaaacacaatcatcgcttgtcatttttgggactgtccaaagaagagatgtgatttttttttttttaatatagtagaagctggaaattcatacaagttttttggctttagtgttattgataacttttcagtctttaaaaggaaactgttctcacaagcaactttatctttgccaaggtgaatatgtgaaatagcaaaggtgttctagtgcaatactgctgagtctttcatgtgtgctcgtatcccctgggaacctggtgaaaatgcagatgctgcttcactaggtctggcagagggcctgggattctgcatttctaacaggcttccaggtgaggccaaggctgctggtcctaaccacactgtaaggtcttggggaactgagcataaaaaataaaatgtccatggcaatataatattggcttttaatatattttaaatatttttagatggtcctatagatttctcctctttgaaatggaacttaaagttaactaacattgttcatgcttatttttcaacttaaattgtcccaacaaaattgagggggttctatcttgatattccacttctggatttaagcatcttactcagggagtaagtcctggctagctgtgtttccttgtatgtatggatcattgcggtgctgtgtcagaggctggagtgaaaggccatcatgcagcccaatcccaacactaaaatcagagtagggtgacaggcttaccacccagaatcacctcctaataatcaggaagttatttatgattagagaaactccaaccacatcaattctgtctgggaaggaggtgtgaatcagttaatttaacacatagcaaataaaaatctatggtccacaatatcatgttgtctagctcctggggacaggcaggctccataggccactaataacagagtgagaattactgactgtggggggcggacacaaggggtcagctgaggagcgcagtttgtgactttccctataggcagtgacctcggggtagttgtggggctctttcttcctggaagcataaatgttggtctcttatggcttccgtcttcctggcattaggttacacttcaggattctgactctttgaaagggttgtagatagtcttgattagtactgtatttaaaaatgatttttttttttttttttggagtatgggaaggggcaggaattctaattaaatagcaataatggaaggtgctcggttaaagcctccattctcactgatttagaaagtacaagaacatcctcatctcagttttggtagattcagaataacgagaaaataaggatgttcatttcataaatattataaagaataaaggcatttgtagaactatctttttttaaatttacaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgc

SEQ ID NO: 38673 - DNA, 29849 bp, Homo sapiens
gcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaggcgcgggcttggcgacgccgcttgccggctcctgggcgggcgggaggatcgggaatcgcggattggaccgggtgtccaggctcaagggcgccgtgattggaaagaacggaaaaggggcatcggagagacagcgagggtcatggaagtggccgcccgcttcccctctgagtgcgtcttccagacccgagttacaaactgccccgtttgtttcctctttctgttaggtgtcagacagctgacacctaacaaacacgcacgcctccaggacagccacatgccgagctgtgctgccccttgtgggtgttgggggcgctcccgaagcgggagagggcggagttagggtggcccacgatccaggagaggcctggcctggtgtttttatgggatgggtattatctgttgggataaacgattcctgcagggccctttttccttcccgaagcacgccgagttttgtgttggactcgcgcgctctgactgaggttcggatctgggggtgcttgcctgctccagcagcgcctcccgggcacctgtggcacgttccccatttacgcgagtgggatctccgcgggggggaccctggcgccacggccagggctgtgcagaaaaacacgttcttctgtccggggagaggaggaggcaccgtgtgacctccctgggagaggatgaggaagaggaagctgagctggcacgggtgggggggccagcctcgggctgccctcaggaacctggcattccctcccagccccggagccccagcgcacagacgctgatgaaacctacgcgcctgtttgcatgatgaaataaatcctcgtggctctctcctcccctctcattgtcgcactgcccccacccctttttgctcctctcccttcattctcctccacgctgctttccatactactagaaaacgcgacagatcctggcgcttggctaggtggcgggcgggggccacatgcttattttctcaggcagctgtcccaccagcagcgagcgcggccagatccgaggtcctctgctgtttgatccaaaacatacactgttagaacggttagggatcttgtccagccctgccgtcttattctacagagcccggcattgaggccccagagcttgaacacgtgtctgttgcccattgtcacaccgttttcccagattggacaagaaatagcaaccaggcagagaagggagaaatgcttccttttctattagaaatgagccaaggaaaagctcgcaggggctcttgttgccattcccgactcatcctctttcccttgctgggtcttttgtagtccatgctgttctcctttgtctctgtcacaatggtctaccaggacaattcctgacaattttggagttctttcaaatgagggtgtaagtgtctgctggatttgttcagggtgggccctgaggccggcctgaaggcgcaggtagcccttttttgcactctttattgctggattgttgggtcaaattggaagccaggatactgtttataggcacttctggcccgggtaccaaggttcacacctgtaatgccagcattttggggagccaaggcaggagaattgcttgaggccaggagttcaagaccagcctgggcaacatagtgagactccatctctacaaagaaacaaacaaaacaacaacaaaatgttgtcctagctactacagaggctgaggccagaggatcgcttgagcccaggagttggaggctgtagtgagctatgattgaccactgcactccagcctgggtgacagagcgagaccctatctctaaaataaataataaatataaaatataggaacttcaaatccacttttcactttgggttgggaagtggggagtgggcagggggctgacagaccacagcaaatccccttccctttgaaggtctttagcagtagggggagtggggaagggacttctgcatcagggcatagcatatgtttctgagatcactggaagaagctagcagtgccaggagcctaaagccagctcactgtttggtcgtccagtggagcaggtacagctcacagtccctaagccagggaaacctggctgacttccactaaagtcaagcaagcctggtcggcctcgattagccaaggtgtggactcttcctccaaagcccacctcagcccacctctgccagggcagagaagccaaaatggtcacattgcagccaaaatggtcacacccttttgctccagagcagaatactgcctctcagtcttccaggtgcttgaggataactgggggcttcatttaagtgcatattctgattctgtaggtgggggtgggaactagattcagcatttctttcttttctttctttcttttttttttttttttttttgagacagggtctcactctatcacccaggctggagtgcagtggcgcaatctcagctcacagcaacctccacctcctgggttcaagcaatcctcccaccccagcctccccaataactgggacaacaggcatgcaccacccatgcccagctgatttttgtattttttggtagagacgggggtttcaccatgttgaccaggctggtctcaaactcctggcctcaagtgatctgcctgcctcggccttccagaatgctgggattacaggcgtgagtcaccatgcccggcctagattcagcatttctaactagctctgactgattggtgcacataccacactctgagtactcaggaattagtgaaacataacttccctcacctttcagatctctggagtctagcaaaaaaaaaaaaaagatggctccatccaggtaaactttgatctctaaatcgtggtgtggagagccaggcttttgatagagtgtctgcatggctgtctgcacctgcttacttatagggactgtcagcttctcaggaaaaaccattggagtaagtaccccccagtcactcctgctgggaatggccctcaagtgattgtccctggagggaaagaagcagcagttgggttgcactatctccattcctatgactccagtttgctttcctttttttttttttttttttttgagatggagtttcgctttgtcgcccaagctggagtgcaatggtgagatcttggctcactgcaagctccgcctcccgggttcacgccattctcttgcctcagcctcccaagtagctgggactacaggcgcccgcgatcaagcccggctgattttttgtgtttttagtagagacagggtttcaccgtgttagccaggatggtctcgatctcctgacctcgtgatccgcctgcattggcctcccaaagtactgggattacaggcgtgagccactgcacccggccctttttttgtttttttcctgagacagggtctcatggtgtcacccaggctggagtacagtggcacaaacatagctcactgcagtctcaaactcctgggctcaagtgatcctcctgcctcagccttgcaagtagctgggactataggcacgtgccaccatgccctgctaatttttttatttttttgtagaggcagggtctctatgtattacccaggctggcctcaaactcctgggctcaagcagtcctcccacctcagcctcccaaactgctgggattgtaggcatgagtcacctcacctggcctccagtttgctttccatggtcattaaccatttgcacactgaggctctgctctgaggttagctgtccagagtacttaagataatttaattgccgaagggagtgtcatgtatgaatatttgagtctgtggagtcttaaaaatatccagcgacaccataaacagctcattagccagcagaacctttgagtgggtcagaaagaaactttccctcatcaatctccacattcccagctccgtgttgcatgtttgactctgaagcctatatacaggcttggatggcagttgtgccaaagacccgtacctggataaggtgaatccgaggtgagcaggtagggctgcaggtgttaatggcaccctgtttggttaagcaaacaaggtctgtgcccaggaagcttaccttggagcagctcccaagtctttggacatgaaacaggcagtgctgggaagaaggggatgtaggctgggcaccaaagccagagcacagcccatgtcctgaggccttagtcacatggagggaagaaattattaaggatgggttaaaagagcttggacattaatgcagtgagggagaaacgatggaccctcttctcacatttacctgagcttccttttaaagtgtttgaaggagctgggtgcggtggctcactcctgtaatcccagctattaggaaggctgagacaggaaaattacttgaggccaggagttcaagaccagcctgagcaacatagtgagactctgtcggtataaattaaataaataaaattttttaaagtgttggaagcattccacactgtgtcccttattaaagatttggtggggggttcctggtgtagagcactccaaaatccctccaatccccagactcctttttattattattattattttgagacagagtttcgctcttgttgcccaggctggagtgcagtggtgcaatcttggcacactgcaacctacgcctcctgggttcaagtgattctcctgcctcagcctcccaagtagctgggattacaggcatgtgccaccacacccggctaatttttgtatttttattagagacagggtttcaccatgttagtcaggctggtctcaaactcctgacctcaggtgatccacccgcctcagcttcccaaagtgctgggattacaggcatgagccaccacacccggccttattattttattttattttattttatttttgaggcagtctaactctgtcgcccaggctagagtgcagtggcatgatttcagctcactgcagcctccacctgccaggttcaggctgagacaggagaatcccgggtagctgggatgacaggcacgcaccaccatgcccagctaattatttatttatttatttatttattattattttcctcaagatggagccttgctctgtcgcccaggctggagtgcaatggtgcgatctcggctcactgcaacctccacctcctgggttcaagcaattctcctgcctcagcctcccgaatagctgggtttacaggcgcgctaccacgcctggctaattttttgtatttttagtagagatggggtttcaccacgttggccaggctggtctcgaactcctgacctcgtgatccgcccgcctcagcctcccaaagtgctgacattacagccatgagtcaccgcgcccggcctattttattttatttttgaggcagagtctcattctgtcacccaggctggagtgcagtggcaccgtctcagctcactgcagcatccgcctcctgagttcaagcaattctcctgcctcggcctcccgagtagctgggaccacaaacccggctatttatttttgtagagacagggtcatgctttgcttctgagtctgaccctctagttttttattatttgaaaggagaggccaggtgcgatggctcacacctgtaatcccagcactttgggaggctaagcagatcacctgaggtcaggagttcaagaccagcttggccaacatggtgaaaccccatctctaataaaaatacaaaaaaaaattagccgggcctggtggcaggcgcctgtaatcccagctacacaggaggctgaggcacgagactcactcgaacgattctgggtgacaagagtgaaactccgtctcaaagaaaaaagagagagagtttgatttttttgcttcctaaaagaccaaaaaagtccttcattgccaaatctgaggaaaaagggtcagcagagcaataccatatttatccattgacataaagtagcgaggcattttctcatatagacctttattttcatgttctggaagatgagttaggaaggcacagcaatattgtttcttcttttttttttaatttgaaacagggtctcactttgtcacccaggctggagtgcagttgcagcctcaacctcctgggctcaagcaatcctcccatctcagcctcccaagtagctgggactacaggcatgcaccaccacaaccggctaatttttgtattttttggtagagatgaggtttcgccatgttgcccaggctggcctcaaactcctgagctcaagtaatccacccgccttgacctcccaaagttctgggattagaggcatgctccactgtgcttggcctgggaaggcacagcaatattgaaaaaaaggaacattgctttctaaggtgagttttaaaaaaaaaaaatgttcagttgtgcacatagattcttgcctgtgccaacaaacccatgaaaaacctgtttctttctggtctgacttagacccatgcctggggtctctctccattatgattcatagcgaatgaatcacacgtttttgtttacgtgtttgttccctaggttagccaggaaattttttctgagcagtcttactcatctttgtatccacatgacctaatgccaggtctagtgtctggaaggtgaagagttgaaaagaatgctggaatgaaagcgttcccctcaggataacctagttttcttattttatttatttatttatttttgagactgagtcttgctctgtcgcccaggctggagtgcagtggcatgatctcagctcactgcaacctccacctccctggttcaagtgactctcctgcctcgcctcctgagtagctgggattacaggcacgcaccaccacacccagctaatttttgtatttttagtagagacggggtttaccatgttggccaggatggtctcaatctcctgaccttgtgatccacccgcctcgacctcccaaaatgctgggattacaggcgtgagctaccatgcctggtcaggataacctagttttcttactgtcaggcctgagtctccgctggcttaatgatgacgtttaaatttccttttctgtcctttcagttgcagggtataagtgtttatctcagaatgtcccaggggcagaaactaactttctctgttttgatgatgttgtctgttttttgtttgtttgttttttgagacaaagtcttactctgttgcaggttggagtacagtggcacgatcatgcctcactgcagtctcaaccccctgagctcaggtgatccttttgcctcagcctctccagtagctgggactacaggcacacaccaccacgcctggctaatctttaaatttttagtagtgacagagttttgtcatgttgcccaggctggtctggaactcctgggctcaagagatccaccacctcagcctcccaaaacactgggattacaggcgtgagccactggaccagccagagaataaccttctctgaaccctcctacttatcctcatacagatagtccccgattatgatggtgtgactacaatttttgactttacgatggtatgaaagtgatatgtgttcagtaggaattgtacttttaaaaattgttttaagacagattcttggccggacacggtggctcatgcctgtaatcccagcactttgggaggctgaggtgggtggatcacgaggtcaagagatagagaccatcctggctaacatggtgaaaccccgtctctactaaaagtacaaaaaattagccaggtgtggtggcacacacctgtactcccagctactcaggaggctgaggcagaagaatcgcttgaacccgggagacagaggttgcagtgagccgagatcacgccactgcactccagcctgggagacagagcaagactccatctcaaaaaaaaaaaaaaaggcagagtcttgttctattacctacattagagtgcattggcatgatatcggctcactgcaacctccgcctctcaggctcaagcaatcctcccacctcagtctctcaagtagctgggattacaggtgtgcgccaccacgcccagcctagaaattgtacattgaattgtgaattttgatctgtttctgggccagcgatacgaggtacatgctctcgagatgctcagcagggacagtgagctgcagctcccatttagccccacaaacatgaggacaaatggccagtcacaagcttgtccaacccgagaccctcaggccacatgcactctggacagctttgaatgaggcccaatacaagtccgtaaacttccttaaaacattatgaaatttctttcttttttttttttttttaagctcagctggagtgcaatggcacaatctcggctcactgcaacctctgcctcccaggttcaagtgattctcctgcctcagcctcctgagtagctgggattacaggcacgcgcaaccacacccagctaattttgtatttttagtagaaatggtgtttctctatattggtcaggctggtctcgaactcccaagctcaggtgatccgcccacctcgtcctcccaaagtgttgggattacaggcgtgagccaccacacccagccagtgttagtgtattttatgtgtagtccaagacaattcttcttccagtgtggcccagggaagccagaagattggacagcccactatagagtctatagtgtgctgtgttgccaggtggttttgtccaactgtaggctaatgtaagtgttctgagcacatttaaggtagggaaggctaagctataatgttcagtaggttaggtgtactaaatactttttttttttttttttttttgagttggagtgttgctctatcgcccaggctggagtgcagtggtgcaatctctgctcactacagcctctgcctcccaggttcaagccattctcctgcctcagcctcttgagtagctgggattataggcgtgtgccaccacacccagctaatttgtatttttagtagagatggggtttcaccatgttggccaggctggtctcaaactcctgacctcaagtgatctgcccgcctcagcctcccaaagtgctggaattacaggcgtgagccactgcacctggccctaaatgcatttttgacttaagatattttctatgtatggtggatttattgggacatacttcattttaagtcaaggaacatttgtattaaacagtattgctggtatttcttgtcccaatattaccgaacagggagtggatgtgactttttttcttttttttaaaaagcaaaaacaaaaaacttttaacagatagggcctcacctctgtggcccaggctggagtgtctatgggctgaagtacagtggcgcgatcaccactcactgtaactttgagctcctgggctcaagcaatcttcctgcctcagcttcccgagtagctgggaccacaggcacatgctaccacacctggctaatttttattttttgtagagatgaggtctatgttgcccaggctggtcttgaactcctggcctcaggcaatcctcctgcctcaacctcccaaagcattgggattacagatgtgagccactgcatctggcaactttttcttacactgaacaagccagtattggggccggggtctcagacactgtgactgatgctgtttatttacctgtttgcatccagcattgctgacaaggcaagagtaagtaactgctgctcactgacatttgggtatgcacagcaaagggctccatgtaatctgatggttatgcccatgaaagctcattaagagagctcagatactaggcccagaggatcagggcttcttaggtgtgcagggacacttggtgaaaatggttgtatcagttagctattgctatataacaagccatccccaaacagtaactaaacagcagcgatttgttattgttctccatcttttgggttcgttgggttctttgtagatcttgctgagcttactcatatggctgcatacagtgtacagctggactgtcctggggtggaagctccaagatggtcttacccatacatctggggcattgctggggacagctggaagcctgggagttccctctatcctcttggtctcccaacattctgatcactcagtagtctagcttgagttttatttacatggtagtttccaaggccacttaaggcctaggctcagaagtcccataacatcacttaccaagtattctgtcggtcaaagcaagtcacagggccagcccagattcagggagaggggaaatacatgcctgttgttgttgttgttgttgttgttgttgttttgagatggagtctctctctgttgcctgagtagctgggattacaagcatgcaccaccatgcccagctaatttttgtatttttagtagagacagggttttaccatgttgcccatgctggtcttgaactcctgagctcaagtgatccgcccgcctcggcctcccaaagtgctgggattacaggcgtgagccatcgcgcctggccttttttgtttgcttgtttgtttgacagaatctggctctgtcgcccaggccagagtgcagtggcacgatctcagctcactgcaacctccgcctcccaggttcaagtgattcttttgcctcagcctcccaagtagctgggattacaggcacctgccaccacgcccggctaatttttgtatttttagtagaggcgggggtctcaccatgttggccaggctggtctcgaacttctaacctcaggcgatctgcctgccttggcctcccaaatcactgggattacaggcatgatccaccacacctggcaggaaatatatgccttttaatgagagaagctacatgtgcaaacaggaatgggaggagtggtaggagccacattttcgaataatcctccacaagggccagacctcaaagaatgggtcttagagggaacgtgctgcctgtcctgatgtgtggccagcagagccaggaccaggtgcagaagccgactggaatcacaaccctgtgaatcagggttaaagaacaaaggacaccttcctaaaggtactgactcatagatcccataccctgttctcacggccttatgttcacttccacaaagcaaaccacacaaggtcgggtgcagtagctcatgcctgtaatcccagcactgtgggaagccaaggcaggtggattgcttgaggccaggagttggagaccagcttgggcaacatagtgagaccctgtctttacaaaaaaattttaaaactagccaggtgtagcagcatgcacctctagtcctagttacttgggaagctgaggcaggaggatctctggagcccaggaatttgaggttacggtgagctatgatcacgccactgcacttcagcctgtgtaatagagtgagaccctgtctcagaagaaaaaaaaaaagcaaaccacacaggtggccatgatgctggaccgctaagcaatctattcctctttgtgttgagccttcattgcaggccatcacccaaaccatctcctcttccccctccaagtgtcctgcaggccaggctttgggaacactcttcagaggagcccacacctgccctgccctacccagcactaccatgtgaatatccttaattttctgtagtacttgcaataggatggactcatgtgtctgtgcccagcagtacaaaaccaggcaggaatgagaatagcagagggtacagtcgggctcagtactccctttggtttggaagtggacagtgtggaggtctcttgccttaaggagcatgtgtgtgagtgtgtggtgtaaacagatttctctcttctgcccttctgaacacaagggtagagtgggcctgccttagtttactatggctgccataacaaaataccacagattgggtgctttaaacaaaatgaattatctcctagttctggaggctggaagtccaagatcaaagtgccagcagggctgggttctgaggcccttctccttggcttgcagatggccaccttctccctgtatctgcacatgggccttcctctgtctgcatccaaatctcttctcataaggaccccagtcagactggattagggccccaccctaacagcctcattttaatttaatcatccccttgaagactttatctccaaatacagttgcattccgaggtactggggttgggcttcaacataagagttttgggggcaggccgagcatggtggctcatgcctgtaatcccagcactttgggaggtcaaggcgggcagatcgcttgaggtcaggagttcaagaccagcctggccaacatggcaaaactctgtctctactgaaaatacaaaaaattacccaggcgtggtggcaggtgcctataatctcagctaccaggaggaggctgaggcaggagaatctctggaaccagggaggcggaggctgcagtgagttaagatcatgccactgaactctagtctgggtgacagagtgagaccccatctcacacacacgaaaaaaagtttttgggagagatgctattcaactattcagctcataacagggccattcccctttccaactgggacagcaatcactactgtttgtaatgggaggcatttcagaaggtcattccctattggtaatgaatttcagggacagcttcacccatagggtgcatttgaagtgtttgggaggaggttaaggaaggggaggagcttggccagcaatcagaataattagctcagctattttgttctgaaagtctctgtcaaagccaattttcttttcttttcttttctttttctttttttttttttttgagatggagtcttgctctgttgcccaggctggagtgcagtggtgcgatcttggctcactgcaacctctgcctcctggattcaagcgattctcctgcctcagcctcctgagtagctgggaccacccggctagtttttgtatttttagtagagacagagtttcaacacgttggcatgctggtctcaaactcctgacctcaggcgatccacctgcctcggcctcccaaagtgctgggataacaggtgtgagctatcacacctggcctgaagccaattttcaaagaaactgacctattccctcccatgccagggcctcagagggagaggctgccgatcgtccccatctggtatccagcagcttcataagacccctggcccctgagaaatgttgggatcttggttctctttgtggaggtcagcggttgcggggcagaggtaaagaaaagtcttggactgagtgtgctctgcatctctcaccaggatttccaccccggcagttctgtcctgcttgttaaatagaccatccagccagaaaagccacccagacacatgtgattcctccctggactgtgtggcgaggagggagggaagaccgagattctggcatgtcggcgtatttacctccaggttaacagggagctgcctcagagctggagttcagattgtccagggtgttttgctcactggctgttggcttggatctgagcagaagcatttggacctcccccaccccggccctgttgtgaaatgctctccctctccctggaatgggaacagcagttctaggaattccatcctcgtactctcactaagcctcacgtccccacatccaatggaagaatgcttctgccaaaggaaccccaggggaaagtgagggccatgcgcggctcagtttacagaagtcctatccagccgcagagtatgggcactggagggctatggggaagcgctcaaggcagggaacatcctgttctgacaagcacccagaagtctaagacctcctaatttttccagctgagagtgttagctaaggggtggtagcctggtctgccttactaattttattttattttgtagagacagggtctcactctatcacccaggctagagtacagtagcatgatcccagctcactgcagcctcaaactcctgggctaaagcgatcctcctgcctcagcctctggagtagctgggatcataggcgcacgccatcatgccaggctactttttaaattttttgtagagatgggggtctcactgtgttgcccaggctggtctcaaactcctggcctcaagcaattctcatgccttggcctcccaaagcattgtgattgcaggcatgatccagccttgctaattttaaacagtaggaggcatttaggattggagtcgaggtgggttaggttggcctctggacggctgtgaggggacagcctttctgggcctcagtttcctcttctgcaaggtgaagctcctgcgtggggagttgtaagggggaataagacctagcacgtcaggctgtgagcacagaccggaggggatgacagatggcaacgattgctgtatgcacctcgcccgaaaatctaagccttcattcatgcagcactccaatgctccttggcctccaaaaatgcttcctgttcccggcttgtgacatctttctttggttgcgtatgttctcccaagtgattttctctttaacagcaattatgtgagtgtcactttattctcacacaaagaatcttgatgttctttattttatttaatcttcacgatactcctctgaggtgtggattttgttattccctccctcttataactgaggaatgaaagtgcaacttggagttcagggactgacatgtggcaagctcaggtttgagcccagaacatctgcctccaagcactatgctatttgtacattaagtacctgccaacaaggagatcctaaaaataaatggcacgtgcctggtgctttcaaaatagtttgaatgagcctagtacaatgccgttgttttacaggtgaggaaactagaacctaagggaatgtctctatggctttatttattgtaatcccagaactttgggaggccgaggtggggggattgcttgagcccacaagttcaagaccagtcaaggcaacatgacaaaaccttgtctacaaaaaaaaaaaaaaaattagctgggcatggtggtgcatgcctgtagtcccagctacttgggaggctgaggcaagaggctcacttgagcccaggaggcagaagttgcagtaagccaagatcacactattgttctccagcctgggcagcagaccgagactctatctcaaaaaataataataatgataattaattaatagaaatatttccttactttttttagagacagatcttgttctgtctcccagactaccgtgcagtggtaaaattgtagttccctacaaccttgaattctgggttcaagccatcctcctgcctcagcctcctaagtagctgggactgcagacatgcaccacaacacctgactaattttttttttgtttgtttgagacagagtcttgctctgtcacccaagctggagtgcaatggtgcgattttggctcactgcaacctctgcctgggttcaagcaatcctcctgcctcagcctcccaagtagctgggattacaggcgtctgccaccacgcccagctaatttttgtatgtttaatagagacagggtttcaccatgttggtcaggctggtctcaaactcctgacctcaagtgatccacctgccttggcctcccagtgtgctgggattacaggcgtgagcttccccacccggcctacacctggctaatttttaacttcttttgtagagatgggatcgtgctttgttacccatgctggtcttgaacccccccattgctttatatattgaaagcaaactactgtcaccacaaagcatgccttgaaaaaaaaatatcattcctatatttggtgcacatttggagtttaaaatcctgaaggatactggctaacaaacatgctgaagtttatgatggttcttggtttccgtgggcctaaaaaggagggaggacaccctcaccctgtcccttccaagtgtctctcctgagttgcttacctgtcctctgatttatccctgctttgactgataattggttgctggtatggatggaactgaataaatggtgaaattatgtcacctggaccctgcaggtcatgataataactagaattgtatggggcttacattgtgtcagccactgttcaaatccacacagtaatcctatgaagttggcactaccatcatcatcatcatcattgtcgtcgccaatctggagaagcagaaactgaggcacaaagattttaagtcataacttgcccagagtcatgagagctagcaaatggaatgacagagctgggtttccaaaggatttcaggtagaatgagcctcagttattgtccccagatagttcaagaccgaaccttgaactctacccccagcacacaacgggctggatcccagctacacaaatggtttgaggtgtaggggtgctcctctcttcttcccttgccctgctgggaggcagggttctgggtttccctgctctgcatctctgggttggcaatcaaggtcagccttagctcacctccctcacccctcgggcactggagaactggggtgagatggatgtttctctgggccgggggtttagggtcaggctgcttggaagcaggaagatggaggacttgggatctgtgtcccttggtgatctcctcttacgcctgtctgtggacttcacacacttggctgtaatcacttgtttacgggtctttctcgactaaattacataaggtttggatctaggcactttcactacatctgacttttttaaatccctagcacctcgcatggtgctagtacaaagtagaggttcagtgagtaagtaaatgagaccagcacacctactttcaggaaaaaaggattgagcaaagaccggcaaatatgtgggtaaggattaacatttttgtccctggattgcagtagtctctatacttgaatacagttcatgggagttaaggtgtagtgtagggttttgggttttgttttttttttttttttgagacagagtctcactctcttgcccagggtggaatgcagtgatgcgatctcaactcactgcaacatctgcctcccaggttcaagcagttttcctgcctcagcctcccaagtagctgggattacaggcacatgccaccacgcccagctaatttttgtatttttagtaaagacagggttttgccatgttggccaggctggtctcgaactcctgacctcaggtgatccacccaccttggcctcccaaagcactgagattacaggcatgagccactgcgcccagcctgaatcacttttttgataaatgaggttttttttatttctgtattttctctcttcctctcccctcattgtcccaataaaattacatttcaaagttttaaaaatccagccaggtgcagtggcacacacctgtaatcccagctcctcaggaggctgaggcgggaggatcacttgagcccagaagtttgagtctagcctgggcaacatagcaagattctgtctttaaggaaaacaaaaaacaaaaacaggctgggtgcagtggatcacttgagcccaggagttccagcccaccctaggcaacatggtaaaaccctgtctctacaaaaaagtatatacaaaaattagctgggtgtggtgacacttgcctgtagtcccagctactcaggaagctgaggtgggaggatcacctgagcccaggaggtccaaggttgcagtgagccatgatggcaccactgcactccagcctgagtgacagagcaagaccctgtttcaaaaaaaaaaaaatttaaactaaaattaaaagtaaacatttgttgtttttattatgatgattcttgagccaagtactatctataataatagcatttccacttttatatatatatattttttaaaaaaagcagagttaataattgctttgttttaaaaatgtgcttagttttcatttaggttttcccaaaccttccagaagctctctaaaatgcctcacagtaaggtcttgcacacagttggacttctagatttatctgcccattttttccctctctcctaaactaagacaagatttggagtaacagtttggctgctccagccctgccacacaactgtcaatgtggggttccctgaagccctagtctttctataattttggcagaacacatcttactgtattctttctgaaatgtctctatggccaggtgcagtggctcacacctgtaatcccagcactttgggaggctgaggcaggaggatcatttgaaaccaggggtttgagaccagcctgggtaacatagcgagaccctgtctccaaaaataaaatttgatttaatttaaagaaaaaagagaggccgggtacggtggctcatgcctgtaatccctgcactttgggaggccgagacgggtggatcacctgaggtcaggaattcaagaccagcctcgacatgtagaaaccccatctctactaaaaatacaaaattagccgggcttggtggtgcaggcctgtaatcccagctactcgggaggctgaggcaggagaattgcttgaatctgggaggcggaggttgcagtgagccgagattgcgccattgcactccatcctgggcaacaagagcgaaactccgtctcaaaaaaaaaaaaaagaaaagaaaagaaaaaagagaagtatctctgttatacttttacttgatttgtgtttggcaggggataagatgcaggttgaagtgaattttctgtcagattgtgaaggcgtcaaggcaccgtttgcaggcttccagtcttgccatttaagacattttacgcccttctcattccctgtccttgtgtatacctgaaaatcctataaaggattttctctttatcgccagtattgtgaatttcacaatgatgttaactgagtgttttgaattcattgcactacttactgaaaggggagcttcaatttcaagacatctctttcaattcaggaaaatttccgtcttctttttttttttttttttcttgagacaggttctcgctctgtcccccaggccggagtgcagtagcgtgatctcaactcactgcaacctccaccttgtgggtttaagcaatcctcctgcctcagcctcccgagtagctgggattatagacacacaccaccatgcctggctaatttttgtatttttagtagagatgggttttcaccatgttgtctaggctggtcttaaactcttgatctcaagtgatctacccacctcggcctcccaaagtgctgggattacaggcgtgagccaccacacctggcctttcttcatatttttaaagtaaattcccttttattagtttctcttttctccttctggacttcctgccatccaatattggacccctaatttattatctttttgcctattgttcatctctttgtcctttttcttttttctttttttttttgagatggaatgtttctctgtccccaggcccggagtgcagtggcacaatctcggctcactgcagcctccgcctcctgggttcaagcggttctcgtgcctcagcctcctgaatagctggactacaggtgtgcaccaccacacccagctaatgttttgtatttttagtagagacggggtttcaccatgttggccaggctggtcttgaactcctgatctcatgtgatccacccgcctcagcctcccaaagtgttggggttgtatacgtgaaccactgcacccggcctcttttgtttttctttaagattttctgcttcctttattacctgtttcctcctgttgatttgcttagatctcgccttaaatgctacaagcctttctcagaaatgtgtgggaacatttgactggttggttttttaaattttttaaaatttagtttttgacacagggtttcactctgtcaatcaaactggagtatagtggtgcagtcttagctcactgcagccttggacctcctgggctctggtgatcctcccacctctgcctcctgggtagctggaactacagacgtgtgccaccacgcttggctaatttttgtcttttttgtaaagacagggttttaccgtgttgctcaggctggtctcaaactcctgggctcaagcaatccgcctgcctcggtcttttctttctttctttcttttttgaaagacagggtctcgctctttcgctcaggctacggtgcaatgtcatgattatagctcactgcagcctcaacttcctaggctcaactgatcctcccacctcagccttccagagtgttgggattacttacaggtgtgaaccactgcaccgggcctggctgtttttatttaagggtggggaactcaggagctgaccaggagtcccttgtgtggcccagagactgatgggttccatctggtggctagctggttttattcactgtggacccccatgccacaatcagtttctgtaggtctttatcttcactctttattctgaagcaggggagaggagagggcttaaggctcaccattcaggaggtcaactttaatttctctgtcacccctctccttggggcaagggacacctggcacccctctggtaagtttgcttaagagagtaaacctcagggcagctgctagatgctggtaagaacctggggtttccattttccatacagacttccaagcagtctccctgttatcagcccccatccccagattccatgctgtgcctaattcctgaaccttcctggggttctctggggcaaacggagaacttgctccacccccacctccctgcatttcagtgtcacccgcttcctccccatgagatcgttgaccgctcctgtacttgcctctgtctttacctgttgtgatttggggtgacagttggagctctccctgcatccaggttggagaacgtgcttgtacttctcattcttggtgtttggcatgacttttgagaggagtaggagaaaaatgtcatggctctgccatcttgaagtcactttgatcctcaaaagtacttcatactctttgtagtgacctagtggaggtgggtcatttaccccagtgtacagaggggtccaagacaggcctgctgatgacataggacctcagttaaagaggttttgttttccttttatttatatttttttttatttttttgtgacagagtcgtgctctgtctcccaggctggagtgcagtggcacgatctcggctcactgcaacccccgcctcccaggttcaagtgattctcctgcctcagcctcctgagtagctaggattaggtgtgtgccaccatgcccggctaatttttgtgtttttaatagaggcgggatttcgccatgttggccaggctggtctcgaactcctgacctcaggtgatctgcctgcctcggcctcccaaagtgctgggattacaggcgtgagccactgcgcccagcctgttttacttttaaagatgaggtctcgctgtgttggccaagctggtctggaactcccagcctcaagtgatcctccaaccttggcctcccaaactgttgggatttacagatgtgagtcactgcgcccagccgtagcccccacctttggctaaagagttttatgtggaggccaccctagcgtgatgccactccacctgctgaacacacacacaggtttctgtcagaccacacctgaccagcagccctgaagggaccttggcatccatcccacccactcgtgtttccatttcctgaccttgtacatgggccaagtgtccccagcaccaagtagctctgcagcaggtgtcttcagccaggctttaaggtttgtctttttttttttttagacagggtctcgctctgtctcccagactggagtccaatggtgcaaccactgctcaccacagcctcaatctctcaggctcaagcgatcctcccatctcagcctcccgcgtagctaggactccaagcgcatgccaccatgcctggttaattttttaaaaattttagtaggccaggtgcagtggctcatgcctgtaatcccagcactttgggaggccgaggcaggcggatcacctgaggtcaggaactcaagacctgcctggccaacatggcaaaaccctgtctccactgaaactacaaaaattagccaggcatctgtaatcccagctacttgggaggctgaggcaaggagaattgcttgaacccaggaggcagaggttacagtgagccgagatcgcaccactgcactccagcctgggcaacagaatgagactccatctcaaaaaaaaaaaaaaaattgtagataaggtcttgcaatgttgcccaggctggtctcaaactcctgggctcaagtgatcctcccacctcagcctcccaaagtgctgggattgcaggtgcgagccacctcacccagccttcggctgactttctgcatgctgctgtttactcctcacagacccctccccaactgaaatctctgcttttattaggtaaaattaggattcttatttttaagtaactgtggtagccatagaacaaagggcacagaggctttttctttcacttttaagtataattaatgatttaattttttttgagacagagtcttgcttgctctgttgcccaggctggagtgtagtggcatgatcttggctcactgcaacctccgcctcccaggttcaacaattctcctgcttcaacctcccaagtagctgggattacaggggtgtgccaccacgcccagctaatttttgtatttttagtagagacagggtttcaccgtgttgaccaggctggtcttgaactcctgacctcaggtgatctgcctgcctctgcctcccaaagtgctaggattacaagcatgagccactgtacctggcctgtttttttgttttgttttgttttgagacagggtcttgttctgtcgcccaggctggagggcagcggcgcgatctcagctcactggagcgcagtggcgccatctcagctcactgcagcctctgcctcccaggttcaagcgattctcctgcctcagtccagagtagctgggattacaggtgtgtgccaccacgcctggctaatttttgtatttttggtagagacggggtttcaccatgctggccaggctggtgaaagcaagatcttcaagaagtatttgtattcccatgttcatagcagcatgattcacaataactgagaagtggaagcaacccaggtgtccatcagtcagaggaaaggataagcaaaatgcgcgcacactctcaatgggatattattcagccttcagcaggaaggaaatcctatcacatgctacagtgtggagggaccttgaggacattatgctaagtgaaataagccggtcatgaaaaagcaaatcctgtatgatttcactatataagatacctagagtagtcaaattcagagagacagaaagtagaaccctgcttgccagggcctagagggagtggggaaggggagttgttgtagagtttcagtttcacatgatgaaaacgttttggagatgattggcggtgatggtagcacaacaccctaccgaaaatgtttaagatggtcaatgttatgtgtatttcaccacaatttttaaaaagtcaccaggggctgatgacctttaaagaggctctccagatggttgctggcccctgggcgcttctttgagactgttgaatctttaactcttaggtttcacgctatgataaacaaaccaacaacaacaaaaaaagtgtggctcatgtctgtaaccccagcacttcgggaggctgaggccagtggatcacttgaggtcaggagttcaagaccagcttggccaacatggtgaaaccctgtctctaccaaaaaatacaaaaattagccgggcgtgatagcacatgcctgttgtcccagctactggggaggctgaggcgggaggattgctagaacccaggaggcagagattgcagtgagccaagattgtgccactgcattccagcctgggtgacagagcaagactccatctcaaaacaaacaaacaaaaagcaaagttggggggaaacaagaaggggggcactcttgccgagtctcaaagattaagaaacaacagaaaaaaagtggtcccatctggagccaggatgtccagccacttgtccactgagtccccaccccgctgcctggaccctggggtctctgggcttccctcccctctggggaggagagattgtacaaccccaagccttgcagagtggagcagtgccacatctggcctctagaaccaaaacaaatctgggtcactttttaaaaaaaagagttagaaattggtcttcccttacctcccctcactgtcaccccagccctgcaaagagagggcaccactgctctccatttgtaatctgggctcataggcactcagacctagaaggtgcatgggtctttattttacagatgaggagatggaggcccaaaacagggggtgcaaggagcaaggtgcatagggtcacacagctgactgggaacggagcccaaatgcaccctggttctttacacccctcctcctaagaaacagctgtgcgctggagtcccataggcaatgagcagggctgtcagcttcagtatcactgcctctcctgcaaggggacaggagagtaagaccagtgactgcctggaggggccacagccagactagaggaacacagccagcaggtgaagtttatctttaggtatctctctgcattcctctgcccttcagcatctcacgtcatcctcagcacagagccccgtttcaggaactcacactcagactccgagatggaaattggttcctttccaggggtttacagagtccagtgctgagcatcaagaaatgaatctcaatatgtacaactattatggatccataaaaattaaaaatcaaaaaagtaaaataaagtgtaagaaatgaatctcagctgttggaatgctactcatcatagcccctaagtgaaggagagatttcaaggttattgctaaggaagggcattcctgaagtccttaaatcatgattcccaaacttgggttattcatattttatctgcacaattattaccataccttgcattccacttgtacagatatttaatatttctttatatcaccttagcttttgaatttaatttacattattttattatagaatctataatatattattatattattgtatattaaaaggaattgctatcactactatatatggaacaccggattcacttgccataaatagaaggtagctataaaaagatacaaaggggccgggcacggtggctcacacctgtaatcccagcactttgggaggccgaggcaggcagatcacgaggtcaagagtttgagaccagcctggccaacatggtgaaatcccgtctctactaaagatacaaaaaattagctgggcatggtggcacgcacctataatcccagctacttgggatggtggggtagaattccaaggtcagtgacacactggcaggacacactgggggcctcacaaaggaggggctcagcaggagagcccacccttcactcctgcctctggctcttctccgcaaagcccaggcatttctctcttttttttttggaactgtctttttgagatagggtctcactgcagcctggacctcctgggctcaagcaatcctcccgtctcagcttcccgagtagctgggactacaggcacgtacccatcatgcccgactcattttaacatttttgtagagatgaggtctctctaagttgtccaggctagtctcaagctcctgggctcaagcagtcctcccacggtggcctcccaaagtgctgagattacaggtgtgagctaccacacctggcaaaagttcttatttttactactctggttgaatcacaagtattttctgtttggtcatttgtaaaatgcagctattctgggtatcccacaggagtgctgtaaggacaggactgaataatgactagaaatgcattttttccaccgtggtatgtgattgtcatgggtaattaacactaagcccaggtgggtgagtgagctgaggggctatagggacagagcacagtgtgcacagagctctgggaagacacaggtgcagttggtggcctgcagaccccttccattggatcattccatgtgaaggggagttggggccgtttggaggtagcagagttctgggtggcagccaggcccccaaataagcctcactactctggcttttttttttttttttttatgaaaaggagtctcgctctgttacccaggctggtgtacagtggtgcaatcggctcactgcaacctctgcctcccaggttcaagtgattctcctgccccagcctcctgagtagctgggattacaggctaccaccaccacgctggctaatttttgtatttttagtagagacggggtttcaccatgttagccaggctggtctcgaactcctgacctcaggtgatccacccatgttggtctcccaaagtgctgggattatgggcatgagccaccgcacccagcctcctctgggtttttcaggagaatctgctgcctctactgcagccacgcctttaaaaagtggaaaaaccggcaggcaagaggctgcagatggcttgaccaacctccctgttcccttctaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgagtgtcggggcttggccaggctctaccttgggaaagggaatgtatgaggctcctggagtccatccactgggggcaattccagggaggaggaacaacagggactctgccctaccctctaaggagcagctcagagcccagagggtgagagtaggggtggggaggttgaactcttcattggtagcaactttccccctgaaaggggcccaggcacctcaggaaaggtgatctggcacctttgggtcatgtaattagcggggagtttgtttgaaatggcagcggctgcacacagcaactttcgtaagcatgtgcctctgtataattgtctctgaagcatttccacttggaacacacccatgatgtttgtggtgcaagagacaagttatcaaagacacagtgtacttgtcctttgggaaattatatgtctacaagataagaaatacatccgggatgcctcctgttgggctgttggtcccctagtggatcttcatgaaggcaggtagaaacaatgcagccagttgtctctgccgatttgacatttggtagctgggtccttcctgctgtccccacctcccgagtaattagagcagccactgtggtagtggtgtaagtgaatgcactctttgtggcatcctgactggcttggcagagtgttggagttctctgctgcaagatgatgcagcataagcacttccgggcaactataatcagattggaacccgccgacccttcacccggaaggccgtaccccaggcccagacaggaagcagcagggacctcagcttggctggctctgctaacagcagcagaattaatctccccagggcctgcaggacatgattcataattaccttgggaacctcacagtacaagacagacaatagttgcctgtgtcttagtctgtttttttatggctgtaactgaatacctgagactgggtaatttatgaagaaaaatggtttatttcttacagttctagaggctgggaaggccaagggcatggtgcccgcatctgctgggcttctggtgagggcctcctgctgcatcataacatggcggaaggcatcacagggcaagaggggcacatgagagagaaccaagctgcctttttataacactcttgtgataactagcccactcctgtggtaacccattaatccaggaatgggctaatccattcatgaggacagagccttcatgacccaattacctcttaacggccccaactcttaatactgttacattggggattaagtttctgtatgaatttcaaaccatagcattccagccctggaccccccaaactcatgtccttctcatatacacatatattaatttggtccccatatccccaaagacttaacacgttgcagtcctagctcaaaagttcaaagtccagaatttcatctgaatcagacaagactcacagcatgattcatctcaagcttaatttccttccagctgtgagcctgtgaaactaaacaagttatctactttcaaaaaataggggctgtccctggcccctaaaaacatcagctggtggccaggcacagtggctcatgcctgaaatcccagcactctgggaggctgaggcaggatgaatacttgaggccagaagttcaataccagcctgggcaacaatgcaagaccccatctctacataaaattttaaaattagccaggcatggtggtgcatgcctgtaatcccaactacttgggaggctgaggccagaggatcatttgagcccaggaggtcaaggctgcagtgagctatgattgcgtaactgcacgccagcctggccaagagagtgagaccctgtctctaaagaaaaaagcaaaaacaacaagagtcagacgaaatgatatagtctggatatttgtccctgcccaaatctcatgttaaattgtaatccccagtgttggaggtagggcctggtgggaggtgtttgggtcgtggggacagatccctcacagcttggtgctgtcctcatgatagtgaatgagttctctcgagatctggttgttgtaaagtgtgggagcgccactccaccctctctcttgctcctgcttcctccatgtgacatgcctgctcccgctttgctttccaccatgacgaaaagccccctgaggcctccccagaagccaagctgaggccggcgtcatgcttgtacagcctgcagaaccgcgagccagttaaacctcttttcttggctgggcacggtggctcgcacctgtaatcccagcactttgggaggctgaggagggtggatcatctgagatcaggagttcgagaccagcctggccaacatggcaaaaccccgggtctactaaaaatacaaaaattagctgggtgtggtggtgggtgcctataatcccagctactcttttgggaggcttaggtaggagaatcgcttgaacccaggaggcggaggttgcagtgagccgaaattgggccactgcactccagcctcggagacagagtgagactccatctcaaaaaaaaaaaacaaaaaaacaaaaaaaaacttattttctttataaattacccaacctcaggtatttctttatagcaatgaaagaatggcctcatataccaagcattcacccattgttgacctggccctctgtcccctctctccccaggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagg

SEQ ID NO: 38674 - DNA, 29784 bp, Homo sapiens
acttatccagaagaaaggcagagggcgcacactgcgcagcgcggatgggaaagttaactgaattatttgcgggaagacagaggaggtggggggtcccccaagccccagccattttgtggctcgtaggggttgtcgcttcccaagccgtgaatggcccaaacccgccccccgccccaggtcggactcctgccccgcgcccctctgggtcggaccccaagccgagccccccaaccccgcggctgggctgggcgattggggacgagctccacacatggagaacctggcctcgcctcgcaagaccgcgggacgcgcagatgtgaagtgcgcctgcgcggggcgcagccccagctgcagacgatctgtgagcgacgcgccggcgcaagtcgagggcggtggcttggcttccctggaatgggggacgtcttaggactgcgcctgcgcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgaggtaggtgtcctgatgggcagctcagatggctggactgcacgtaaggaaggacaggccaggtgaggcgtcctcgcactgcgtgtgcgtcgctggcggacagaggcctccgcccccttttgggacctccgagcgccttcgcgatctcagccactttccctggcgtccaaacgggagctcggtccccgtcacacccttccctgcgtgccgcaccccttcccggccactcccgccgtccagcgccttctacggccacgcccaccccaccaccatctctgtcacgcccttcgcggccacgcccacctgcctggcggcccctgccccgaagctcgcggcgctgtcccagcctgaccctctcgtgcccctgcgtccacgcgtggccctctcgcttcctgcccccttctcaccccccttcactggccacctgttccaaccctccatgatcctgttcctcccgagggcatcttaggagggcagggtcctgcgcgcactgcggcctccactccgaccccgtcccagtttggacccaggtcttccaatgaaaatataattatgcaaatcagtaagcatttgtaactacgaatatcacaaaaataagcttcaagtctggatttagaagtgaagcatgcattttaaacaaagaattgctatgcaattttaaaaacacattgatcccagagcagtgtgtggattacactatcactggaaaaatacgaattgagaagaaggaaaagactggaagatgcagaccttggttcctgttagtggaaacactgtaaggtcccaggtagggacttttaattggaattaaagctatcacacttctaagaaattaatgaatactgatttattgccttaagtcgacacctgatctaacagaaactaacaggcttcagcaaatgaacaagattaacaccttgcagactagtgaagaaaacacactatttgaagtttatgatttttaaatgcttttgtctctgtaaagtattgtaaattttcatttctacactaatcttcacacatacacattttacttctatttggtagaggacatcatgcacattagaagttaagtgaactcaattattaagcaatgtaacaagtactttgtgtctccttctctttttaaaagtagaaatggaaaagaaaatgaaataaatcagcagttatgaggcagagcctaagagaactatggcaacatcaggtgactgtcccagaagtgaatcgcaggtaatttccgttccacttcctaaaaatctgtgtttaatgaatgtgagcattacagagagctaagcgtcagctcacagatgtgatggagcttggcttgtgccttggaaggtggccaccggcagtagaatgcttaaatgtgaagattgtgaggcagaggaaacgcagtgcctgtaaggtgacatcctgcattgggcaccataacaattctaaggaaatacttagccccaaaacatcagcatcatttagggttccatttttggtacgtgaactggcaaagcaagcatattttctgagctgttcaataaaatttcaggcataataccagcaatatattgaaggcaagttggacacattagaaaagatttatgtattcatactgtttctgcctggggtactcatgtagtttcgttcaagttagcagtaaaaaatacccctcaaattgtaaagactgttgattatgtaaaagtcaccaactgaataatagatactgtttttaaaaatcaagcatttccgtatctgttatgtcaattttaatgttttctttttttctctttcattccaatgagctttcatttggctttttatatataggaattttatttatagtcagaatctttcgttaatttctttaattattcataaaatgttttaattccgtggacatcttatttttcttttgagaaatttaacaaatattaggacatttccagaatgatattgtaaacatcaagtacattaaacagtgtacattaagctatatatatgtgtgtgtatatacatatatgtgtgtgtgtgtgtgtatatatatatgtatatgtaaaaaatactgtcgggtgtgtctgtagttcagctactcaggaggctgaagcaggagaatcacttggggccgggagtttgaggatgtggtgtattatgattgtgcctgtgaatagccactgcattccagcacggccaataaactgagacttcatctcttaaaaaagaaaaagcgacactctagataaagtttgttccccagtctcagtcctattcctcctcttctctctctagaggcaaacactactgtgaatcatgagtctgttttgtgccactgcaccatttttatacctctatggcttatatagatatacttgaatgacatatgatattgtttgtgtgggctttttagagtttccatagtggtgtcatactgtcagtgtcacctgtagcttgcctcttcatataactttacctttggggaagttgtccttgttatgtgtgtaatgctggttcaatcctgccactgtagggtactcctgtagtgtgttccttctctgaaagtgtaaagtatcctatttgtagatatgtgtatgggcctgttgcagtctcactgctacacagtaggcatataccccattttacttattccctttttgttggacacttaaattgtttctagttttttctatttcaaacaatgctgtagtgaccatccgtctccatgcctctgtgctccagtaatggcattgcagggtgcaagggattgcaagtttcagttttactggataatgatcagttgttccccacaatgactttacgagttcacaggtctgtcagtagcccacaatagtgcttactaacacttgacagtatcagacttttaagttttggtcagtctcatgggttagaaatggtattttgttatttcaattttgctgactggtcatggtagtatttcagtaatacttgtgttcatcctgttaataccaccctccattatagaagagatgtcttataatggtaatttgtgttttatctctttttttcacacttgatcaatcttttcttagggttttatcaattttatttttataaagaaccaattttatctgtgttgatttctctgtttttctatttcattgatttctgcttttgtctttatttcattctgttgtatttgggttaatttttataacatctgagagggaagcttagataattgattttaaacctttctttaatagtctttaaagctatgactttcctctaatcactgctgtagctgtacctcacatatttaaatgcattttcattcttcaaaatattttctaatatattcaatggaaattagaagttttctgggctatttgaaagtatgttgaccaatttctaaacatattggaaattttactttttcttatttaattttgctttgattacattggttagagaacataacatcctctataatttcagtcttttgaaatttattcaggcttgctttatgttctaatcatatggaatatgttggtgagtgttccatgagtacttgcaaagactatgtattctgcagttgttgagtgtagcattctataaatgtcatgaagatcaaatgtgttattagtattgttgaaatctctatatcttttctgattttttttgccatcttctatcagttactaaaaattctccactatgattgtagatatatctatttttccttttggttctatcactttttgctttgtatattttgagtccctgttattgggtgtatatatttagtataggttttgttttctagattaattgaccttattttttataaaacatctgtctttttacctgttaataaatacttcttttcttgcgtgtaccttttttttaatgctaatatagctgtaccagctttttttttttatcattagtgcttacataaagtgtgtgtgtgtgtgtgtttgtgtgtgtgtgtgtgtgtattttttttccctcaacttaagtccttatatttaaagcgtttttctcgtaaagagctagttgggtctagctcttaggtctgtttttttgtttctctgttaaacacaatttctgcctcttaattggagtatttagtctattaacacttcatgttatgacgaatgtgatgaagtgtaacattttgctgtttgttttatgtttgtcacatttctttttcctgcatgtctccattcctgccctcttgtggataaataaaggattttctataattccatattacctcctttaatagcttgttagctgtatctttttatattgttttagtgttttcccaagaaattgcagtatgcatcctaattcaatttcagtcttttttttaactacttcataaggtaaagatcttagaagttagtttcatttaccagcgtccatatttttgtactgttgatgtaacattttaattttacatatgttgtaaacgccacaataaattatcattattgctttacgctatcgagtctttttttatgaagtaaaataaatagtcttttttatgtttccccacatattatttgccttttttgaggtctttccctttttcttgcattctgtgttttcatgtaggatcatttcccttcaacctgacaactttatgtttatatttactagtgtgagtctgctgtgtcaaactatgaaatgtgttttgcctacatttttttttttttttttttttgagacggagtctcgctctgtcgcccaggctggagtgcagtgatgcgatctcggctcactgcaagctccgcctcctgggttcacaccattctcctgcctcagcctcccgagtagctgggactacaggtgaccaccaccacgcccggctaattttttgtatttttagtagagacggggtttcaccatcttggccaggctggtctcaaacttctgatctcaggtgatctgcccaccttggccttgatggttttttttttttaattttggaaaaatctccaccattatctcttcatttatttttttctgcctcatcttctgtcttcttttttggggtctccatgtaaacataagttagaatttttgctgctgtttgacatgtctcatgctctattcttattttttttttcattttgtgcttcagtttggaaaatttctgttgacctgactcttgaggcgctgatcataaacaagataactgggaaaacaatatgtttgtaaaacaatttcttgagatgtgaaatagtatctatattgtaccaagagtagtcccagctacttgagaggctgaggtaggaggattgctttagcttgggaggtggaggttgccatgagccaggatcatgccactgcactctagcctgggtgacagagggtgacctcatctcaaaaaaaaaaaaaaaaagcgtattcttcaaccctggcattctatcctgcagaaataaaatgtcatcacataagcttgtctgtgcacagacttcttttattgcagcatcggttatggtggtagaaaactggataccaagacaaagtctatcaaagggggatggctgaagaatcaagcggaattcctgctatggaatatcgtatagccattgaaggtagtaaatcagggttctaacagttggagagtttttccagaaggtattgtgtaagaaaagcaaagtgcaggtcaggcgtggtggcccacgcctgtgatgccagcactttgggaagctcaggtgggcagatcacttgaagtggggagttcgagaccagcctggccaacatgatgaaaccccatccatttctaccaaaaatgcaaaaattagccgggcgtagtgacacacgcctgtagtcccagcctctcgggaggctgaggcatgcgaattgcttgaactggggaggtggaggttgcagtgagccgagattgtgccactgcactccagcctaggcgacagagcgagactccatcctaaaaaaaaagccaaacaaagaaacagcctgtgtgtgtgtgtgtgtgtgtgtgtgtgtatacgtgtacacagggctttgtgtgtgacatgggcatggtggaggtgtggaaggccgcacaccggggggttagtaagggttgcctgggctgggtggatcggggatggggtggagagcaagcagagggcagtgctgccttagagtgagtcatgctcctggcatagggaaaagcacgaagggtacaaatagacagtaaggtaaaaaaagatgccagcaagtattttaaaaacgcctaaccacacaaagagagggaaatggaagtaacaacagtgatttttacccatgaaattgacagagactaaagtgattggtatctattgagtgagagtgtgggaagattggtggttccctctcagcaagcggtccagggaacacctttctggagagcactgggtggtaaaaccaaaagccacatagtctcagtccatcaggttcacattcagagacttaccctaagaagattaaggtacatacagaatgatttatgttgaaagaagttcatcttaacatgatttagaatagtaaaaactgaaaagtctaaatgtacaagactaggaaactggataggtaagtcctgataattcatagactggatattaaatagtgttagaagtatatttaataagaaaaatgttcagagtttataaagtgaaaaccataggccacaggcttattgtgtgaacccagtgaatgctttgtacttatgttacgtgtccacttttttaaaagtctgaaagtataaacaccaatgtgctgtctgttattatctgtgatcagtgagcaaaattacaggaggttttaattttcttctgtgtacttggtgttttcacacattttctaaagtaaacacgaattacttttatgtttaggaaaatgtgtttaaaatgtatgtattgagacaaggttgattcattgaactggagtgtgtgatctgaggttctgccccctgcagtgatgtcttccaggcaagcttattcttatataaagtgaacggccaggcatggtggctcatgcctgtagtcctagcactttgggaggatgaggcaggtggattgcctgagctgaggatttcgaggccaacctgggcaacatggtgaaaccccatctctactaaaaatacaaaaaattagctgggtgtagtggtgcacacctgttgtcccagctacttgggaggctgaggcatcagaatcacttgaacctgggaggcggcagaggttgccctgagccgagatcatgccattgccctccagcctgggcaacagagcaagactctgtctcaaaaaaaaaaaaaaaaaaaaaatggaggggttgggggaggctccaaggacctgtgtgggtccaagctgggctctgctgcctcgtggaggtttgtgccatgccatcagctctttccacaggcccctggctgtgcctgcctggggcgctgggcccctggctctgtcctcacactggtttctcttcatggggttgatgatcaccttcaggaagcaaagctgatgaaggacaagggctcctcaccaaatagacactagtggtgcctgtttctgacttcttgctttgatgttctcttttagggtccagataatttttttttttagaaaagaaatgtagagtgaaggtgacagcctttgattatagtagtaaagatgatccaaatagtttgtataataaatacttggacacatgaatctgtatttgaaatttgaaaccatcctaataatatagccaaaaaaaaaaaaaaaaagctccagcgtcctctcctcacgctttccttggctttgagcagggagaagagcctgctgagtgcagtgaggccggtctcctgcaggagggagtacagccagaggagtttgtggccatcgcggactacgctgccaccgatgagacccaggtagccacacgtggtggttaatgctttatggctttcagcatgttcagtgtcaaaaggagataaattttgcagacgtcacaccaaagttaaatgaagaggtattcagatgcgtagggccacacaagacctgtgtgtgaagctcacagcccagccagttctgcctcaagcatgatgtaaagatacgaggcatggagtggggaccctcagccaggggcagaagcacctgttctggtttctacttggaatgtagaacccacccagttaatgaaaagtaaggctaccaaatatatcaagctatatctgcttggacatagctttgtttactttgtgacaggaatttcttagagtcagcctccagtaactcagttggcatagttgagttacaatgaagaggctgttgagaaattctctcctaagccatttgaaaatgtttactccttcttttaaaaaatatctgttaagctgtgccctcctttcaggtagatgttccagaggcatcgctaagtcatggtgtcacttgcaaacattctcagttgctgtcattacccactgactcctgtttgaaatctctgtgattttgtcaccattgatgggatttatcactgagccacatttgaaataccaatgactggttttcttattgaattttaacttttttttttccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctggtattgctttctaaattccctgttcagctggccaggcggtgggttctctctagctttagttctactgcaacgttcagagcaggcccatagtcttacaggccagagctcctctgttgtagccactcagctctgacatggttgtgtggaagccactgtggatgacacacaaagtgtgcactgttgtgttccaataaaactttatttatggatcttgaaatttgaatttatactgtacagttttcatgtgtcacaaagtattttcttttgatttaaaaaaatcatttaaaaatgtaaaacccactgttagtttggaggccatccaaaaacaggtggtgggctagatttggcccatggcttagtttgccgacccctggcttagagatatgatttgagcaatgagattatgtgcgtgctccctcagtatttaaaaaaaaagcagtaaattttactttaaaaatgaaattaggctgagtgtggtggctgacacctgtaatccctacactttgggaggccaaggcaagaggacacttggcttgagaccaagtgttcaagaccagcctgacaacatagtgagaaaaaataaaaaatataattcgtctctacaaaaaaaaaattaaaaaaaaatataattagctgggcatggtggtgcacgcctgtagtcccagctactcgagaggctgaagtgggaggattgctcaagccttggaggccaaggctgcagtgagccatgatggcgctgttgcacttcagcctgggctacagagcgagagcctgtctcaaaaaaaaaaaaaatagaaaaaattctataaatctatgaataatactacttaggtcaggtgtggtggctcatgcctgtaatcacaggactttgggaagctgaggtcagagcatcacttgaagccaggagttcaagtctgtggtgagctatgattgcgctactgcactccagcctgggtgattgaaccagactctgtccctaaaaaaataataaaagcccagcttctaaatagcttaccgaaattttttccccaccatggagaaatgcctataacccgatggtccaggcaacaatctctggttacattttaaaactagatgaaaacagttacttgcaggatgaatgttataaaaatgatgttagttgaaagaaggaatagggcaaagaatctataacgtttgactcaattatataaagttaagaggccatattagaaggttttttgtttgtttttgtttttttttttttgagacgtagtcttgctctgtcacccagactggagtgtggtggcaggatcctagttcactgcagcctctgcctcccgggttcaagcaattctcctgccacagcctcctgtgtacctgggactacaggtgcgtgccaccatgcctggctaatttttgtatttttaatgagggggttttgccatgttggccagactggtcttgaactcctggcctcaagtgatcctcctgtctcagcctcccaaagggctgggattacaggcatgaaccattgcgcccggccggaaggtactgtttgtgagtgtgcatgggtgctgagactgactgagggcaggagtggctcccctgttggttgaatggaggttacctgctggtaggggaggctctgggaccagcgtggctgagtcaggagttctgacatgctggcagtgttctggggttggatataggtatagaggtgtttgctatataacaatacttgactaactctgcagatactttttattgcactttttcgcaggtatgccatatttcacaattaaaagtgttaaaaactattcatgtctgtacatggttagtgatttctatccgttaaggaaagatacataatgaaaagccaattccagcctcccacctctgccgcctctcagctcaaagaaccactgcccaccagattcctctgtgcttatgaagtccaagtgacacctaatgtattttacgtttttaatgtatagaaaaggcattgttccaccactcaggtcttcaccttgctcttttcacgtagctgtagtattttgaagatctctcatattggcacctgtcactctttataacagctgcagagcgttgtgttactttaaaagggtcctgttgatatttggacagtggttatttaatagctttttatcatgataaataatgctgtaatggagtcctgtataatcctgttaaatgctgtttagaatttctatagggtaaattcctacggggtgtgtgtgtgtagtgtgtacatgtggtttccttaagtggatcttgccagttcgccctccagaaagatttgctaattatacacttggtctgtttgtgctgctgtaacaaaataccttagactgagtgaattatgaagaacaaagctttgtttctcgcagttctggaggctgggaaggcattggcattggtgtccaagatggcgcctcatggctgtcctcacgtggtgaaggcgggagggctgggagcacctctttcaccacaaaccctttcatagtaacctccaaaggtggcctcttaatgccatcacactgacgattaagtttcagtacatggatttttggagacatttcagaccgtggcatgatggtgtgtgaaagctcatttccctaccacaaatcaaagtgaaaaaggactttgatcttaaaagttaaatatggcatcttttagttttgatttccattttttaagtaagattgattatcttttatgtgtttatgggccttttgtattttttctttttttgtaaactttcatattatttgccccttttgatttttgttgattcgtgtgttaagtaatttagcctgaatttgtgaagttttgtgactttgtgaaattttttcccacgtacaacttttttctttgtatagcctaatatggttttcttttctttgtgacttctttttcttttctttgtgaaaaaccttcctcactataagattataaatacccacacttttgttttcagaactgttatgattctgtgttattttatttttgttttttatgttttttagagatggtgtcacactctgtcgtatgagtggctggagtgcggtggtgcagtcatagtgcactgtatcctcaaactcctgggtttaagggaccttcaccttagcttcccaaagtactgggattacaggggtgaggcaccctgcctggccttctgattctattttaaacaatgagattttaaataataaaaaatctagaaattatttgttgtaaaaaatataatgtaaaattccgccctaatgtatgcccacaaatctccagcgaccccagcctcagttactggacagttcccttcgcgttgatgtgaaacggtgcgtttgtcctgctctggatttcaggggtctgctgtagaattcctgttgtttcactggtctgtttactgcagttcccagtgcttcgtcatttccatcactgcacctttgtaggatctgcaagagctaggtctccagcagttcttttttttttaaagcattttcctcattagccttgggcacttactgttttgaaactaattttattatcattttgttgtgctttctcctttagtaggtactgcatggaatgtttatgttaattttgggagagctgacatctttataacattgactctcagtctctgattacttaagctttgtttaatatctcttagtattttaagataaggacaatatctctttgtcatacatggttgtgcacctttcttgttaaatttgttcctaggtattttttgtgtattattactgttataagggggtgggtgaagtgttctctaaataccaatgagattaacttggttgacagtgatgtccaggccttccatagtcttccataggggtgttggggtcaggggtcatcagctgtggctctgaccctccatctcagtccagacctcagcatggctctaggtcacaggcagtgattctgaatgtgcatttcttccagaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgagtggggtctcgagcgcatcccgggtgtttgtgccgaggctggtgacgtccgaggtggcctctgagtgtgctgacttgtgaccctgagctgttgggggctcaccggtgactccatggtcttgttgagcaccctgcacgtggggctcagggtcggtaaaatagcagtgcgtggagaccgcgtgctagaggccgtggcgcccgcgtacaatgagtcgcagacagcacagacgggagtagggcagaatagacaatatcccgtgaattgcgtggggcggggtatgttctgtgagacgtttatttcagttgagtagagaaacacgtgcacccacatgtctgtgctgggccttgggtgtggttggtctcatggggttgggagggatgcacacgctgggccccctccccacccctcttaggccgtctatactgtgctgagctgagccgagctgcagccttggagactccttacacagtgggtggggtcgcagcacagtgtccacccaagtccaggctctgcaggacccaggacccagcgcttgggtgcttcccaccagacccttccctgagaacctgggtttgaaattgtctgacaggcctcagatgtggcacagaccagcattgtcacttgggtgctaagaagttgctgtgctggtcatggattaagattgctgtgcgtgtggcagccggctcgggcatgcgagtcttccatccacttgcagccctgcgtctgtgtcttgtccgggaggtgggggcagttgggagggttagaggcggctcctttctgggtgcccctggaggggcaggtgtggccagtcctcgctgcctctgctgtctggaatgctgcttccctcttgtgtcattgaccatttctcgtgatgctggttgtgactcaggagagtagatgacgggccgtgtgccggccggatgtacgctgacggtgcctctgctgctgcaggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctggtgagggcgggcgtgcgggcagctgggggccggagctggggggcttctgagcacgggctcggctgggccaacctcaggatctcaagggtcgtgcgtgattcattttgatgttttccctaatgtgaggtctaattaatttcttgtgtggacattggctcagtgtcttgaattttcacctgatttaaaaaatgcctttatgagaaatttaagtcaaagttcatgtaacattttcatgagtgatttacatgaactgtgttctcctcggggatctgtaaaaatcctgtgcctaacaggtaaggctgtttctttaatgccagtagggccttcgtccctggccagggtctcctcgccttagactggccccagtgatgctgtgaagccacttgggcatctgtagggccagcatatgcctgtcctgtcagggttgctcaccctgagtttcacatgtgggtggaagtggactgttttctggttgcctgtgaatatgccctgcacaaacgctgtctgcttggagggaagttgacgggagtgtggctggatgctgtctgcccgcgctgtcttcctgggctcagcatcctgggacacaggacattgtagtggagcatcccaacctgaaactttgtctcagtgtagagacccagaaagatggggtctgggtgaaggagtgtggagtatggctgctgctttccaggaaacggtttcccctggtaacagatggcattgggcttttagtcctgttgaaattttgttgtcagaagataaatgtaaatagactcaatgtccatgctgtgacttggcttattaataacatctgtggagccataagatgacacacaggagaaacgggctccactcctaccccctgaaggggcatttgcctttgccctgaacagcagcgcccattcaataagtatctgttgacagctggtgccccggccacggggacaaaaagaggacagagcaggagtgaggctgtggtgaggccaaggttgtgtgggcggtgatacggggaagcctggctgctggagtgtccggctgtgccctggattgggtgagagggacacaggagggacgtggggcagagggaggggagaggagtagccactgtgttcaccgtgttgccgtgttccagggctgcccagtggccggattggccagactgtgttgcatcagggaggcagaggccagatgtagggaactgtgtgtctgaggactttgtgccacgtcctggacaccgaagggagtgccactggtgtgtgagtgatggagtaagaggtgggctgtgttttggaggcccctgggtatgtgtggccgggactggaggccagggactggctgtggtccagccccagcatgcagagaggcctgggacattctgtgtgaggggaggcccctctgtgtgggaggtgcacagacttccaggactgaccatggctttattgtcaggatgcaggagccagggcttggcatggggcaggtgtgggggatgcagagcagggccagcaggcaggatgtgctgatgggggcctggcgtgagcaggacggtgcctcccagccctgagccgcagggagtgggccaccaggactggctgggggccggggtagggagggccctggggagggtggacatctgtgtgggtcttgaacataggatgcccatccgatgtgcagggccagctattggttgggcagtggggacatggcctggggtctcggtgggcgatggcctggaggggccaccctgagcaggacatttggaggagtgctggggtgagtcagacaggaccatgtggtggttttctccagtgcaggcagtggagggggaaggcggagctttgcaggtgagggcttgaggcagttccgacttcagactcccccccagggagactgagggaccaccaccatcattactcaggccaaggaggcccagaacagggcagacggggctgcaagagttcctatggcgatagttgttggggcacagggttggtcggatttgagggagggagggtatgaatctgggagtcgttggtgcggttgtacccaccttcactttccgtccccaggctgcgcctctcctgagctgccgcattctcccctgcacctgtgcgtctggccctcttcacgtcctcctggcctgctgtctgcctctcccctgcacctgtgcgtctgtccctcttcatgtcctccttgcctgctgtctgcctgttctcagagcccctcagccctcaggccttcatctctcctggcccatcttcctactctgacgctgacatgtagtaaaagtctgaagacagagaagagtgcatgtgcgtttagcataggaggggcagctttcagtcagtgcagcaagggcatgtagttgttcagagatggtgctggaacgactgatttggagaaaagaggcccttcttcacaccatctgctaaaataaacctcagatgggctcaagagttaaatatttaagaaaaggaggaaacaaaaaaattgctacaagtttatttgttgttaggatgggaaaggtttttctaagaaccaagttcataatgaagctgtcaaataaaatacttgacaaaaaattccccttcatacattagcacagctaaaaactattaaatggtaaatgcaactaaagaattgcagctaaagaattgtgtgacgtaaagagttgcaataagaaaagcataagataaaggtaacctcatggaaggtgagcagggactagaaaggcagagaaatgccagaggccaggagcttgaacgttgttcaatgccaccaacaatttgaaagtaactgtaatagttttgacctgggaagttggctgagcaatcctctaatatctgatgctcccgatgctgaggttgtggggaagtgtgcaccgccatgccctttttttggcagtgtaaattggtaaagccttttgaaggaaaatagggcagaataagtcaaagagcattaaaatttttttgtttttccagaagcagcaaagttctgaaggagacgcaagtaaagataccacaggtgtcctagattgtcaacagaccatttaatcatttttgttaacaaagcaggtgacaattgagccctaatttgcgttatcattagttgttacaggatcttgcttgttctcctgaggccacgccacgatttccgagaagcaggttgcacactcagcagtctcccactagccagtggcactgcaggtgcaggggctgcctcctggacctttcaggacgctttgcaaggtcactgaggatctccattgcacatttggtagaattaaaagactgccagactcagtcttactgttgttagtgtattcgtgctgtcaatatgtgatgaggacatattatattccgttattctctttagctcaaggaagaataaagaatttggaccaaaattacaaccacattatgacgaattttctaagcaaaagaaacaaagtaactgctgaggttaacaaagatgtaataattctcttcacacagccttgtactgttttattgactgtattatcacaaatcctgagcttaacgaaagtctttataagtcagctcatgaaaacaggcacgtggccagtaagaatttaatttcataccaataacacttcagacttcggatgtatttaaggctgtttgcacatatttatagaatgtgtggtgtagatgatgggacagctccccctcagcaagactctggcctaaatgtatttgctttatttacacaacaagaggataagcgtaaacacgggcactttcagtttgtggcactgaaggacgatctacacagggcaccctgcagaggccacaaccaaggccgcctggcttcccagtgggacaggcctaagggaggacttctggcccctttgcttgatgttcatgttttatgccttgatatttctttttggttgcattccctggagctcatgtagatcattttacttttcagaggtgctagttctggtgcccacacgcacacacacaaaaccatcaactcttctggattccttggttttaaagcttgcctcatacaaagtacagagacatctttttcaggaaacattgccaccacatgcttgaaggaccgcttatggctacacttagacatctccaaccaaggtctcttcacctccttctacaacaatgcactttgtctgcactgggacaaaaaatgacagccttttttcttttcttgtttttttttttttttggcgtggagcatttccgaactttcacgtcataaaaaatgcagcatagttaatcagcagcttgcacttctgagggcacattcacctcgggggaggaggaaggaggaggagctggtgggtgctgagactgcagtgtcctccttcccagcagctggacccagagaccaggcaccaaatttttttgatgaaattatcctaaggaaataatcaaatttgtacagaaatttatgttaaaaaatgttcatggcagcaccgtttaaaatggggagaaaattggaaacaacagaattgtagcaatacatatgatcattaaaaattatgttttagaaagatttttaacagtctttggaaaaagttggtgacatgttgctagtttttaaaaaaagtacagagtatgtacagtatgattccaattttgtgtttaaaaattagacatagtggtaacctagcttcagttccagataagatggagaaggcatactcctttcatgtctcccactgaatgcagctataaatcctggagagtagacagggagaaactatttgaggactctggaacaaagacatagtagcaatcgactggtgaagaagacaagaatttgaagtacggtcaagtatctgtgggctccacatctgtagatacaacctacatgtattgaaaatatcagaaaataaaaataacaatacaacaataaacatcaatacaaataacacaccaatacagtatagcagctacttacataacactgacattgtattaggtagaagtaatctagagatgatttaaagtctgtcggaggatgtgtgtagcctgtatgtaaaaaccacgttattttatatgggggactttagcatccaaggatttgaatatccacgggggtcctggaacaagttccccatagacaccaagaaacaactgtattcctgaaacagtcttgagttatcattttctttcttctccctctatgtatgtacatagagtgtacatacatagagtgagaagcaaagaaggtccatgaaatggaccaattcttttgaaaactgcaaattaccacagttcatctaacatgaaatagataacctgaatggtccaataactagtaaagatattgaattaatagtttaaaaaccttctgaaaggtaaatctctaccctaaatgatttcactggtgaattctatcaacacatttaatgaagaaaaaactccagttctaaacaactttcagaaaagaagagggaacacttcctcactcattatatgaggtaagcattgccctaataccaaaaccaatgttaacacaaaatatgaaacctacagaccaataaccctcatgaacataaatgtaaaaatcctcaagaaaacattagcaaatttaaaccagcaggatataaaaggaataataatacaccataacaaaaaaagaaactatccttggaatgcaaggctggttcaatatttgaaaatcaatcagtgtaatctaccatattaacagtctgaagaagaaaaatcatgattatatcaatacagaaaaaaattgacaaaattcaacatcagttcatgataaaattctcagcaaactagaaagggaaggaaatttaacatgacataggacatctacaaaaaaacctacagaaaatcctaaggagtctatgagaaaatttcctaaaactagtaagtgagtttaacaagatcacagagtgcaaggtcatcatacagaagtcatttttatatcttagcaatgtacaattagaaattaaagaatatcacagtagcttcaaaaatatgaaaggcttagaaatctaacaaaatgtgatctggatgctgaaaatgatgagatgataatgaaagaaaccccagaaaacctaaataaatggagagataagaaggctcaacctagtaaagacgtatgttctttttaaattgatctgtagacttaataaaattccaattagaatccaagcaggatttgttcttatagataagctcattatgaaatgtatatggaatgtaaaggaactagtgctatggtttgtccccaccaaatctcatgttgaaatttgatcctcagtgtggtggtgttgggaggtggggcctagtgggaggtgtttgggtcatgggtgtggatccctcatgaatagatgaatgcccttcctcgtgggtagataagtgagttctagctctttcaggtcccaacaagagctggttgtgaaaaagagcctggcacgcccacttgcctctgctcccaccctgtggtctctgcacgtgccagctcccctttgctttccaccgtgaggggaaatagcctgaagccctcactggatgcccaatcctgaactttcccaaccagcagaaccatgagccaaataaacctcatttctttataaattacccagcctcagatattcctttttggcaacacaaaaatggactaagagaactagagtagctgatagaattttttaaaagaagggtaaagttggaggaactatactacttgattttgaagctacagtaatcaggacaatgtggtgaagggacagacacgtaagtcaatggaatggagacgagagatttctacaaatatggtcaatgggttttttttaacaaaggtacaaaaatcaatttaatggagaaaagacagtcttttcagcaaatgttactggaatagttgtcatccatatctaaaaaacaacacctcaacctcacatctcatacacagctgaacttaaaattgatcatagatctaagtgtgtgaaatgtaaaactataaacctccttgaaaaaatcatagaaaatcttcatcacctggacttgggcaaagactttttactctaaaagcgtgatccatagcagaaaatgttgataaattgaatttcatcaaaactaaaaatgactgctctgcaaaaggatgatgctaagagaataaaaaagacaagctaagattaggagaaaatattgcaaagaacatatccagtgtgtgttctgaatatacagagaaatctcaaaactcaacaggaagaaaacaagccaattgaaaatgggcaaaatacttgaacagacactttaccaaagtggatatacagatatcaaatacacacatgaaaagatgttcagcatagccatcagggaaatgcacattaaagccacagtgagatatcacttacacccattgaaaaatgactacaataaaaaaaaaatctgatagtaataccaactgtcatcgaggatgaggaacagctgaaagtcatgcattgctggagggaacatgccactgtggaaacaggtgggtgctttcttatagacttgtatgtgcactcaccttatgcccaggagtccctctcctgtgtgttcaacccagagatatgcaagctgtgttcacacaaaaacctgtatgtgaatgattatactagctctctttataattgcaaaaaaaaaaaaaacaaaacctggaaacaacccaagtgtccttcatctggataatccttaaggataaactggtgcgtccacacagtggaataccactgagcagtgaagaggagccagttattgaaacaggtaatttggaggaaccccagaaacggtacagtgagtgaaagaaacttgtcttgaaaggttatgtactgtttggttccatttgtatgatattctcaaaaagacacaagaccatggggatggagaccagatcggtggctggagaggctggggtcggggagggcatgaccaccagagaaaagggtgaagagtgttttgggtggcagagctgtgtgtatgctggctgtggttgtgaggacaaaatccacacaagcgctcaagttcgtaggctgtacgccagaaaagctgtttcactacataactgaaaaaataagattgaaaaataagatgtatatattttttgtgtgcgtgtgtagaaaaatacttgaaggtaaactgcagagtgataacagtggttccttctaggtactgggttaatatgtgatttttatgtttgtttgagcttttctaagttttctacattttccgtacaaaacatgtattacttctgtaataaaagcagcttgagattatttaaggaagcaaaacacttctgttgtttctcatcaactacaggatgaagtgcaggctccctgggtggtttgcaggggccacaggccttggccccacctcgctggtgctccctctactcctttctgtgtttgaagcaagttctggttcagacagaaagcctggcctttgagggcgttgggtccccacttcctcagtcatagatgtgatgtgcttcccttgacttgggaccttctgagggatgcaaggtggaccaaaggacccgtgaatggccagggcatgcctgcgtggctttcggtttcttaagcagtgatttcagtccacttaaagggtgtgaaaattctgagaatgctacggaccaaatatattttatgtaacagttgggacccggcaacacttcagggctctttcaaaatctggtagctacgagctcttccgtgactgagatgggacaagagtgaagatttgtccttgcttttagctctgctccagttcatagttctaatgggaaattatgtgacttaaacccaggctgtgagatgcatcagtgacgtgtgggcataaaataaaccctcgagatgttctcttgcatggtacactggcctaggcaggaatattcttgaggctaaaactgtagaactgtcagactagtgttacgaatgtggtggtgagaggcctgtgcagccgcggggcctgtgatgtgtctcctgtgtgtctttcactcctatgcagtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatatatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttcagaagttactgctttgcttattttttacaacatttctgtggtaaataatcggtgacttacaagcctagtgcagccagtgatgggggttggcaaacggtgacatgcaggggccatgcggcgtctagtgtctgtttctgtgttgaatttgtgtagcaacagagcaagtatttctcctgaaactcagactcactcaggccacctcagcccttctagttcctttcgtttattatagagtaacctacagcaggaataccgcgttcatttactgttaatagaagatccacaaaagattttgaaatcaaatacattctaaaactaggcaagacacgctgcaactccccttgtcctctgggttatgaggggtgagcgttggtttccgtgtgctcagatcccatgaatgagacctcacagggaagcgcccagtgactggcaggctccttaatgcctccaggtcaggctcaggaagtctctggatgcctgggtagagtctgggtcttctcagagcgggaggcacccagggcctgtggaggcctgagggctgctctggggttccagggccccagatagtggcttagcatcctggtgacacagaagggagagcactcaccgcggtcccacgtgtgtgttttgaagcctaagatgtttgcaatgactctcaacagtcgctttgaccttttcccctagatctttagcagttaaggagtttttttcaaagcccaagtataaccacattttgaaaccagaagactgtctctctgaaccgtgcactatattgcagttggacatgagaaccgtgcaaatttctgatctagaggtgagaaaaagatgaattgctccttacattcgataatcagtgaccacgaaacactcagaccagagcctggcttatcaaaaaccttcagtgagtgctgggggtgtgagtgaataactaattattttattatgcaaataagtgaatttataaaacgtttgctactgattttttccagtcttttttcttttttacgttctattttgattctttcatattgtacaccattttatgtctccagcgtcttcattttagatttatgtttaatattctcagcatcttcaaaatcaaataaattatatttcgtttcattatggtatttgcattacagtttttttcaagtattttaagccactcttcatgacagaatcgttagaattccctccgtgaatccctgtctgtggccgcgcggtggcgctcgtgggctctgggcggtttccccgcgcccccgccctgcctggcgccccagctggcgccgcgtctggagatggggcgggcgcggtggcgccggcgcgctttggtttttagttcgttctgctgtggaaaggcccagcctggagctctccaactccttaactggaagagctgagcgccgaaaagattccgcagaatctggggtagaaaattgggcgcaagaagctcagatgcttgaaacgtttctgactgaagcctctgaactcacgatgcgggttttgggggtggtttccccaggctggggggcttttctacggttcctgacgcattcagcgtctgcgcggggcgcgtggagggggccgccccaacccgggccctgcggtgccacgcggtgcccacgcgtgccttgtcatctgcttgacccagaccctgaggggcgagctgcgcttcgacatcaggaaggcggggaccctgcacggcttcacggcctggtttagcgtccacttccagagcctgcaggaggggcagccgccgcaggtgctcagcaccgggcccttccacccgtgagtgtgcggggcgcgggcacggggtgcggggtggggggcaggggagtaggcggggtgcggggatggggcgcgcaggagggggtgggacgcggcgtggcggtcgtgggggggtggggcacgtgggggcgcgggcagtggggtgggggcggcgcgcatgggggcacgggtggtgtagacaccgcagcctgtgtgcccccttccgggtctcgccaccactctgggcccagcctgggcgtccctccgacaacagccccaacgggaggagctccctgtcttccaccccgcgaggagcaccacagctcttcatggtctgacccaaagcgcctccacggggcgtcggggttcacctgacgtttttggaggtgcctgttttttgggacacatttccccgccagcaccctgggcatgtgtggcagtggagctgccttcagggccctgcaggccttccctttgggtggggttggctaccccgctctggcacctgccccgctgacttcccagcgtggtggccccgcgaggggaccccggctccagggaggtcgcagaggtgcggggttgatggcctggcctggcatgtggtccccatcacaagagtcctgtggtggcccctccagtgccatcaccgggtggaggtgggcagcttggaggccagttatacccatccccgagtctgggggcgtggagggggcagtgacctggggcacaggctggggtgaggggtgtgaccagagtcagggaaaaactggagacctgaggagccccccacttcactgctggccccaccgtggacagtgggagtttgagggaagacagagcctgaggaacttagagatgtttccaacgcaacccagtgcagaatcatagcgttttactatttccccccaaatgtgacagttgtcctcaccttgtaaccttcacagaagcgactccttggacctgattctgtctgtgtacaccacagtttaacagcaggagctagatcaccagcctctgcagcttaggcaagggtgcaggaaggggttgcacagccgtcctcctggcgggccggggagtcgacaccacacgggacctttagtgcagctgtgtgtcccctgagctcccgcatcctctgggccacccagggtgagccgtccacacctcctggaatctgagtggtctcaggagcaagcttgtgtttggcattggcaggatctgtctcactagcgtaactttgatcccagtgtatcccatagagtccctttagatcacagggctgggggtgtatatgttccctgagttagcctgaaaagccaagctttgtgtccccaggccctcagggtggactgccggctgtgtgggtgctgttgggggcgagagccagtgcgagcctgagtcagcgccccgagggccatgtggagactgccctagctcagcctccaggtcacacgcacccctgtcttgcagcaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagtaagatacgtagttgtaagattctgtcctgtgggtgccggtcctcagggagacaggcctgggtggtggtagtgatggcagatgctggcccacactggggtccacgccttttgtgcaggagtgatttaatccttacacagaaagcgcctgttgtcattggcttcatttcccatctgacagcacgggaagtggagggctctggaagggaagtcagggaagtcattccctcaggtgacacggtaagtgagggagagcagagacccacatcagcctgaggccccttgtgccatgtccagagggtcccccagatggacagaagcctgagctgtgccttggcgctccctttacacaggcctctgtggcttcccaggcagcagttagtctaggcgtgtcgtctgtgatgcgtgttctgactggcagccttcggatccgtgtgtgaattcatgtgtagctcgcccagctcacttgggcttcctgtctcagaggctgctgaaaatggaatgttcttctttgggctcaggattaatgtggcaaagaaaataaaaataaatggttttccttcattttttatatttgttttgtgctttgctttgtgataagtttttgttaaaagtttgtcatttaaaaaaattctgcacctgaatactgttctcttgtccaatattaaaccattaggaaatgtagtatgttaatcaaatgatttatcatctgattgacctgttgtcatttatctttttcaggttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtc

SEQ ID NO: 38675 - DNA, 5616 bp, Homo sapiens
ctctgcctggtggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggtaaggaaggggccctccctggggtgtgccaggtgtcagcggagcatggtggggcctgtcccacgctgcccagagggagagaggcccctagctgaggttccctccacccggttgaacagggagcagtcctgcccctccccgagccgccagtctcctgtcgtcactgatgttggaggaggtcccactgggggtctggatgtgacccatccttggcctgggggcagtggtctcagaagatggcctggcccatcctctgctcaccacccaccctgtgcaggtatcttgtaccccactttgagccagtttatgaacccagggcctccacagggagctaattaggagcctagaagccaagaagggaaaaggatggggcaaagggggctgactttaacccattcttccccagcagtgatgcaaactgcctttcccaggaagttaggctggaagctccaggctgtgaagtgggggaagaatcagactcctcctcctcctcctcctcctcctcctcctcctgttgttcctcctggtcctcctcctccagcttctccttttcttggagtctgcatggccacatggctctgcctgagcccatctggcagccttccttggcagggacagaaggggtgatctagaaggggtgatccctccatgaagcatggaagggaacagggctaggtctgtgtttggcgctcaccccatccctccactccctggcttcctctggcctggggagttttgtttttcaccctccagagggggaggacatggggccacaccctggcctgtctctcaggcttgtgtgggtggaggctgggaagggagttgggctaaacttcgctgttgcccgaggccatggccacttcccggcaggttgccagcgtcgctacagcccagaccaaggcagaataatctccggatgagctggtggcaccgctgagcctttggtctcaccagggcttcctgttgctggcaggcggggtggagcggagctgctgggaggctgctggataggagaggggtcacggctgcggaagaggaggttcttcgggacacccgtggatggacacggcaaggtcagtaggagacagaaaaaaagagggttcacttagtgcagaatcacccttatccacttcccaagtctccttaggttgtggttagaggtcctgctgtggcacctctgtatttcttgggcctcagcaaggcactttatcctcttcaggtctcagttccctgatctttgcaggcaggagaatcgtccccaccccaaagacaagacagggtggaagagatggagagtttcacgcagagcacaatcaggcatcttttattcttttctttccctccaacatccctaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccaggtaaggagctgtgcaaagggaagctcctcttccctagtggtggctggtgagaggtccggggatggcctagtgctaaagctggggttggtcctcaggggctgaggtctgtgggaaagcactagcgttaggtatcagggctggttaactggtgcatggtggggcaagggccagttccagacacaaataagacagttttatcaatttttttttttactgtaaatctcagttgtatatgaccaaattagttttaaacattaaaggaacattcttctggctcagtctgggccttaattgcaatcacagataagccccttaccccagccagattgagcatgggcccttgacagtggagtgtggctggctctggggatgaacacattcctatcccaggaagggcccagccaagcactgagtcagcctcaagtgttgctgacctaaggggagtcccttgggtcaggatggagtgttgagtcaggaagatgcagttgccgtcctgagccttagctgggctctgaaggagaggaggttggtcaagggacagagggcaagggaagagaactgggaagtagcagaaaatctcagctgcaagtgttaacttagagaagcagggggtgagggagagacaggaaggagaacaagttttcttttttttctttttttttttttgagacagagtctcactcttcttgccaggttggagtgcagtggcacgatcttggcttaccgcagcctccgcctcctgggttcaagcaattctcctgcctcagcctcccgagtagctgggattacaggcacgcagccaccacatccacctaatttttgtatttttagtagagatggggtttcgccatgttggccaggctggtctcaaactcctgacctcaagggagcacagattttctaaaaggtttcttcaataggtaaataagaaatgtaaacagaggctgggcagtggctcacacctgtaatctcagcactttgggaggccaaggcgggtggatcactggaggtcaggagttcgagaccagcctggccaatatggtgaaaccctttctctactaaaaatacaaaaattagccaggagtggtggtgggcacctgtaatctcagctacttgggaggctgaggcaggagaactgcttgaacccggaaggtggaggttgcagtgagccaagatcacgccactgtactccagcctgggcgacagagcaagactccatctcaaacaaaaaaaaaagacaaagaaaaaagaaaaagaaacgtaaagagagaaaaggctggagatagcaccagagcgggaagatggtagacaaagaaatgatacttatttgatgctgatcaaatgcccccagatctctgtacaggagcaagtggtgaaacaaggatgaccttgcctgtccttgccctccaagcatttcagacaagcacatgtgtgacctccaaacaaggcagatggtgatgagaggaaccaggccacgggagattcagaaaaggcacaagtgctcccagaggggcctttgaagccttcccagaggtggcatctgagctgagcctggcaggttgagctgggttttgatggcctgagatgatggcaggggaaggaggtgctcttaagtttgcaggggtggcagcagaaaacgcaggctaagtctaagcgcaagtagagtgtgagttaaagggggtaaggaaacgatggaatcacagccacaagggcctgcttctcttacccaagcagaacttgctccttttccattcgctctggggggtagggcttaggcagttcctcgcccctcctgaactgtgcccattctctggccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagg

SEQ ID NO: 38676 - DNA, 1760 bp, Homo sapiens
gtctggagaggcaggaggacaccgagttccccgtgttggcctccaggtcctgtgcttgcggagccgtccggcggctgggatcgaggtgaacttaaaccccagcctgggtgttcactgggggcattgagggagtggtcagaggcggcgagggcagcggggagggcaaccccccattacttctctcccctttccccatgcagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggtgagcgcgcggggcggggcctagggcagagcagggacggggctggggcagacaaaaggcccggggagggcagggttgtcgtctccgctagaagtaggcgagtgtgaaaccgcacaggggtaaattgagcctcagtcactcccacttccgccccaggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaaggtgtgagtccgcccaaaccctgagccggcttggcgggagggcatggcctgggaagcggatgccggaccccacctctttgaccactgttcccgtcatctctagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatg

SEQ ID NO: 38677 - DNA, 1760 bp, Homo sapiens; identical to SEQ ID NO: 38676

SEQ ID NO: 38678 - DNA, 14825 bp, Homo sapiens
gcttccggcaccggccgaggtgcgggtcgcctccagaggtgcgtggtcgtggcgcgagggatcctgaggctgctccagcagtgcgccgccgccgtctcctggggcggcttgggttagccgggaggtgggtcagaggctcgccccgtgccctgcgtccgggcgtctccttagggcgcgtcttcgggtccggccagcggtgctgaaaaagggagaaggttgggggtagggaggaaacaagatcccagttcaatagatttctccgcagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcaggtagggcggctggttcaccacgccccggctttcggcgttagtccagtctactctgtgataaaaatagaacagttatttggatacagagaatgtctagagaaattctgccctaagatcacctgtcgcgttagagaggccttccttgacactgcagctcaaggcacaccctccacagacatacacactatcattttactgtctagttttctgcatatcccttaacactgccagacatctttttaatgtgtttttttctcttctcacattacaatctctgaggacaaggaatttgttagacttgttcatacttgaattcccagtgcccagaagagtcgctggtactatttaggagctcagtaaacatttactaaataaggatcagtttcccattgctactaattgcctacgcaaggattcttgtgctatatactctgccctagaaatgaataccagagttgatagtggaatgatagtttaacaaaatcagagtatgtgctgtgtaaagatgagcatgcatattttaacagattttctgagcattagcattgttgcttcatgccagatattgatactgggagtacaagagagaatacaggacaacatatatttatgttaccgaagtcattgggaaaccttaggggaaaaaaattttattattattattttttgagataagggtctcactctgtcacccaggctggagtgcagtggcatgatcacggcaactgcagccttgacctccaggactcaagtgatcctcctacctaagcctcccgagtagctgggactacaggcatgcaccgtcatgcctggctaatattttttattttttgtagagacagcgtcttgctatgttgcccaagatggtctcagactcctgggctgaagcgatcttcccactggggcctcaagaagtgctgagattacaggcatgagccactgaggctggctccttaggaaaattaattttctgagagtacctgcaaggagttttttccagttccaaaatagttgtttctaagttgtcaatgaaagtcaaggagaatacatgtgtatttacacttaactccaagatactgtcatgattccaaccaaaaattcacacaaaactactgtgtctaggttaagaccagttttctcaaataatgacttactagtcttctgactgtaggtttttttagtggaatccagtttaaaaaataataacaatctggccaagtacagtgactcacccctataatcccagcactttgggaggccaaggcaagaggatgacgagcccaggagttcaagatcagcctgggcaatacagtgagaccccagctcttaaaaaaaaaaaattagcctagtgtggtagtatgtgcctatagtcccagctgctgatactaaggcaggagaattgcttgagccctggaatttcaggctgcagtgagctctgatccgccactgcaccccagcctgggtgatagagatagaccctgtctctgaaaaaaaacaacaaaaaacttctggatccgcaggaatcagtggccaacagtccttgctgggttcagatatcttcagggaaatatcggtggtggtggtattcatgtttgaccttcagtgtgtatctaacacccagtagttctattatcaggtctcatttgtagattatgaatatatatgtctgtagatcatgagtatatgtgtctaaaggctacattgtggagcttatggtgcttgtgttctggtgacaaacttgttaaaacaaagttctgtggctaggcacagtggctcatgtctgtaatcccaacactttggaaagccggggcgggaggatcacttgagccctggagttcgagagcagcgtgggcaatatagtgagaacctgtgtttaaaaaaaaaagaaaaaaaaagattctatgtctttgtgatgctaatgcttgtttgatagtggttcctagtcttatagatttcacagataagtaaaatttcaaaacaattttggaaattgatagagttgccaaatttatgttgacaaaaaaggatttttttaaaaactatttactcttaccattctttcttaaaaatatttcagcatcaaagaaagaaccgatatgagtatatggcaatgtttttaacaagctgaggaaaaactaaacgttttgacttttttttattttacctcagagactgggcacagttttgtcattcttggcattgctagcagagactattttttgagaaacactggtgggtattagcttcctttatggtgcctcttactacataccaaatcattaccccttatcttttacaaaaataatctggaatggcatttggggaggactaagtaatgcaacacaagaaattattttagaaagagtcatttgcacaaattagattttagtcaccggcttgcttacttattctttttttttttattttttagcatgtatgctctatacaatccataacacttatgatgacattgaaaataaagtcgttgcagatctaggatgtggttgtggagtacttagcatcggaactgcaatgttaggagcagggtacgtaatgcaatatatgctatttgggtattgggtggctttaataaggagcatcaatgggattaactgaattatatttatgagactccacagaatgagatatagggagcaaaaatctgatactgaatacattttgaatgggcagaagatctaaacaaactacaaaaattaaataaaaatggtgaaagcagcagttccttttatacaaacctgagtttccaacccctgccgggtttggaaattatgctgttacacttgactgggcacagtggctcatgcctgtaatcccaacactttgggaggccaaggtggacagattacttgagcccaggagtttgagaccagcctgggcaacatggtgaaatcccatgtctacaaaaaatacaaaaattagctggatgtggtggtgtgcgcctgtggtcccagctacttgggaggctgaggtgggaggattgcttgagcagtgcaagatggcaccactacactcacctgggtggcacagcaagatcctgtctgaaaaaagaaaaaaaaaaagaagaaaacactcactcttactttgctaattgggttaaaaagatatatggtttaaaaaaaaaacagctaattttggttttgtttttacttgggagctataagtcgccactctttgtatgtgttttgtatttataggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaaggtttgtaacaagaatcgggtatattggtatatttatagaaaagattttaaaaccatttttaaggccaggcgcagtggctcaggcgtgtaatgccagtgctttgcgaggctgatacaggaggatcatttggggccaggaattggtagccatcccgggcaacatagttagaccctgcctctacccacacacacacacacacacacacaaattttaatttcccaagtgtggtggtgcacctatagtcctagctactcagaaggttgaggtgggaggatcacctgagctcaggtattcggggctgcgatgagccatgaatgtgccactgcactccagccttggtaacagcaagaccctgtctagaaaaaattaaacaaaaataaaaaccatttttatcactgtttgggctaagtgattttatcactcttcattaaataaaccaaggctaagtgatgttattactcttcattaagtaaaccaatctcttatttgtatagttcttataatttacatttcaatttgtttaatgcatggctaagaaactgagtttttcaactttcatttttacaaatttgtattaagtaaacaaagatagtcatgtcatttattgtatatctcccatttgctttcaggaataatttgcctaacccttatgaatgaatacgaaacatagaaagaattttatactttcagaatctgttttttaatgtcttaacagacccaagggtttctacatgtgcccatcagtaacagtgactcaccgtggctgttaattttgtgtgtactgtgggcaaggaggttaggaagtcagtgagggtaggaaaagacatgcatagtttggccgggcgtggtggctcacgcctataatcccagcactttggaggctgaggtgggtggattacctgaggtcgggagtttgagaccagcctgaccaacatggagaaaccccgtctctactaaaaatacaaaatgagccaggcatggtggcacatgcctgtaatcccagccactagggaggctgaggcaggagaatcacttgaatccgggaggcggaggttgcggtgagctgagatcatgctattgcactccagcctgggcaacaagagcgaaacaaaaaaaaaaaagacatgcatagtttaaaaagtaccctgcccccaccaagatgattctgaatagtactctatgcatttccttctcccctttttgaagtcattaatgttggaatataatattaaaatttttactttatccttatttaaccaagacagtataattctggttttattctaccagccttaaaataatattttgatagtttatttgtacccttattgctaaaagatttcaaggtggctattttgaagtttggaagaaaatatttctaaatcctactaacttaatcttctgttttgagaagaggtaaataggagctttttttctactcttcacagggacagatatggcttttctaaagactgctttggaaatggcaagaacagcagtatattccttacacaaatcctcaactagagaagtaagttcaaatcatctgatattctgtggcattgatttttaaattcatgacagtgtttttaggatttgctgtgaatactagataccacagtatctatttctcctgaccattttgacatgtgaaacttaaattttccacttaaccagctagcatctgattggcctttttccaggctataagacttatttcctcaaagatttttttcagacaggaactgttgccagaggagagactataactcaggagtagaaaagtgtgttgtaactaggattactgtatgttttggtttctctgagtaagtcttagttgatcccttttgtcccattgtcccggtgtggcctgatgtacttaagggaggcagtaaggccaggttttcagaacacttgagcctggagctaaacagatctgagttcagaaatcacctattcttacttttgcagcatataacacatggagaggtgtataagttgtagtccaggaaactgggggaaggggcagtacatttttttagtgtcagtataacacaatagttaggaacagagattctgaagccagaccagattctctgggttcagatccaagttctgctgcctcccagctgttttcttggtcaaggtaattgagtttcatcatcaaggtaattgagcttttgtcatctatactatcctcacctgtactctaagtgtaagggactgagagtaccaattgtacttcataagaattgtgaggattacatgagttaatatttacaaagcacttagatcagtgtctgacatgtgtaattgctatgtgttagctattattatttaaatcatacatgtattcaaagattttaaagtgcttttgtaggaaaaatacttaattcatgtaaatacagtacgtaagaacccagttggaaataatacattctagttacatggtaatgtgataaccttttaaaaagcataaaatataacagctaaaaagaactatactgctaataataagtagtggtacatgtaggcaagcaacaggacacaacatagctagtaaataaatcctcactcactatatatgaaagcaaacaccagtaaacattggtatccaaacctgtgtccccaagaacaccctcaggtttgatgattcactaggaaatctcacaggactcagcatctagtcttattcatggctatgatgtattacagtgaaaggatatagagcaaaatcagcaaggagaaaggtgcattaggcagagaatggggtaaaccagggccaggcttctggagtcttctgccagtagaataacacaggacacaattaattttcccagcatgaattattgataacacatgtgaaacattgccaaccagggaagctcattagagactcagtgcccagggcttttattagggactgatcatgtaggcaattccctttctgacacatacccaaattctagactcccagtaggaaaacaggtgttcagcataaacagtgttaggcacagtcagtcactattattaagggagtagggagtgggaggcttcccaaaatctaagttcccagtctccagacaagggccaaactaagcaggcctttctaaggataagcagccaggcctgctgtgaactcttttctgcacagcttggcataacatgaattttttttttaattatactttaagttctagggtacatgtgcacaacatgcaggttacatacgtagacatgtgccatgttggtttgctgcacccatcaacttgtcatttacattaggtatttctcctaatgctatctctccgccagccccccaccccccaacaggcccccgtgtgttatgttcccctccctgtgtccatgtgttctcgttgttcaactcccacttatgagtgagaacatgcggtgtttggttttctgtccttgtgatagtttgctgagaatgatggtttccagcttcatcccatgaactcatccttttttatggctgcatagtattccatggtgtatatgtgccacattttctttatccagtctattatcgatggacatttgagttggttccaagtctttgctattgtgaatagtgccgcagtaaacatacatgtgcatgtgtctttatagcagcatgatttataaccctttgggtatatacccagtcatgggatggctgggtcaaatggtatttctagttctagatcgttgaagaatctccacactgtcttccacaatggttgaactaatttacactcctaacagtgtaaaagcattcctatttctccacatcctctccagcatctgttgtttcctgactttttaatgattgccattctaactggtatgagatggtatctcattgtggttttgatttgcatttctctgatgaccactgatgatgagcattttttcatatgtctgttggctgcataaatgtcttcttttgggaagtgtctgttcatatcttttgcccacttttttgatgggtttttttttcttgtaaatttgtttcagttgtttatagattctggatattagccctttgtcagatggatagattgcaaaaatgttctcccattctgtaggctgcctgttcactttcatgatagtttcttttgctgtgcagaagctctttagtttaattagatcccatttatcaattttggctttgttgccattgcttttggtgttttggtcatgaaatctttgcccatgcctatgtcctgaatggtattgcctaggttttcttctagagtttttaggtcttacatttagatttttaatccatcttgagttaattttcatgtaaggtgtaaggaacggatccagtttcagttttctgcatatggctagccagttttcccagcaccatttattaaatagggaatccttttcccattgcttgtttttgtcaggtttgtcaaagatcagatggttgtagatgtgtggtgttatttctgaggcctctgttctgttccattggtctatatatctgttttggtaccagtaccatgctattttggttactgtagctttgtagtatagtttgaagtcaggtagcatggtgcttccagctttgttctttttgcttaggattgtcttggctatgtgggctcttttggttccatatgaaatttaaagtagttttttccaattctgtgaagaaagtcagtggtcgcttgatggtgatagcattgaatctataaattaccttgggtagtatggccattttcatgatacagtgctctacactttcggagaaacttctctagtaacgaactatagaaatgatccctgaaagtatagtcttggcataacatgaattttataaaactcagttttactgcatgaactgaattccccatgtacctatatctctgccaaatggtttctaggctagctagctgtatatatcaatgaaataatgctacagaaaccatatgagaacattacacatctttgatagatttctgaaatagtcatgcatcctttaacaacagggatatgttctgactaatgcattctgaggtgatttcatcattgtgcaaacatagagtggaccaccgaggctctgtggttatagtctgttgttcctaggctacaaacctgtcaacctattactgtattgaatactacaggcaattgtaacacaatggtattcttttgatctaaacatatataaacaccaagaaggtaatgtgttgtgctgtgatgtcaagatagctacatcattaggcaatagcaatttttcagctccatttataattttatgggactaccaaaatatatgcagtccctagataaccccaaatggcattatgtggtgcatgagtagctttctatcacttggatttattgtgtgatttggttcagattgttaaatgtattgaaattgatttattattttcagaatactatccattcaattgaaatttttataagggtctagattctaatgaaattttaagcttaaaaactcaatctcaagtattagtaaaaagcaattttaaaaaatcattatttaaaaatcagctcataacaacatattatttatgttcagcatgttcaaaagaaagctgcagaatggaaaatcaagatagatattatagcaggtaagacaaatctcaatcctaatatccaaaagggccaacatgtattcgcccaaccaaaattttcatgcaggtgctgagaagataaactatgctttacagtgtggcaaaatgtgcatgattggtaatagattggaaatggagtaaaagcagaatgaacacttagcctgagactgtcctaatttatgcgatttactgaaaatttctaatagcactcaggtatttggtcactccagactcaggcagaacactgtatagcagcacaatggctaaaaacatgggctgggggccaggtgtggtggctcacgcctgtaatcctagcactttgggaggccaaggtgggcagatcacctgaggtttggagctcaagaccagcctggccaacatggtgaaaccccatctctactaaaaatataaaaaattagccaggcatggtggcgcacacgtgtaatctcagctacttgggagactgaggcgggagaatcgcttgagtcccagaggcagaggttgcagtgagccgagatcgcaccactgttcttcagcctggatgacagaggagactcagtctcaaaaaaacaaaaacaaacaaatgaaaaaaaaaagtgggccgggcgcggtagctcacgcctgtaatcccagcactttgggaggctgaggcaggcggatcacgaggtcaggaaattgagactatcctggctaacatggtgaaaccccgtctctactaaaaatacaaaaaaattagccaggtgtggtggcaggcacctgtagtcccagctattcaggaggctgaggcagaagaatggtgtgaacctgggaggcggagcttgcagtgagctgagatcgcgccactgctctctagcctaagcaacagagtgagattccatctcaaaaaaaaaaaaaaaagtgggcttggagttggtcagatcttggtttgaaattcattcatagaaaatgccaccacattattcctagataatctaatttcattttcttttttctttttttttttttgagacaaagccttgctctgttacccaggctggagtgcagtggcaacctccacctcccgggttcaagcgatgctcttgcctcagtctcccaaatagttgggactacaggcatgcactaccacgcccggctaattttttaatctttagtagagacagggtttcaccacgttggcagggctggtcttgaactcctgacctcagtgatcctccagcctcggcctcccaaagtgctgggattacaggtgtgagccactgagcccagcctctaatttcattctctaattacccctggaatcaaataacatttatctttttcttctaaatatctatgagtaaatcatgtttgatacatttttattactaaattgggtaatagtcacaaacatcaaaacaggaaaagcatataactagaagctaattataatctaagcctgaaataagagtgcaataagggaacatgttttttcacaataataaactaacaatgaattgccactgtagtgttaaacatacagctagatatattactgttcataataataatgtaatatacacttctgttcgtcttcctgttattttcagtaggggtgtttttttgttgtttgagatggagtctccctctgttgcccaggctggagtgcagcagcacgatcttggctcactgcaacctccacctcctgggttcaagggattcttctcctgcctcagtctccccaactagctgggactacaggcgcaccaccacgtccagctgttttttttattattattatttttagtagagatgaggtttcacaatgttggtcaggctggtcttgaactcttcacctcaggtcatccgcccgccttggcctcccaaagtgctgggattagaggtgtgagccaccgcgcccggccagttttaggtattatatgcagtacggaacaccttagaacagtcccagtactataccaagccagaggcttgttcctccaaatgtggccctcagaccatcagcattaaaatccctgagatttccttgttagaaataaagaatttcaggccgggcgtggtggctgacacctgtaatcccaacactttgggaggctgaggtgggcagatcttgaggtcaggagatcaagaccatcctggctaacatagtgaaaccctgtctctactaaaaaataccaaaaaattagctgggtgtggtggcaggcacctgtaatcccagctacttgggaggctgaggcaggagaatggcatgaacccgggaggtggagcttgcagtgagcccagatcgcgccactgcactccagcctgagcaacagagcgagactccgtcttaaaaaaaaaaaaaaaaaagaatttcagactccacccagacctactgaactagaatctgcatttcaacaagatccccaggtgatttgattgcacattaaaacttgaaagctgtgacatacaggagtagtagactcactgccatccctctaaaatagatcagtagtaaagagtttggagaatctacattattctttagaaggaagaaatatgaaaaactggttttcgttttagagcttaggaggaaaatgggtacttagtaccattattaaactctgggtaagaaaattttgaaataaatatggttatgagattaagttagctatagactattaggaaattaaaaatagaaaggtaccatcattttcataggatttactttttcgtccactgtttatccttctaaactcatcacttataacctcaaatttcagtataaatggccataataacagaaatgccaagctgccatggctaatgctaggaatacagaagtcactacttggataagttaaaggttctaaaatgttcagcttaccagcacttaacacttttcttagtttttgttgttgttgttgtttagtcaagggtggtaaacgcttggaaatacaattttatccttaggtggcttttgttttacagaacttcgatatgacctgccagcatcatacaagtttcacaaaaagaaatcagtaagtctcttgattttggctggtctacattcggtattgaaaagctttctgggccggatgtggtggttcatgcctgtaatcccagctactcgggaggctgaggcaagagaatcgcttgaactcaggaggcagaggttgcagtgagctgagattgccccactgaactccagcctgcgcgataagagtgagactcagtctcgaaaaagaaaaaaaaaggaaagctttgtgacaagtaattatttctagtgttaccaactttcctgtgtaaatatacaaagccagcctaggagacaccataaatggcctgtgggaaaggcccatcgtcaatagctaatattctagttctttcctaaatgctttgggtacaaaaagaaaaaaaaaatcaaaaactgtttttgctcttttcatatagtatatattttattagttagtttgtactaatacattctcatattacaaaggcaatttaatggaagaatcttccttttgatatttgaatcatctgaaataacacaaacagaacaatacattcaaagaaatctcatttgcataacaaaaagacaagttaaacaacaaaaaaatttttcctttctcacaggtggacattgaagtggacctaattcggttttccttttaaaagccccgcaaacaaaagtcgtttaaaacctatttaaaatgaataaaaaattggtttactaaactactggtctccagcaccattttctgttttctgttgtttggatgcaggttcttctttgtctgtttcttctcttgctcttttcacaggtcctataacgtaacaattaatttttgttaaattcaacgtaagtactgctctagtttaatactgagcacaattactaataatgatactgttgaaaaagatgcaacaacttccttgcaccaatgagaaaaggcttttctcttagtacagacctgacctctagattcatcttccaaatatcctgtccctgacttatacaacagcataaccgaggtaaatcgttaataatccaagaatggcacttatccaggagttgaaaagccaaatccctattctctctggcaaatcatttatttatggaagtagaaattttctcatgaaactaccaaaggacttaaaaaaaacttaccagttgcaccattttcatcatgttcatcatgttcatcatcactagcaaatttcgttttcttgccctgaaactgtacttttcctttaccagacccaggctgggcagctttattaccctttccttttcctttaaatctacgacctgtagagacacaattgagcactctgtaaagaactttttttaagtctcttgtcaatgtttttgaacactgattaaagtttttgctcaagtaaatgggttcaacaaccaaactgttaaagaaaaatcagaataaatgaccttttgacttccatttgtttagggattcttgttggtcttctattattttcttcagtgcttctttttccacctctccttctagtacttcccaagtcacttctttgttccttaattgtaggttaccattatttgcatctttggctttacccaatgcttccttggctttttctttaaatagaattatcccctataccagagacagaaaacaaaagccatacccttggtttttagtcccacaattaatttctttgtccaaagtaattttttctaccctgcaaaccttccatgtctttaccagtttgaatgaattttactgaacagtagaaaaggaatgctacagaagtaaaactgcaatcatcagtatgaacagttattcatagtataattcagaaactatcagacatcacatatagtgacaataacaacaaagtaaatgatcaagtagaaactaatttagtataattcagaaaatatcagacatcacatctagtggcaataacaaatgatcaagtagaaactaatttaataaacacaatttttaaaattactttctactaattttgtctaagtttctacagattttcaaactgattgctaaaaaggatagggatgtatccaaacctcttttgctcctctgacgaagtctatccattttatttcaccatgatttgagaaaagtatgtgtaaatcttctctacaggtctgatcatctaaatcacccgaaaatttcagcaagcatccaatcttttcttctagagatttctataaaaatatacaaagtgatcaaaaagtttcttaaaagcaacaacagaccagaaatgactcacaccaccttatagctatacaagaaaaagactagaaaccaaaatgctattttaaagtagtttcttccgccggggcagcaagagcgaaactccatctcaaaaaataataataataataaataaataaagtagtttcatag

SEQ ID NO: 38679 - DNA, 2784 bp, Homo sapiens
gtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccggtgaggagccggggagcgaggcggggaggctgggagcggggcgcctcttctgaggccagagggggctgggcagggccggcccggcgggaagggggtcggccgcgcgctatcagcgcctggtccctgagccgcggcgctggcggtgggggcttttcggccccggcccctcctggcagggcccggctgtgcaggtggccgggcagggccgagggccccgcagcccaccgagaaggccccgccggcctctggcccgcccacccggcgacctgcgctggggccgcttgcacggccgccgcgggttgcagccttggagtttagtttcatcttcggattttccttcagagtcggagtgggagtgggacgcaagttggtggtcttcttcggtcttttaaaatagtctgggttgacgtcaaatgcagaaatgaggcagtgttgattttttttggcgtaagtaccccaagcctcgggggaaatcatgaggcagccggttgaaggagaccaactcgggaaggaggaaaaggttagggaggctgaagtgctcagtttaggacagacacttgctttggacagtttgctaactagccagtctgtgtgtatttttgttttcggcatttttgtcgcctttattaaaatttctcagcagttaaacaggccgctgatagacataagggaattatttatatagcagattgcccaactcttgcattgtatcctaacctaggaccatgctgtgtccccatggctttcaagctgaagaaatgaaggtctaaagtgtgtcagacgtacctaaagaagagttcaaaagtgtagctgccatcctttccttagctatcagaggaagcagtcactccagaatgagacatacacaagcccgggttcatagactcaccctccataagctgtgttgctagattgaagtttttaatcaccagtgaagaattgattgtcataattttaggagactactgaagtttgccttgtttctttccctaggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagagagaagcttatctatcaaactgtctgcattagtgcaattaagaaccgaaatacgtctatataaagctttcagctgtattgtaatactttgattcgatagggctacaactcccctactgctaaccacatttcatggaatatggctacattgcatcttgcattaaatatctggagaaaattc

SEQ ID NO: 38680 - DNA, 177230 bp, Homo sapiens
tttgatgtcactgggcctcatgcccctattctggctatggctgggggacacgtggagttacagtgccagctgttccccaatatcagtgccgaggacatggagctgaggtggtacaggtgccagccctccctagctgtgcacatgcatgagagagggatggacatggatggagagcaaaagtggcagtacagaggaaggaccaccttcatgagtgaccacgtggccaggggcaaggccatggtgaggagtcacagggtcaccacctttgacaacaggacatactgctgccgcttcaaggatggtgtaaagttcggcgaggccactgtgcaggtgcaggtggcaggtaaggctggtggctagctggctgtcagtctacttccaggcatggccttggggcccagcgtgttcaggtggagggcttttcagtagggtgagagtgcactctcccagctgccgtgctggcctgcactgctcccgggaagcacagcggtgaaggcagagccaccttcctcatcttcctttccctccttacaccagtggactggaaagtgaagggaagggaaagagagagatggggggaatgagagagacacagagaagaagagatagaatgagaaagaagcagggagagacagacagaggtggaaagagagatggagagaaagacagagagatgagagaaagacagagagagatgaagaaagaatgacagaattatagagatggggaaagagagagatggagagggagggacaggcagagacagagaatgaaagacaggagagacagagatggagagagacagagagaatgagaaactgagagaaacacagagagaatgaaagagacaaagagacagagtcagtgacagagagagggagatagagacagagacagagagacagtaaaagaaaatgagaaagacagtaagcaacagagagtgggaggaagagagagacagagaaataatgacaggagacagaaaggccaagagagagaagagagtcttcagatacgggaggtttcccgagtgactcagaacttgtgcttcgaaacagacaagcctgggtcccatcttgtgccatgaattctacttctgcaacacaggatgcctattcaatcttcctggaccttttccactttgcttcccttcttttgtctgggaaatggggaactctgttagggatggtgtgtaacacagggtaggcagtttgtgaaattgccaaaatacattggaaatcctcaagattttgtttttcctttaaatagaagcagccatggctgcaaagattcaagctgctgtctcttccttcagggctgggcagagagcccagaatccaggtgacagaccagcaggatggagtcagggcggagtgcacatcagcaggctgtttccccaagtcctgggtggaacggagagacttcaggggccaggctaggcctgctgtgaccaatctatcagcctcagccaccaccaggctctgggctgtggcatccagcttgacgctctgggacagggctgtggagggtctctcctgctccatctccagccccctcctccctgaaaggaggaaggtggctgagagccacctgcccggtgagtcctctattcagttctgtcctcacaatcactgagcacaggattccgtggccctggacactggggacattaagagacagctgtggggtttgtggcaagcagggatgggtggcaggtccctgtcctcacatggctggggcatcccaggaggtgcactgtttgggtgctgattactgaagaggaacagagataagggtgcagggaccctggggagagccttgcctttgggggaacaagaaatgtacatcctaatatcaacagtttttagggttttttaaaataggctttattttttaaagcagttttagggtcacaacaaattttagtagaaagtccagagagttcccatcttcccctaaccccctcacacaccttcccccagcataaaaaccctacaccagaaggaacgtccaccatgtttgatgaacttccgttgacaatgccgtcagcacccagagtgcagttttcatgagggctcactcttggcatggtgtcccatggttctagataaatatataatgccacatatctgtcatagtatcatacaaaataatgtcactgcccttaatcctccgtgctccgctcattcattcatctcccctaactcctggccaccactgatgttttcactgtctccatagtttccaggtgttctggaatgtcctgtagttgggacggtgcctctgtagccccttcactttgacttccctcactttgtggtacgcatttaggtttcctccatgtcttttcctgccttgataacttgtttcttttgtgaaatgaataacgttccaggatctggatggaccactgtttattgatccattcacctactaaaaaatatcttggttgtttccaaatttagcttttcacaaaaactttcacttttacttttctaaatgatgtcaaacttacagaaactttgcaagattaatagaaaagttgtctgtgcaccctttactcagattcaccatatttttaccttattgcgatatttctttttatcacttctccctttgtctatctacaaatagatatctaatatctacttcctatgcatatgtctaaacccaactgtcttactccatttgtgtgcctataacaaaataccacagaccaggtggcttagaaacaagagatagctattgcccacagttttgtaagctgggaagtccaagatcaaggcgtggcagatttggtgtctggcaagggcacttcctggttcatagacagcgccttctcactgtgtcctcacatggtggaaggggtgagggagctctctgggctctcccctttataagggcaccattcccatcatatccgttacaggggctccaccctcatgacctcatcacttcccaaaggcctcacctcctaacatcatcaccgtaggggttgggatttcaacccctttgggggacacagacattcggtccatagaccagctgtgcaaatacatactattttggaaactatttcacagtaatttgcaaatattatgtccctggactactgaactctttagcaagtttgacctcagaacacagaaactctcttaccccaatattcctggcttctgggaatcttctccagctaccttctccagaagctcccagttcacggcatggaaagcagctctgcctctgatccttgttgccatgggactcgtaatagctggaggcatctgcatcttctggaaacgtcaaagggaaaagaacaaagcatcactggaagaagagagggagtgaagagaaaaggagcagaggcggcccaccagcagcgacaaggctgagccatggcgtggtgagcagggagccccgacaaggcacatcctgcccccccaccccaaatccaggaccctaacacgaagccctgagctgaggcttcgtccatgtgtcctcagacacagtaggaatggggtggccagtggggatcctccctctggcattgcctgattatgatctacccagtgagaccatctgtctcctagcaatccctcaattaagtcttcactggctgatttcaggcaggctggttgggctctgtcttgaaaacagacagatctgagtttgaaccccaagtctgatgggtgtgggctgagggacctggtgtgagccctgagccactctgtctgctgggagtgctgataccatcctgaaagaccaacagagtagcattcagagcaaggccgcgtcagggagggtttacagttgcaatcactgtgattattctcaatattgactgtgtccttcattcattcacttcactcacttcctcctctgtcatttcaggagctgaggacttgttcctagacttcagagccctattttgagagtagagattgtgctcagctggttataaagactgcattatgacagagttgcttgtggtggcttgcagctgtcatccagcattttgggaggctgaggcgggaaaattgcttgaggccaggagtttgaggacaccctgggcaatatagcaagaccccatctctacaaaaaaataaaaataaagaaattagccaggcatggtggtgtgtgcctgttgtcccagctactcaggaggctgaggtgggaaaatcactcgagcccaggagtttaaggctacagtgagccatgattgtgctactgcactccagcctgggtgacagagccagatcctgtcagacagatgaaagaagaaagaaggaaagaaagaaagaagaaagaaagaaagaaagaaagaaagaaagaaagaaagaaagaaagaaagaaagacgaaatctctcagcatttgcttgtctgtaaaggattttatttctccttcacttatgaagcttagtttggctggatatgaaattctgggtggaaaattcttttctttaagaatgttgaatagtggcccccactctcttctggcttgtagagtttctgccgagagatcagctgttagtctgatgggcttccctttgtgggtaacccgacttttctctctggctgcccttaacattttttccttcatttcaactttggtgaatctgacaattatgtgtcttggagttgctgttctcgaggagtatctttgtggcgttctctgtatttcctgaatctgaatgttggcctgccttgctaggttggggaagttctcctggataatatcctgtagagtgttttccaacttggttccattctccccatcactttcaggtacaccaatcagacgtagatttggtcttttcacatagtcccatatttcttggaggctttgttcgtttctttttattcttttttctctaaacttcccttcttgcttcatttcattcatttcatcttccatcactgataccctttcttccagttgatggcatcggctcctgaggcttctgcattcttcacttagttctcgagccttggctttcagctccatcagctcttttaaggacttccctgcattggttattctagttatacattcatctaattttttttcacagtttttaacttctttgccattgttttgaatttcctcctgtagctcagagtagtttgatcgtctggagacttcttctctcacctcgtcaaagtcattctctgtccagctttgttccgttgctggtgagaagctgcgttcctttggaggaggagaggcactctgctttttggagtttccagtttttctgctctgtttttcctccatctttgtggtattatctacttttggtctttgatggtggtgatgtacagatgggtttttggtgtggatgtcctttctgtttgttagttttccttccaacagacaggaccctcagctgcaggtctgttggagtttgctagaggtccactccagaccctgtttgcttgggtgtcagcagaggtggctgcagaacagtggtggctgtagaacagcggatattggtgaacagcaagtgttgctgcctgatggttcctctggatgttttgtcccagaggagtacccagccgtgtgaggtgtcagtctgcccctactggggggtgcctcccagttaggctacttgggggtcagggacccacttgaggaggcagtctgcccgttctcagatctccagctgcgtgctgggagaaccactactctcttcaaagctgtcagacagggacacttaagtctgcagaggttactgctgtctttttgtttgtctgtgccctgccccgagaggtggagcctacagaggcaggcaggcctccttgagctgtggtgggctccacccagttcgagcttccaggctgctttgtttacctaatcaagcctgggcaatggcaggtgcccctcccccagcctcgctgctgccttgcagtttgatctcagactgctgtgctagcaatcagcgagactccgtgggcataggaccctctgagccaggtgcgggatataatctcctcgtgtgccgtttgttaagcctgttggaaaagcgcagtattagggtgggagtgacccgattttccaggtgccgtctgtcacccctttctttgactaggaaagggaactccctgaccgcttgtgcttcctgagtgaggcaatccctcgccctgctttggctcgcgcacggtgtgctgcacccactgtcctgcacccactgtctggcactccctagtgagatgaacccagtacctcagatggaaatgcagaaatcacccgtcttctgcgtcgctcacgctgggagctgtagaccggagctgttcctatttggccatcttggctccacctcccaccccagactgcccaggatgcatagtgaactcactgcctcaggatgcatagtgagtgaccaaccccaaatccagcctggatctcaccccgtaaggatgaaattacaactgcagtaatgacctctggagggcacatgcaaaggccactgctccttcattctaacctcacagaaagcttgcagaagagcaatagggtcccctgcacagatggagggcctaagaagcattagactagctcggggcccaactctgggacccccaaatccaccagtttcccctgcagttccatctgcagccagccattctgctaggtgtaattccatggctgacacatctccatcctataacagtttcccattctctgtgctctggttgggattcttttaagcagcactttccttgtgaactgtataatgaaatgttctatgtctcaatggacatctgtgtgtgcatgtgcatatgtgtacatatgcatacaaaaaaagtggagagcaattcttgttctattttatgcattctcattgggaatgacatgcctccccagggggtgagaattcgttctcaggggctaaaggcatcacagtggctggcagcctctgaagaacctggcacataaacagatacacagtacctgtgctgtggaagctgcagggtcgtggtgacaatgaggaaaaaaaagtcttaaaaggctccttctggggggcatagtgaaatgaagtttgagaaactctcttctctcctcacttctttgctgttgtgagactaaactggaattagtgtttctcagtgtggattctaagaaccttagagcagggtcctgtcctgcagatttctgggccccagtgcagacttaggaagtcagttccatggagtggcaggaatgtgcatttttaatcagctcttctatccatttcctagagctgcctaacacagcactgcacactgagtggctcagacaacaggcatttatttctttccttgatctggaagtccaagatcaaggtgtagacagcattggttcaccctcaggcctcgctccatggctaccagatagtcctctcctcccagtgtcctcacatggtcctccctctgggtgtctctgcatcctaatctcctcttgttataaggataccagtcctactggatcagggcccaccccaataaacttacttaaccttaattacttctcaaaagaccctatctccaaatatcatagtcctcctcacccacagtttcagttacccatggtccactgtagttatttttgttaagatattttgcaggacagaaagaccatattcacataacttttattacagtatattatcataatcattctagtttatttacctttttcaaatttttatatattttttacacacaacatctcactttgttgcccaggctggtctctacctccttggctcaagtgatcctcctgcctcaacctcccaagtagatgaaactacaggcaggcaccaccacaccccactaattttattattagttattgttattaatctcttactgtgccaaatgtataaactttaccatagctatgtatgtatgggaaaaagcacaggctgtgtaggattgggtactatcctcagtttcaggcatccactgggggtcatggaatgtatcccccaaggacaaggggggcttattagagtcacactctgaggtcctggggttagaacttcaacagatgactggggggcaggggatacaaaatggaacccataacaattctcaaaatgctttttcctcaaacctgaaagtgtaaaacctgctctgaggggtggggagaaagaccccatcacctgctaggatgagcagagcgtggggcgatgcagtcattccctcactgaagacatttatggggcacctccctatgcaccagacaggaaggaaggaattacagaaacaaaacctcacaaatatatacaattattacgtgttaattaaaaatatatgtaaagcaaaaataaaatccagagaaaaggaagggggagcgtttggtggtgttggggccaggaacctccccaggtagcctatggcatcacacagtaaagggcaaccccagtggcacatggcccaccccgggagccagggctgcaggttccctcatcccaaaagtgctcgcagggagccagctgcctctgtagctccattcacctctactgcgctatctactgcagttaatccacttcctcggtccagccgccacccccacatctctcttaagggcacaggggtcctccagtgggcttcagtcctgactttgcagcctctagctgtgggatgcggggctgcttaatgtccctgagcctccatctcctcacctataacatggatatatgacgcacatacacacttctcaacagatggcctccaagaggattgaagttaagacaccccgcagagaggactaaatggtaaccctccaaaatgacacttctgtgaatttacaaaagtgatccaatttgaaaaacaggacttcctgtttgcagacttgattaggaatcttggattgagataatcctggatttcaggtgggccctaaatccagtcactggggttacaatctgaatgtttgtgtcccactctccaaatttatatattgaaatctttacccccaaggtgatggtattaggaggtggggcctttgggaggtgactgggtcatgaaagtggagcctcacaaatgggattagtttccttatgagagggacctgtcaataggggaaaatgacgagacaagtctcaatcaccttagaaaatgtatttgccaaagttaaggatgagcctaggagacaggtctatgcctttctctaaagatgattttgagggctcaaaatttacaggggaaagggcgggatatagattagacaaaccgcactctggcacagccaatgaggctcctgagctgcaaagtccttcagcccattggtgggtgcagtatccacagccctgtgcttgccagacagcctctgcagctgtagatagctctgtgttcagtgaccccactctcctgcagcagaacgagacttggggacatcctaccaccaacagcaattggatgggcagtctatccacaggtttccaaaaaggtaagcccggttctcaggaatggcaatagcctgttgccctgcccccactcttctgcacgttgcatcttggaagaagttgcatttgcatttaggaatcaatcgtcagcaaaatgggctcttcctggagttctctgatccatgcacacatacacacaacctagggcaccaccatgtgcaaatcccatgtgcacatctcttgtcaagggcaccccatgtgcaggcccttgtagcagaacaatttttactcagttcagttaccactgaggcctccaccatattcacctttccacatcctcagcagtgaggacctgtcaccacagcaaccaatggctctgtaaccatcccatgcctgtgccctcatggaaccctgtgggcatctctttggcataacagcccaggggtggaactgatgcaatacatagtatcccagtccatgtggacagcctgggcagcttagaaaccaccaaagtgtgctgctcacagctctggaggccggaagtccaagatcaagccaccagcatatccagtggctggtgaggtcaattccttgttcatagacagcaccttctcactgagtcctcacatggtgtaagagatgagggagttctctggggtcccttttataagggcagtaatcccattcatgaactcatcacctccaaatgctccatgtcataacaccatcatcttgaaggtgaggatttcaacgtactaatgtggagggtgggacaccttcagaccacagtgtgggcatgcaaactgcatagtccacaactgagctgttcccaagaacacccccctgcccttgcactctgctgctgggaagtgacctcaaagcccttgggatgccatgcctgacaggagggtctttgtttgcctggtggccttgggtcacactggacagtcccataatgtggtttagggtaggttggctgcactgaagagaacactgtgacatgggggcgggagtccctgagccaagtccagcggcagcaatgtgatgtgcggtaggggccctttgagtcctgcagttcgacttcctctgaggctggagactaagactggccatgtgggaagtcagctatccctaggtgctggatgccagaagagacccaggattctaaggctgggcagtgtccctggttggcagaactccccgtgcagtcacacagggtgcccggaaggtagcacagcccagacaccacggggacaggacagtcgaagctctgttacctctcccggactcccccatgggtttcctcccttggctgacttaaagttgtctccgttccccataataaactgtaacggaaagcgtagcagctttcagtgggttctgggggcttttctagtgagttatagaaccggaggtggttttgggaacaactcacccgacagacatgccgctggtgtgagaaacaagcccggtgttggggactggctccccctagcgtccggttggtctaactgcctttcatatacagcctatacctcatgttactgcgcttcgcatactgcatttgttaaaaattgaaggtgggtggcaaccatgcgttgagcaagctgacctgtggcattttcgcagcagcatgtgctcacttggtgtctgtgtctcattttggtaactcctgcaatatttcaagcttttttgttattgttccttttgttctggtgatctgtgatcagggatctttcatgttaccgttgaaattctttagggatgccaagaactgcgtccatacaaggcagcaaacttaatggaaaaatggcatgtacatcctcactgctcgccagaccagccattcccctgcctctctctctccccccaggcctccctatcccctggcacacaacaatactgaaattgggccaattaatgaccctataatggcccctaagtgttgaagtgaaaggaagagtcacacacctctcactttaaggcaaaggctagagatgatcaatcttagtgaggaaggcacatccaaagcagaaagatgctacttgtgccaaagtcagccaagctgtgaatgcaaaggagaagttcttgaaggaaactgaaagtactccagtgaacacacgaatgataaaaaagcgaaagtcttattgcagatatgcagaaagtgtgcacggtctgaatagaaaatcaaaccagccacaacatttccttaatccaaagcctaatccagagcaagatcctctcttcaattctatgaaggttgagagaagcgaggaagctgcagaagaaaagcttgaagctggcgggggttggttcatgcggtttaaaaaaagaagccatcactgtaacataaaaatgcaaggagaagcagcaagagctgatgaaggcgctgcagcaagttctccagcagatccagctaagatcactgatgaagggggccacactaacaacggattttcaatgcacacaaaacagccttctattagaagcagatgccatccagaactctcatagctagaaagaagccaatgcctggctccaaagcttcaaaggacagggtgactctcttgttaggggctcatgcagctagcgacttcaaattaaagccaatgctcattcaccaattacaacaattctaaggcccttaggaattatgttcaatctactctacctgtgctgtataaatgaaacaacaaagcctacatgacagcacatctgtttactgcatggtttactattttaagtccattaaaatattaaaatagccattaacacaacattcaagtcttattaactttcaagttaacttccataattaactttcaagtcttattatttaagacatttcataaggctacagctgccttagacaatgattcctctgatggatctgggagaaaatttttaaaaacctgctggaaaggattcaccattctagatgccttaagaacattcatgattcatgggaggaggtcaaaacagcaacatgaacaggagtttggaagatgttgattccagccctcatggatgactctgagcgatcccggacttcaggggaggaagtcactgcagatgtggtggaaacagcaagagaacgagaattggaagtggagcctggagatgggactgaattgctgcagtctcatgagaaaacatgaatggatgacaagttgcttcttatggatgaacaaaggaagtgttttcttgagatggaatctacttctggtgaagatgctgtgcacacggttgaaatgacaacaaaggatttagaattgacatcaacttagttgataaagcagtggcagggtttgagaagagtgactctaatttttaaagatgttatgtgggtaaactgctatcaaacagcaacacatgctacagagaagtcttttgaatggaagtcaattgatgtgacaaacttcattgtcttattttaagaaattgccacagcaaccccaaactccagcagccaccaccctaattagtcagcagccaccaacattgaggcaagaccctcccccagcaaaaagatggcaattcactgaacactcagatgatcattagcattttttagcaacaaagtattttaaaattaaggtacatacattggcttttttagacataatgctactgcatacttagtagactacattacagcctataaaagcattttatatgcacttggaaaccaaacatttcatgggacttgctttattgcagtatttgctgtattgcaatggtctagaagcaaacccatggtttctccaaggtatgccttttagtttgaccccagactgcactccaaagcagcggccttattctacactcctcacagcacctctgggctcacctaatgtgccatcatcactcagacttcaacatcacctagtgctgcagttcccaccacccgcccgaaccacccccgccccaacccaccccgagctaaagcagtatctcattatggttttaattatgattctccagttactaaatagtttaagcatctccttatattttgctgctgtcaacctcatgaaataatagctactcagttaggtaatgtagaaggtaaaatggccccaagcatttttatctcctctctttggccacaggatcctgaaactgaaaacgacctttgggtcccaactatccacggctttcccacaaagctctgaaaataagagttgagaaaaaagtattgagctactggacaaatacatcagtgtcttgagaatgtgtcccctaccttccagcaaacaaactgttgcttttctatgcagtgcctggcctcagtttccttccacatgtcacccacagccagcctcggagatcctcctgcctagggctgcccttgaccagagagatctggttgcagcaaagccacagggacaccagtggctcctcagagcttgcgtggtcaagggctgaggaagggcgtctgtttcaagccatttctataaaacaccctgtgggagcagacctgaaggagaggggcaaccgccacacaggtatgggggagaaatgttccctggagatcagaggccgaggcagggcccacctggcttgctgaagaacagagaggccatcatgctgggtctgcagggagcagggggcacagtggtgacgagagaggaagagctcggggtggattatgtagcacttcccaggccactgcgaagctttcccggaatgaatctgagttgctgcagggccttgagtacagcaggggcaggctcttgcttagtttttattttcattgttttaataaatttcattgtgtatatttaaggtatgcaacgtgatgttacaaagtacaaacagatagcaaaatggtcactacaggggagcaattaacattcccatcacctcccagagtcaaccacttttaggattttgtggcaagagcagctgaagtctagtcatttagcaggaactcccaaaacagtgcaattttattacctacattcctcctgttgtacatcggatcaccagactggttcatcctacatattttaaagtagaaacccatctacctgctgggttgagaatgcattgttggagcagcgggaggagatgaggtccccaggtctcctgggcagaagaggacagtgccagtgggccacggtgggggactggcggggagcaggtaagatgaggtcaaggtctttggctacaggaagagcctgcaggattcctttgcagacctattgtggactgttagagaaaacaactcagagacagctctgagatgtctgaggactgcagggattgggcccctgggcaagtctgggatggaggcagtggttggacctggaagagggtttgggagagagacccacgtcagagaggcaagtgtgaggtcaccatggggggctggataggacagagaggccacacgaggatgccaagggttcttccacatgaagagggtggagtggagaggacacaagggagacggaggagcatcagcaaggccagagaaagcccttgtggagggaatgtccctacacaaaaatccattcaaaacagacaagggcttaattgtaaggcctgaaactgtaaagccagtagaagaaaacacaggtgaaaaactccatgacactggcctaggtttcagggttgtatcacttcttgcatatgaccctaaaagcacaagcaacaaaagaaaaataaacatacatgattgcatagagctaaaaagcttctgcacagcaaaggaaatcataaacagagtgaagacaactcacaaattgggatagagtatttgcaaaccatacattaagtagggggttaatatccaaaatatacatggaactcaaactcaatagcaggaaagcaaataaacgactaaaaaatgagcaaagaacctgaagagacacttctcaaaagaagacataccaatggccaacaggtatataaaaaaatgctcaacatcattaatcatcagggaaacgtaaaccaaatcacaatgagattatctcacacttcttagaatgactaatttcaaagaaaataaatgttggtgagtatgtaaattattatagccattatggagaagcatatggaggttattcaaaaacttaaaaagagtaccgtgacccagcaatcctactgctaagtattttcccaaaggaaacgacatgaatatatggaagagatacccacactcctgtgtttcttaagagcacttttacaacagtcaagatacggaatcaacctacgtggtctagaagcaaagtgataaagggataaagtggataaatggcttaagaaaatgtggtgtatacacatcatggaatactatttggccataaaaaaggaaaccctgccatttgcaacatgggtgaatttacaggacatttatattaagtgaaataagccaggaacaggacaaatatcacatgatctcacttatatgtggaatcaaaatgttgatttatagaattagagagtagaacggtggttagcaggggctgagacaagaggatttggggaaattctagtcagagggtacagagtccctgctatacaagaataaactcaaggtctattgcacagcatggtgacttcagctgataaccgtgtactgtacgcagttggccctctgtatctgactgtcccacatatgtgcagagggagggctgactgcagggtacttgagtatctgcagattttggtatccatgagggggtcctggaaccaatcccccttaggcacagagggatgactgtatttgaaattgctgagtgtagatttcaaatattctcaccaccaaaaaaaacatgagatggatacattaatctgtcactccacaatgtacatagatatcaaaacatcacactgtgccccataaatatataattttcttaaatagaaagaggttgtgattgacagggtgggatgttgctggtcagctaggttaggtgaggatggtgaagccactgtcggacctggtgatgtggagacactgatgttgtgggagactctgccatcaggacctgtccgggcaagcatcacaggtgtgcagggcaggggcagggatgctcagggatgacagcagactgcagcaggcggagacagtgagaaagacaaactggaggtctcagggtcgggatgttgttggcgtgctgacaaagattctctacttggccaaactctggccaggctctggaatcttctcctagggccctctttgccctttcttatgaaatccagttttagcaagaaccctaatttggttaaccataatatctgaccaccctcaatggtacctgactgggttcctctctgaccgtttgcagccaatgtctgatcgccctgcctgcctgcagcaaggactctgtgaggtgggtttagccagagccccctcagccctgatgtctcctcacagtcattcccacccatggaccctatactgctcctcgctcctccaacccctgccctgctacgtcggggtggagccccatctccccccaggccccaaggaaagggtcccacacccatctcaatggtcccaatcaaagtcctcctcaccatgctttagcacgtgtcacgaggaagtttcctttgacactggagggtggccagggcagggggaagaggccaggtggacacacggagacgaagcaaacgagctgacacaaacccactttattcagcattgagccagcccacacgctgggcaggtcaaactcacagacatcgcaccaagggccggggactcagaagggctgaaaggcttcatctggaaatgggcaccgctcacaagcccggctatccccaaatctcaacaactgtctgcatctatgtccccgactttgcaatcctgtccccagtgctgagtttctgtcgactaatttatctacacacaaggatgctgcaggcaactgagctactgctacaagctttgcaaaattcaactactaaaggaaatgggaggagggaaagagctagagataacagcaagatgagacacgatggcagggcctggagatgctaaatggggttagccacctgccagccccctcacccagggaaacagagaaagaggcttccttctgcggaggcaggtggagcacagggagggctcctgggaggcacaggagtggggtgggggccaggaagggggaggtggacagagcgacttggataaggctgggccgggcccacgcccacctcaagaggggggccgcctcctcaggaggcatcaaggtgcaatccagtcttcctttctctccctgaagacctgagttccagccttcacagagcgtcatgcgcattcttctttctggatgctaaccccaaatccgacactcaatggtgcacctcaggtacctgccaaggatctgtgggcccacatggaaggtgcagggtctgggtccctggatgacgaggtgaggggcagatgggtgaccagggaagggcatgacccagagctgccgggactcatggaggatgggctgtggctaggacttcaggaagggacgggcacaggtgggaagggtcctcaggtccagcctctaccgggaggtgtttgcagcccccaaaacacgcctcggggtgaaggataaatggacattgttgaaacacgcaactatgtagatggacccaaggccaggcgcctgccacgcttccctggcagccacacgctgacacttcccatggagatgaggatccatcctcctgcctccagctctgggactgccacgggttggcgccatcactgcatgggaggggagagggaaagacagagagacaaaaagagaaagagacacacagagtcagagacagaggcaaaaggagagagcgaaagagagagcgcacatgagacagcgcatgaggtactgtcctgagcacaacaaacccagggcctggcccagacttccgtctccccagggccaaagccttgtcacctatggctggcacgggcaactgaaccgttcagggccatctgggttgctgcagggtctggggttcaggccaggccctgggcagaggcagaagaaaagccctgaggttgggtttcttggctgcttctgccttcaggaccccagggcgaggcaggagccttccatgctcgggcactcgggatgccaagtgccctcctttgtgaaggtcagggacacctcagaccctcctcaacttaaaaccccttcccatcaccttccctgaccacccacccattcccgaaattcagccctgcaaggccacggcagtgggagtcaggctgggcttttaagccttgacttcgggcaatggtcccccaatggctcgctgctgcctgcgtccaccctggcccgatggtgggcagacccagcggggctcccgcacctgcagcagcatgctgaggcccaggttgcgatgcttcttctccagctccgagaccgcctgcagcagtgacctgaaccgctcagtggggtcagccagctcgtcctcagggagcccctcctccttctcagcctcctgcaggaaatgctcctcctcctccacaaagaaggcccgcagcttcttgtagtcggtcagtgccttcttcctacggtccatcacgtgtccctgcaaacgggtggcaggaaaagacctgtgtcctcacccaccctccccaggggaaggggaacctgtttgctcttgaaggagttaagaacatgccactccaaaacatgctgctcaggcacatcgactattaggccaggcacagtggctcacgcttgtaatcccagcactccaggaggccaaggcgggcggatcatgaggtcaggagttcaagaccagcctgaccaacatggtgaaaccccgtctctactaaaaatacaaaaatgagccaggcgtggtggcacgcctgtaatcccagctaatcgggaggctgaggcaggtgaatcacttgaatccaggaggcggaggttgcagtgagcccgagttcatgctactgcactccagcctgggcgacagagcgagactccatctcaaaaaaaaaaaaaaaaaaaaaaaaagccaggcacgggggctcacgcctataatcccagcactttgggaggctgaggcagacagaacatgaggtccggagattaagaccatcctggccaacctgctgaaaccccatctctactacaaatataaaaattagctgggcgtggtggcgcacgcctgtagtcccagctacttgggaggctgaagcaggagaatcgcttgaacctgggaggcagaggttgcggtgagccaaaaaaaaacaaaaaacaaaaaaaaaaacaataacagaagaggcctggcacggtgcctcatgcctgtaatcacagtactttgggaggctgaggtgggaggattgcttgagcccaggagttcgagactagcctgggcaacagtgaaaacctgtctctactaaaaatcaaaaacattagccaggcatagtggtgcacacctatggtcccagcaactcgggaggctgaggtaagacgatcgcttgagcccaggagtttgaggctgcagtgagctatgaccataccactgcactccagcctgggccaacagagcaaggccttttttaaaaaaaatcaaaaaacagtgcaagatcaccctgacctccattctgcttcttaaaagcaaatgaaattcccaagtgaaagacgccctccccatatcaaataaaatgattttatcatcaaggacgacaggaagtcaaggccgacagaatttggtacagaccttgtgaaaacaactctttcaagcatccccacatcatgtagttgcttttttacaagtggctagtctttgtccaagtcagtatataagtgatttaattttgccactttgagtcttcatttcattataagggagcctgtgctgtataaaacttgtgttaaattaatatgcctggctggacacggtggctcacacctgtaatcccagcactttgggaggccgaggtggttggatcacttgaggtcaggagttcaagaccagcctggccaacatggtgaaaccccatctccactaaaaatacaagattagccaggcgtggtggtgcacacctgtagtcgcagttactcgggaggctgaggcaggagaaccacttgaaccaaggaggtggaggatgcagtgaggcaagatcgcaccactgcactccagcctgggcaacagagcaagactccatctcaaaaaaaaaaaatcctatgttttttctcccattaacccatctccctttattttttttttttttttttttttgagatagggcctcactctgtcacccatgttggagtgcagtggtgccatcacagttcactgcagcctcaacctcttgggcttaagtgatcctcccacctcagcctcccaagtagctgggaccacagatgcaacaccatacctggctaatttattaatttttgtacagatggtggtctcactatgttacccaggctggtctcgaactcctagcctcaagcaatcctcctacacctcagcctcccaagttgctgggattacaggcatgaaccactgcacctgaccctgttagtttagcttatgtcagtttaattctcccgcccagcctggggccctaaaaggggagaaatagagttctttctcccctacactgcagtgctcagctgcacaggaagactgtccctctcccatctcccatggccaaggggacagtaaatccttgagtggccctgctaggtctagagcctgtcaggcacgtgactgtcagggcaggacacacacccatcttgccagcaactgtccctgctgtgcccacaccagaactccaatggctgaaaaccatcccatcagccttcaacaaacagcattcacacttgccactcttcagctggttttcagccaactcctaaccttgcaaacaggagagcagagcaggatgctactctgattttactcagtcatggatggcttccacctggccctgggccacacagggcaggtgacacccatagtcatgaggggccaaggcttttgttgctgagaatgcaaatgacagctgggtgtctgctggctggctgatgcaacacgctgcaaactccttcctttggatttaggtggcttctctcatcccagcatctaagccacaaacccccaaaacaggacagattgaaagctccaacctgctaaaatctgtgggcaaaacaattcccttggggtaacacagggttactgaaaacttggaggtccccaaagccttccagcctcacttgcactgggcagtgttgaccactcacaaggcaaggagaagttcagagcagccccaagggcagtgtggagtgccaggggtctgagtggcatcagggaccccatgtgtaacccgtcactgtctgagggaggcctgcacctcaggcctgtggatagcaggcaagggcttggcagcaccaggagcacagagcccacctcagcctcaagctggggtaaaaacgtgggcctcagcctcgagatgcagccagttacccaagagctgctgcacctgtgaaaagcactctgtctttcaggttaaaagaaggagataggaatttatgaaacgcagagaaaatggcacacaggtttttactacacgaggaaaaagtcaccaaatagagtttaaacgactaaagagctttactggtgagtaacctaaaagaatctatgggatgtccccttgggatataatactgtggaaggcacccaaggaaagtaacgctgctctggtctgaatgtctgtgtcctccccaaatccccatgctgaaatcctcatccctcaggtgatggcgttaggaggcaggacccttgggaggtgatgaggttgtgagggtggaactctcaagaacggaatcagtgtccttacacaaaggccccagagacaccctcacttcttccaccatgtgaggacacagtgagaagacaccatctatgaaccaggaaacgccctcaccagacagggaatctgccagttccttcatcttggacttctagcctctaaaaaataatgagcaactctcagatcagaacaagaggaccacagaaaattacagatgtgttctaaaaaagaaaaaaaaaatagcactttgggaggccaaggcgggagaaccgcttaaggtcaggagtttgagaccagcctgggcaacacagcaagacccccacctctagaaaagcattttaaaattaaccaggtgtggtagcacgtgcctatagtcccagaggctgaggtgggaggatcgcctgaggccagttcgagctgcagtgagctacaatcatgccattgcacttcagcctgggtaatgaagtgagactctgtctcttgggaaaaaaaaaagaagtctgatgctgccatcacctacaggtaaaatgtgaggagaaaaagaggcttccactggctttggctagattctatttgagaaatacaaacacatcctaaaaaaaataccctgaagctcacttaagtccagaggcccctcctccaaccaaccagctgagcagttcagaggcctggcccacttggcctggtggtccctttgtctagagccctgagcccacagtcccctcattccaggctgccccaggtccccccacttgccttccacactgcagctgctgactctgcctggccatgcaggtcccgggcgtcattcaagtcctttctcatgatttccacagaccccttgttctcctgtaaagaaaagaaggtcaccaggggtgggcagaagctctgggtcccccaacccagcccagtactgagggacatcaccccagctgactgcacacagtctgaccatcccagagataacctcgaagcccggttgtctagggcaggaacgcacaggcagtcaaaaggtttcttgggcttcacacctattcagaaggatctgggtgctggggctaaggggactgtctaggtgggtttaggagttctgtgtctgtaagtggccctgttcagtgtgagttcggcctgtaccaaaggtctgcacagcctgccctacaccctgccctgcctgagccggatgggggtcgctctgcccggtggcaggacccccaatgcaggaggagcacccagggacacagtctggctggcttcccctcccctgtattgaagagcaggaccccaggctggctgttgtctcctattctgtgtcccacaaccaacccgccatgggcaaggctccagactcccggacccgctgctgccagactctcagagcgggtttctgaaagatgggagaggggacagggggtgcaggcgagggctgggtggcccggggagcagacgagaaggtgggccaggcctgtggacacagtggaatacagaggggcaagaggcgtgatgtctcccccaagggaagagtgagtggaggagtcaatctgtaggaactagagggggtctatgagggcgagacagggcacagctagtgatgggaccacaaagatgggcgctggtgggggaaggacttcgtagaaggtagggggtggggagataaggcaccgcccagcaggggacaccaagacggggaaggggaccagactccgaagagacgcaggaaatatggggaggcaagccgcaggagggaggggcccagcacacgctggagaggggacccgtggcggtgaggggagggggacaatccggggacggggacaatccggggacaggaacagtggagacgggaagggcccagggctcagggggaccggggcgggggcggagaggcgcagggcaccgtccggggtggggcacgggaccccgcggcgcgcaccttgccgcgcagcgccttcctccagcgcggttcccactcgggcggctcggggcccgcagccatacggcaggcggcgcagagcgggccggcgtcggcgcggcacagcagctgcagcgcggcctcgctggccgggccgtcgcgcgcgggcgccgcggccgcctcctcgagcgccagaaggcggcggctgagcgggggcctgccgggctccacggcgcgctgccagcagtcgtcggcgcactcggggcacgggaagggcccgtcctcctcggcccagaagcgcaccacgcacgcccgacagaagcggtggccgcagtcggcgcgcaccggttcccggggcgcgcgctggcacagggcgcaggcggcctcggcggggcccgcagggagcgccagggctgcgggcggcggggccggcaagggcgcaggagcggctggggagggccggagacctagacggccggcgaccggacggagaccagcaacaggacgaagacgccaacgccggggacgcgcacggggcggggtcggggacgcgcacggggcggggtccggaccgcggagcgctctgccgataagatcctggcagcggtgtgctgcagccggaggtcctggccgcgctgcgctccacagacaagatcctggcagcagtgtactgcatccttaggtcctggccgcggtgggcttctccgcctggatcctagcggcggtgcgctcctccgccttgattttggcaactatgctctccacctgcaaggtcctggcagcggcgcacgtcaccgcgcaagtcctggcagctgcgcgcttcactctactgcctgcggaccggcccaagtcgtatcctgaaatcttactgggctgtcccttcctacttcagtaactcctgcgaaagagggaaacaaagttttatttttacttgaaggttccatttttaaaaggttgtttttgtaagctgctaggatctgagctgcgcgtacccccgcggtagctcgcccgcgtgggctggggacggggcgggaaatggcctgcgtgggcctcctccgctgctctcatcctgcacggacccgccctgcatgggcacgccctgcgtgcacgggcctgcccgcgtggacgtgccctgcgtgcacccttccttcagggacccgcccttgaacggccctccggacgtggacactcgtatacgcccaccctgcgtgggatctccctgcgtggacccatcccgctgagcctcttctcgcgcagcctccctctggccccctgggaagctaccctggttgtccgctgtctcctggctggggggagctctcattgattctgtgatgatgcatgacagaagagcatttgttagctttgctttgcttttctttcttttttgagacagcctcgctctgttgccaggcaggcttgagtgcagtggcgcgatctcggctcactgcaacctccgcgtcccgggttcaagcgattctcctgcctcagccccccgagtagccggtattgcaggcgcctgccacgacgcccggctaatttttgtatttttagtacagacggggtttcaccatgttggccaggctggcctcgaactcctgacctcgtaatccacccgcctctgcctcccaaagtgctgggattacaggcgtgagccactacacccggccgttagcttttctttaaaaaataaatttaaaggaaagaaataagcctttgggaagagcaatcttgtgtttttgttttttaattattttgaaaacaagcaagcatggttaaaataagattgtgcaagttttgcattttaaaaaattaatctgggccgggcgccgtggctcacgtctctaatcccagcactttgcgaggccgaggcgagcggatcacaaggtcaagatatgagaccatcctggctcatggtgaaaccccgtctctactaaaaatacacaaattagccgggcgtggtggcgcatgcctgtaatcccagctactcaggaggctgaggcaggagaatcacttgaaccagggagtcggaggttgcggtgagccaagatcgtgccactgcactctagcctggcgacagagcgagactctgtcttaaaaaacaaaaacaaaaaaaaatttttataaatctgtattccaagcaagcgcaggatctaatgaggtatttttgtctttgtgaagattttttaaatcgacttggaaatgcactagatgcccgtgggaaacatgaatagtaaaccgaggttatttctgtgtagtaaagattagaggcttccagccgagccttgctgatattgttgagtcaactaggaacttgctggagagaaaagtaaaaaatataaaaaatgagcaaacttcataatgaactaatcttgtgaatgagaaaatatcaaaaattataattaaaggcaaatagccaaattaggaacattgtaaccacaaatatacaaagagtttataaaattaggtaaggaaaagcatgatggaaaatacaccttgtcatgggatttttcaaatcacaaaaaaaaaagcacacaaatgattgaacacacatgagaaaaaaatgtacactctgcccagttaagaaagaggaaaataaaacgagactctctttctttccactattaagtaagcagaccaaacaaaaaaaaggaaacttggccgggagccgtggctcaggcctgtaaacacagcactttgggaggccgaggcgggtgaatcatctgaggtcaggagttcaagaccagcctggccaacatagtgaaaccctatctctactaaaaatacaaaaattaggctggatgtggtggcacacgcctgtaatcccagcactttgggaggctgaggcaggtggatcacaagatcaagagatcgagaccatcctggccaacatggtgaaaccccgtctctactaaaaatacaaaaattagttgggcatggtggtgcacgcctgtggtcccagctacttgagaggctgaggcaggagaatagctggaaccgggagacgaaggttgcagtgagccgagatcatgccactacactccaacctggcgacagagcaagactccctcagtttcaaaaaaaaaaaaaaaatacaaaaattagccaggcatggtggcacgtgcctgtaatcccagctatttgggtggctgaggcaggagaatcgcttgaacctgggcggtggaggttgcagtgagccgagatcacaccactgcactccagcctgggcaacagagtgaaactccatttcaaaaaaacaaaaaacagaaaacaaacaaacaaaaaaaacacttgattctgtgaatactgcttcttgtaatccacgtagcagtatcgattaaggattttctgattggaattccttttcttagaaaacaaactataaaaataacaggaaatgaaaataataaaaattgggttgtaaaaaattgggctgttttgttttgtttagaaatgtggctgggagaggtggctcatgcctgttaatcccagcactttgggaggctgaggtgagtggatagcttgagcccagtagttcaacaccagcctggggaacatggcaagaacctgtctgtacagaaaatttttaaaatttagctgggcgtggtggcacgcacctgtggacccaactacttgggaggctgaggtgggaggatcacccgagcacaggagattgagcctgtagtgagccgtgatcatgccactgcactccagcctgggaaatgagagaattttttaagaccttgtcttaaaaaaaagaaagagagagagagagagagagagaggtgggggcggggggtgggggagagaaggaaggagtggagggagagaggaaggaaggaagaaagggaaaagaaaaagaagaaaggaaggaaagaaagaaaaggaaggaaggaaggagaaaaagaaggaaggaaagaaagagagaaaggaagggagggagggaggaagggagaggaagaaagagaagaaagaaagagaaatgtatgtcatatcactattcattttggagaaaaaaaaaaaaaccttgaaggtccaatactaggggcatggcttagcaaatggtagcagccatgaacttgcacatgtgtgcattagagacttttggaagtatacactggcaaagattgttgcctgaaagcctctctcccttaccaccagcagaatccacattgtgtggtgccagcatccccacttcccaagacagggtggctggtgtaggtgccaaggggaacccttggtcctctcaaattttgatgaaaaattgcaaaaggctggtcgcggtggctcacgcctgtaatcccagcactttgggaggccgaggctggcagatcacaaggccaggagatggagaccatcctggccaacacggtgaaaccccatctctactgaaaatacaaaaattagctgggcatggtgctgcatgcctgtagtcccagctactcgggaggctgaggcaggagaatcgcttgaacccaggagacggaggctacagtgagctgacatagcatcactgcactccagcctgggtgacagagccagactctgtctcaaaaaaaaaaaaaaaagaaagaaaaattgcaaaaggcagatcaattggagaaaaggcagacacatttatttactgtgtctatacaaacctaaagatatgggggaaatcgtcctttttttttttttttttgagacggagtcttgctctgtcacccaggctggagtgcagtggcgcgatctcggctcgctgcaacctccgcctcccgggttcaagcgattctcctgcctcagcctcccgagtagctggactacaggcacgtgccataccgcccgactaagtttttgtatttttagtagagacgggggttcaccgtgttagccaggatggtctcgatctcctgaccttgtgatccgcccacttcggcctcccaaagttctgggattagaggcgtgagccaccatgcctggccaagatatgagggaaatcatccatttttatgcttaggttccacaaggtatggacagccatgcagaaatagaattgggcaaatagggtcggagctaatgagaagagcctaagtggggacacccagccaggcctgtctgtctagattcttatggcctctctgagcagtcttccttccttccttccttccatccaggaccctctctggagtgagggtcttaagatctacagtctaacaaggtaggtcagatcatttcttcatggctgggttttacacagaaaggcagaaagaaaattagagtcatattttttaagtgttatagctggctttgggttctagtttctatgactcaccttgaggaagagggattctagtttctatggccagacaggggagaatgaggggctagagacagagggccagagaaggtcagagaaaactttttgcttctgaggctgcttaggatgtcctcattttgggtcttgttttctgagcctcctggcacttctctgtccagcctccctcctctctaccctccagattagagactgagcctgatgccgtttgagcactcagttgggtggggaaagagtactcctcctccctcatgtgcctcttgaactgtttggaaaattgaaggctttcactttctgatcagagacaggatcaaagtgggcagtgggttttttgtttgtttgtttgtttgtttgttttttctcagcatgacatctcatagattccacaaagacagaagaacattgacgagtcttggatgtctctgggctcttgaattcccatcgcattggcatcaaagaactgaataagacactgttccgccacaaaacggtgctggatgctgaaccatcatcttctcaggataatattttcaactgattaatgtaaaatgtttggggatttcactggcaaccacaaaagcatgtgaatattttctctaagagtgcgatgaagtcttttttttttttttttttttttttttttgtgagacagagtctcactctgtcccccaggctggggtgcagtggcacaatctcagctcactgcaacttctgccttctgggctcaagcaattctcttgtctcagcctcccgagtagctaggactaaaggcacctgccaccacgcccagctaatttttgtatttttagtagagacagggtttcaccttgttgatcaggctggtcttagactcctgacctcaggtgatgcacctgacctcaggtgatgcacctgccttggcctcccaaagtgttgggattacaggcgtaagccaccactcctggccagtcttttttttttttttgtaaggcaacagaaacaaccaaaaaatggatgactagaagagaggtaaacgattctaattataggaaatttttgagacagtcttactctgtcacccaggctggagtacagtagcatgatctcggctcactgcaacctccgcctcctgggctcaagcaattctcctgcctcagcctccctggtaactgggactataggcacacactaccacacccggataatttttgtatttttagtagagatggggtttcaccatgttggccaggctagtctcgaacccgtgacctcatgtgatccacccgcctcagcctaccaaagtgctgggattacagttgagagccaccacacccagccttaattacaggaaattttaatcccacatttcccttgtatatttgatgtgtcttttgttatatgtattttatggcattgcgggttaccctgtttaaaattgtagtctcacaaatcagagtgtacaaaaacgaatgttgaagaggccataagctgtgtatttaaaagaaatatgggagatgcaaggatgtttggataggaagatatgacttgggaaatctcatgtccggcacagggaaaaaggaatctgaagtaattaattttcattgctcctaaaaggcgaaatacaactaagaaacacaacttcctacgtggtatgaagtcactctgctcttctgcctgagaaaattgtcagaatagaaatggagtcacgaatgttcacaaaaccctgaccaataggattggagaagtcctgaagagaagatttttgggcttgcatgcctgatttaaaaaaaaaaagagactacaaaaaccacagccttgctcagaggacatcgccagggtacacaaaaaagacatttgcaaggacatctccccagtaacctcctgtttaacttcggactggtgtcacccttgttattgatatttctaaccacagataattatttcaaaacaattatgtaattcttcttatttttttcctttaaaaacctttgtcttcctttacctctctgaatacgcacttactttttactatggcacacgtattcccattgcaatgctttattcccaaataaatttcttttagagagcttgtctcggtttatttcagttgacaccaaattttctatgtgtaagtgaaaaaaaggtaggggggaatcataaagtgtcaaaatggagagatgtcttccagatggttcagtccagtccctgtgtcttactaaaggagactaagcatgttaacacacacacacaaacacacacacacacacacactccaacctgctgaaaataaagtctctttttaaacatttctgtctacattgttctggtgttagaattgcactggaggacgcccagctggtgtccactggggaatctgcagagttgcttgcttggtgtgtgggaaaacactcctgccaacatctggtggcagaagggtcatgttgagtggagagttggaaaaaaacatgtccattgatttttcctgtatgtcttgagttgcaggggatggaaacccctttcctttaagcaaggaaaatgggtttaacaggcaaggtacttgggagtgtgtgtgtgtgtgtgtgtgtgtgtgtgtgtgtgtgtgtgtacataagagggggcccacacaggctggtgataaaggtggactctgagctgagatgtatgctttttaactagagccttgtgcctgagtagagtagcatgcaataaatgatacctgagcagttctgtacctacaccagatctgtttggagggcacaactcatgctgcatgtttcaaccacagtcaaataaataatacaattcaaaatgtcttcttggctcttcaatctcacatgcatttaggcaatcccacccttgcctcactaaaatgagtgcccactgatgaccacaaccttatccaacatggttctcaaatcgaggacacattacaaatgggctgatggcatcaactcccacaagcctctgtgtgctgctttgatgtgtcaggagctttaggttgcgggtgacaggacctaactgcagatggctgtaaatgacagtggaggagggtggcctgtggctcctgagactgcaagtgcagcctgatactgtcaggcagtgtgagccctgggagcctggggatgtcccaggacacacacttcttcctccgtccccttcctcctgggtggtccccctacagccccaggcaattgtctcctcaaggccaaatggccaggtcgggcttccattgacagccactccagcccagcaaatcagagctcccctcctccagatatccagggtgggtgttgggccaggcactgatgccattatcatgaccagggaagggcctgaggacccagtggtcagacctcccatcatgggctggaaccagctccggccagagaaagaggatgcattcgagcagggcccaagcccagagccacacaccagctaggggccaagggagaaaaggaaggaaatgacgaaggggcctgattaaaaaagaaaaaaaaaaaaaaaaaccacagccttgcacagataccatcgccaccacagacaaaaatgagggactgtggtcacctgcagggccagagacagcatgggtgggctgggctaccatccatacctcaacatccaggagccctggcctctctcactgcaaccctccacgcaggcagagataacgttcacaaaattaactgctacccttaaagatggcgaatattaagctaactgtattatccaatattatggatagcctttgcataatttttaaacctttcaacttaaaaactcatgtcaaaaccaattactcaatgtttcattttaaatgcaattgtaatggtaatcttttcaatatttcagatgtcaaaattgctcaaaaaattaggattctaaatatctaaatatacccgtgaaaggaaaataaatcttggggccccaaagtcacttggctaaagagaaaagtcaagctgggaactgcttagggccaacctgcctcccattctatttaaagtcacccgtctgctcactgaaatagatgcatatctgattgcctcctttggaaaggcaaatcagaaactcaaaagaatgcaactgtttgtgtttcacctatttgtgaccaggaaggcccctccccactttgaatctttctgcctttgcttcaggttttcctgcctttccagactgaaccaatgtacttacatatattgactgatgtctcatgtctccctaaaatgcataaaaccaagctgtgccccgagcaccttgagcacttgtcgtcaggacttcctgaggctgtgtcatgagtgcctgtcctcaaccttggcaaaataaactttctaaattaactgagacctgtctcaaattttcagagttcaaatacctaaggtatttctattttatttacttacttaagagatgcattctcagtgtcctttagttcaatctaatccttatgcctatcaaaagacaaaattacaacaaatttagagacataatgtttttaaaattattattattattattattattattattattttgagacagggctttgctcttgctctgttgcccaggctagagttcaatggcgcaatgagggctcactgcagcctccacctccctggctcaagcaatcttcccacctcaatctcccaagtagcagagactacaggtgtgtgccatcaagtctggctaagttttaaaattttttgtagagaaaaggtttcaccatgttgcccaggcttgtctcaaactcctgggctcaagtggtcctcccacctcagccttctaaagtgctgggactacaggcatgagccaccatgcctggcctagaagctaagatatttctaaactgaaagtaataataataataggtattattattattattctaagcctttgattcactatatataaagcaattccataatcctgacccaagcaaatttggttttctctcccaggtccctgaagtgaatgaatgataatctctgttcagatcctatcacttggttcccagcttgaaccgggatgttgacaaaaatacggactagagcacaaaagggccttgcttgccttgcacacccttcagacataagttacagctctgtggtttcttccatctaaaacttgcaacctccctgtctcaattggttcaggccgctgtgaaaggaagatagttggaccccttcaggctgggaacctctcaggtcaaatctacctcacatgctattcagtcatccctctgctcacagagatagacgcatattctgattgcctcttgggaaagacttatcagacactcaaaagaatgcaaccatctgtctctctcatctacttgtgacctggaagcccccagtacagtgtgggtggggcggccttgttttgagctgtctccgccttttgggatggagctaatgtacttcttaatatattaattgatgtctcatgtctccctaaaatgtataaaaccaagctgtgccccaaccaccttgggcgcgtgttggcaggacttcctgaggctgtgtcacgcacatgtcctcaaccttggcaaaataaactttctaaattaactgagacctgtctcagatttttagggttcacaccaccataacactgcagcagagagactgggtgccataaacaatagaagtttactttctcatggtgctggaggctggagtccgagatcaaggtgtgaacaaggtcatttccccctgaggcgtctctcctgagcctgtagatgcagtctcctccccggtcctcatagggccatccctccttgtgagtctgtgccctaatcccttcttatgaggacaacagacctatgggagtagggcccaccccaaggaactcatttacctttatttcctctttaatggctctgtctccaaacacagccacattctgaggtcctgggggtaggacttcaacctgtgaatttcaagggacataattcactttataacagccccctaccccaacaagcaggtgagcaccagccaggtttcctcccagctcctgtttgaactggacttgctggccctctggggatacttggattcttgcactgactgagggtttgtgtgcatctgaggtcattgttgacgacagccctctctctagacatgggacatcataagatgtgggctagccaggtgcggtggctcacgcctgtaatcccagcactttgggaggccgaggcaggcagatcacctgaagtcgggagtttgagacaagcctgaccaacatggagaaaccccatctctactaaaaatacaaaattagccaggtgtggtggcacacgcctgtaatcccagctactcgggaggctgaggcaggagaacctgggaggcagaggttgcggtgagccgagatcgcgccattgctctccagcctgggcaacaagagctaaactccgtctaaaaaaaaaaaaagagagagaaagaaaaaaaagatgtgggctaactgcacagacctagaaagttgcggggcaggagcatcaaggatcaggacattactggtgtgttatcagcattgccctgcttctgatcaacagggtggacagcttaggagccaagggaaaacttcccctttatcttctgaagttttgttataaaatcagctgacagaaggcagattgctaggaggaaaggcttacacatctattaacatgcatggggagaatcacagggtggttaccccaccatgcaatggggtgcagaggcctttattctcctcttaggggaaagggagataaggaagtgtgcattattttagggggatagtaaatattttttagggaaattcaacgggcttgaagaacatacaatggtctgggacagtctgttggtttgtgacaaagacagcttctaccagggccaattttatagctaaaaaatatatttacagctagaaaaaaaaggtctgtccaggcatgttgaccgacttcagtcctcattcctgtgatgagagttcagccgtttgaaactcagggaagggatcggaggccattgttttctgctgcagcaggtctgcactttaggcagataggggaatttcagagaacagcttcatccagtgctttgggagagacagaagattgggagacaggaaggaggggaaggtcagagagacctggaggcttcttattcagttcagcatgtcaaagcgctggggtatcagtttctgagccccaaaaagagcaaacagcattcctggcaggatagaggaatgcaagtgtagtaaccatgcctttgattttctatattttcagaggctttgacatccagggcctcactggccatggagggacagcttctcccggggacaattttatagctagaaaaaaaaatttacagctagaaaaaaaaattactgggattgtgcatttcatatacaaactcaccaacccagagcccacagccccaaccactcatctatggagctgtcacactccaggccactatcgttctctctctgttattttggttggcactccaaattttctatgtgtaaatggaaaaagggtgagggggatcacaaaatgttgaaattgagagatgtctttgaatggcacagtccagcccctgtgtcttatataaaaggagactaaaaggagtacatcaggttaatacctacacatattgccaacctgccaaaactgaagactcttttaaaaatttcccatttgcatttttctgctgtcggaattgcattgcattggaggacacccagctggtgtccactggggaatctatagaattgctttcttggtgtgtggcccaaagcatcccaaggttaggtacccagagcctgctgggcttattcaaaccagccattgtgagctagcttagtctgccttgcctgctccttccagtgaaagccacagtaaaggctcctgcccacactttcccctccctccatctgcctcttaactgaccctggcgctatccctcgtggcatcgaaggcttagcaatagcaaacccctcctcttgggaactgtgagtaataaactatcttttcaatggtgtttgtctcctgatctgttggcctcactgtacctgagtaattttttttttaattttttatttttatttttattttttttgagatggagtctagctctctctcccactctggagggcagtggcacgatctcagctcactgcaagctcctgggctcacaccattctcctgcctcagcctcccgagtagttgggactacaggcgcccaccaccatgcccagctaattttttgtattttttagcagagacgggatttcatcgtgttagccaggatggtctcgatctcctgacctcgtgatccacccacctcagcctcccaaagtgctgggattacaggtgtgagccaccgtgcccggcctttaattctatttttaaaaagtgagaggaggcccagaagaagagatggcagggagtcctggctgggctgcaggattaggattgtgggtggggcatccagggaccatgtacatagtgagggcttacacaatagagatgtgaccaggtgctggaatttctcagtgccccaatgcagaaacatgaactggttggagggagaccaagtgccagggaggaagttcctaggccagatgggggactcatctagaatgcctgcccgtgtgtgagcagcaccatggtgctgagctagggagagaagtgtggccattgactagaaatggagaagagtgagatgacaccaccagggtttctatgtggtgtgcgtcccttggagtggagagctggggtgagaaggtgagttcagttttgtagaagattcagcttgaggctggagcctttgaggagtgtttttaaatctcactgggggccggacacggtggctcacacctgtaatcccaggactttgggaggccaaggcaggaggatcacttgaggtcaggagttcgagaccagccccctgaggatgtagagtaagaaatgttaggtaggtgtgtggatatcagaaccacattttgggaaaccctctccccaaaaattgtatagcccataaggaggaatttagggaagttgttactacaggtggggacagggtggtgttagaagctagacaggaagaacaggagggaaaagcattcagaaagcacttgtgtaattggatgcacagctctcccttggacaaggcagcgtgggttaagggtgctgacccctgtccagttgaaaatccaagtataacttttttttgagttggggtctcactctgtcgcccatactggagtgtaatcacagctcactgcagcctcgaactcctgagcccaagcagtcttcccacatcagtctctcaaatagctggaaccacaggcctgagccaccatggccaggtaaattttgtattttttatttttttgtgcagatgtgatcttgctatgttgcccaggctggtctcaaactcctggcctcaagcaatcctcccactttggcctcccaaaatgttgggattacaggcgtgagccatggtgcctggccttcacatataatttgactcccccaaaacttaactactaataggctactgttggaagccttaccaataacataagcagtcgattgaggcaaattttgaatgttctatatattacatactgtgtccttacaatacggtaagctagaggaaagaaaatgttattaagaaagtcctaagaaagagaacatgtagttactattcatgaaaaggaagtgaatcatcataaaggtcatcctcgtggtcttcacactgagaggctgcagaggaggaggaaggagaggagggcttcatctcgctgtctcagggataggggtagcaaaggctggagaaaagcggtgtatcggtaaccctcaaaggtcaaactctggttgctcaagggtcagctgtacagttgagaacccatgcaggtgtaggcacagggtagataaacggttaaaatagcaaaccaaacaggccacagccctcctgctagagaaagtataggagtttcttacttttctggaaggaagaattttttgattacgtgttagaatttatttgatggtccagcacattaatgacatcatgtagggggaaaataccctccaccccatcaattcttagttgaaactgacccctgttataaaagacacattagcaagaggcacaaatagcagcttactagcagctacctttcctagatacatgcgtggcccccagagaatgggtagtcctcaaagaggtggctttgaattcccgcttttatggtatcttcaacaaagaacagtaaatctgcagagaagtgacaagataagagagatgaactttgagtctctaggaacagcaacttggagaaaggcacataaaggacacatgaagtctagttagtagcccttgctaatgcagatcccctggtagcatctccagtcaataaaggtgcaaagttgtcttcagtgctaacctcccttctccctggtgaagtggggtgggggctggatgccttctgtaaatccatgtcctgcttttagccacccagagggagggcagtgagctctcctgtatactttcttctccattgccctgagcccaacaatccctcatcttgcaggaggcatattctgctcttccactggaacaaaatgccccctaggggtgacttaagaagacagcagggtgcagaatctgaggctacaaaacaagactagaagacttggctggggagtccagtctagactcaggttagcttttttttttttttttggaggcagtatcttgctttgtcacctacgctggactgcaatggcacgatcacagctcactgcagccccctactcccaagctcaagcgatggccccgcctcatcctcccaagtagctgggggacgataggcgcaggccaccacgcccgttaactttttaaatttttttgtagagacgaggtctcgctatgtcgtgtcacccaagctggttttgaactcctggccccaagtgatcctccagcctcctttggaggacacagatggacagggacccggtggccagcccattttcccatcccggcctgggaaagaagcgtcaaatgcactcgggaaaataacccacttcacctagttaatgtcttgggcggttctgggaaaagcgtttctgcgcagtccagagacctggaccttcatctccagcctgcgccccacggaggcggcaccggagccggcttccttaggtgtgttggtgacgtgctgggcgggtctggcggaccagcctcgcacctcctcgggcgcaacgcgagtgggttccgtcttgggttcctgcgcgaaggggcagcccaggctcagggcatgcggcgccagggtgctctgcttcacgaatgccggggtaccgcagtgctggggtgccggacgcaagggtgtcagatggggtgctgctgggattataagggtcaccagttgcagggatgctgggggtgctggggttacaggggtgtgggggcagaggatatgaatgcaggggtgcagtggtacccgagtgcagaagtgcaggggtgccgggagcagagttgtcaaatggtgtggtgctgagttcacaggggtgccagggatagagggaagccccggcaccagagtgcaggagtgttgggatgctggggctgcaggggtgccggggaagatgggtacgcagtgcaggggtgccgcggtgctgtgacgccccaatactgaggggtgcagtatccagttggttctaaattcattctcacccgcctcacaccacaaaccaattggctgatgcgccttctcgagctttccaaagccacccttcattccgctgcctctctgcgaccctcggttttatttctgagtttggaatttgttgtatttcatgcacgtttgcgccttaatgttttctccccaatctttgcatgtcaccaagatttctcgacccccgtgtggcacagggatgaggctgcttcggggtttacagggtggaggaggccggcttgcgtgttcctcagggtaaatcggggatcagtccagctcccctccccacccatcccccggagcccctcccccaactcctgctcccctccccgccaccctcccccaccccccttcctccccgcatacttcttgtctcccatctgagagcccctcccctcccaacccgccccaccccggtatcccccacttgcccacctcctcctgcactccccctgcacccctcctagcccaccgtagggcacccctccccgcacactccccggctctcccttccctggtggaaaccacctctcctggttaaataataaatatttattatttattatttattacataaaattcccttatgtcttgtgataggtacgttgccggtttccatatcttctccaaatgctgcttgaagccaccagcttcgcagtcagcagcccgtaagatatttaattgcagtacgtaagaagagaaatctgtggtataatattagcttggggaagggagatcactggccttgaagagcttttcgccaaaagctactgtagggcaggagctgcttcgctgggtggacagggccaccaaaggccgccgttcaggttaccccaaacctgctgctcagggagcacgcctcgggttcccaggctggtgccctcgcccgggcctgcctctgtttcactgattggctttcatgctcctgctttgcttctgcatccacaccacctgtcgctggcatttgcagctcttttctaagtgctgaaatgcaatggaaatgagcacaaaagctgctcctgcggacgtgggcgctgggaatcagccggtgtgcctcctcgacttggtcagagggcctgccctcttgggcatcaggtccccgggggcaccggcctttgtcccccgtgctccgagcgctgggctggggagctcccaggtgctggcccggcgcaacccggtgcctttaagcagggtgggggcgcgccgggaggaggttgctctcaggcgccccaggagtcgcccctgatggaaacgcgccttggctgtggcaggagggcctttgtccataggatgtcaactggaagccctgagaagcgcaaggctgcccaaacccttttttccttctttgcaatcctgcaagcattacgggaggccccaatgttccctgcagaactccatagcacaccctgtcatttcagccactcccagttcctccgctttaaatcgtacaaggttccctctagtccttgagaagcctggaagcctgtcctctctgtatctgtagggtgctgtccctcacacagatcccactctaccggtggggtctggatggagcatgtgcatttgccattgcaacgtgcaattttattaaatgcttaaaaaaatagagacaggggtctcgctatgtttgctaggctggtcttaaactcctggactcaagggatcctcctgcttgggtctctcaaagtgctaggattacaggcctgagccaccgtgctgcacctgtattaaatgcttgtttgtaagacttaaagggacctggcttcttggctggtggggaaagcgctcactgcaggaagccctcatcctagtagagaagcatacatcatctagagctgcacaaaaatctaaggtgtaaagatggactgatttcatgcattcagttattcattcaacacatttgtggactggcttccagcccaagtactgtactctagaacgattaaagaagtgcggggggcaggggggaggtgtttattatttttcttaatcatctaaacctggtcactaagctagaggccactgtttctttttcttttttctttctctttccctgtccttccctccctccgtctccccaactgtccctcttctttctttacttccttctttctttcttttccttccttccctctcttcttttttccttcttttcttcacatgaggaaagcttcaagtttactccatagtgtccgtctgccaatacatcatgttggtcttgatccgagacactgtctcaattggctcaggctgttctaacaaaatgctacagaaggggagacttaaacaacagaaatttatcaaagtctttgggggaaaagagacctgtgtgggaaacatagaaaaaccctgtctctacaaaaaaaaaaaaaattagccaggcatggtggcacgtacctatagtcccagctacttgggaggctgagataggaggattgcttgaacccaggagtttgaggctgcagtgagctatgaatcacaccactgcactctggcctgggcaacagagcaagaccctgtctcaaaaaaaaaacacacacacacacacacacacacacaaaagacatttaatacaaactgcacattacagttacataacacatacattttgtgtcgttattttcccccaaagagtgctgattatccaaggctagtagtctgagatcagggtgtcagcagggttgggttttgtgaggtcattcttactggtttgcacctagccatcttctccctgtgtcctcacatggtgctagaaagcgatatcctaaaatgaagacctctgaagcaaaaaactttctctgatctcctgccttcctgtctcagtcccattctcccccagactggccatagaaactagaatacctcttccccaaggcaggtcataaaaaccgcaaccccttttccccacagccagacacaaatcctaaaaatattactctaactcctgcctttctgtgcaaatgctgaccataaattctctgggccaccttgtctggttgtacgtcataagactcccattccacagagggtcctgtctcatacccaagaggaaggaatgccacgcagagaggccaagaagaatctagacagacagggcttgctggatgtccccactcagtgtattagcagtagatcatgcccaatcctatttctacatagcagtccatattttgttgaacctaagcattaaaatagacagcttcttctgtattcattctgaaggcttttttgtcacactaaactatgatcaaataaatgtgtatgccttttctcttttaatctgtcttttgtcagctgatttttagtgaatcttcagagggcaataggaaagtttttccttgggccctgcagcagagagaaagagaaaagcaagctgtcttgtgtctcttcttataagggcatgaatcctaccatgccactccaccctcatgacataatcatcccccaaaggccccaccttctaacaccatcaccctggggatgggggttttcaacctagaaatttggagggaacgcagacattgagtccctagcaatcaccacccatgagaaccaggactgatttcctgacaccaccaagcagccaccatatggtgggcagagcaaatcctaaatcttagtacctgaaagacatattcttacccaaagtccttagaatgcccacctcctgtcccactccaagttttgtttcaaacctttccacaccagtaggaagccaggaagccttagtaagaacctggtgggaagaccagcatctcactgggctggcaggaccaaggcaagcagtgctatatatgtacatatattaacgtttgttaaaccatggtgaggaaggcttcattcaggacggtggagtaggattaggaccattgcagtgggattctgcagcagggtagagagattgggctcaattctgagtaccgcactgacaagtggaaatttatagacaggagtagggtagattagtggatagaacagtattaagaggagacatcagggccaagtacggtggctcatgcctgtaatcctaacactttgggaggctgaggagggtggatcacttgaggtcagcagtttgagaccagcctggccaatatggcaaaaccctgtctccactaaaaatacaaaacttagcctagcatggtcaggcatgcctgtaatcccagctactcaggaggctgaggcaggaaaatcatttgaacccgggaggtggacgttgcagtgaactgagattgtgctactgggcaacagagcaagattccatctcaaaaagaagaagaagaagaagaagaagaagaagaagaagaagaagaagaagaagaagaagaagaagaagaagaagaagaagaagaagaagacatcaggtgtgagggggattctgggtaaacgaacctcacatggctcttgctggaggcaggcagggtgatcagatatcacctggggatggaggatgaggaaccccatcagatagcacagagggcgatcagatattcagaatcaggggttctagttaaactgacttagcggggctcttcctaaaactggatttcacaagaaagtgcacagatggacccaggaggaggttctggagcctgaccagagtttggccaagcagagaatctttgtcaaagggctgtttgagaactaaattgaatcaagtatttattaagtggttacctagccagctcttagtgagcactctagaaatgcttggtaaatcaaccacatatttcaaaaggaagcagataaagtgcttaatgctgggtatgcccaaagccattcagggaacccacagtctcaagatgcccagaagacctcagaggacagacttgaatgtagagggtactgcctcagctcacaggcttattcacaagcagatactgactgggcccctgctggtgccacactctgtgctctggagcctcagacatgaaagccacatccttccctgtgagttaagcttagtcagcatgctagtgggagagaaaggtttgtgctacatatttacgtgatggatctgcccggggcatagagcaggctctgctgaggtagcccaagctgcttatggctggatcagtcctaagaaggaaaggcgctaacaggaattaagcacaaaatagatgctgggcaccctgcccgctgcttcacactcattaatgctcagcaacgctatcaggcgggcactggcagccttatttcacagatgagtatatggaggtgtggagaggtaaattatctgccccagctagggcagataaatgacctccggactagggcttctcaaatcgtcaagtgcacacaagtctatttaaaatgcaaattctaactcaatcagataggagtgggcctgagattctgcttttttaaccagctcttcagttgaagctgaaatacacaacaccttacgtttcttcattgggaattaatagaatggcggggagaggggcgcagctcggagacagtgccttctataagcctgcgctctgacggagttagagcaatcacagtacccacctctcggggataccgggaaacaaatgagatcgcccatagcaatccctttgcattacggctgtcacttcgaaggggtttggggagaccttaaaaacaataggaaagactaagtttcatttgaaacccattcaatttctccagttaaaactctgcctcatgacaattccaattgaagtaccttagcatgttttctgtactattttctgtatttcctaacgaaccgtttggatttacaattgaattctgagaagaatgcatctctttgatctttggaggaatggagggaagggcaagaaacgaagggttaaggtcgttgcaaactgccattcccaccgccacctccccttctaaataagcactaactacccctccctagctgtgggcctcagaaaaaaaaaatgcccccatgtatgtgcctcacagccagagaagacctcaatttggggttgcaaccgtttttcagtttctctttagctacctccagatccgctgcagacacaaaaatctccaggtttaaaacaaaggctttgaacaaagatgcgcaacctcagctccggcgcgcggcggatatgccttgggattggttggaccgccgtccaataggaaagaagaaccggactctgctatttacagaaattcctcccagtggcggccgcggagtcaggccgtccaatcagacactacaaatttggagccttaatttgaatataaagatggcaaatagccctgccggccccgcatccgcgttcgtctaggcgctcttgtcacctcgccatgccggagccatcgcgggcggctccggcttctaaaaagggctccaagaaggccattaccaaggcgcagaagaaggacggcaagaagcgcaagcgcggccgcaaggagagctattctatctacgtgtacaaggtgctgaagcaggtgcaccccgacaccggcatctcgtccaaggccatgggcatcatgaactccttcgtcaatgacatcttcgagcgcatcgccagcgaggcctcccgcctggcgcactacaaacaagcgctccaccatcacgtcccgcgaagtgcagacggccgtgcgcctgctgctgcccggcgagctggccaagcacgccgtgtccgagggcactaaggctgtcaccaagtacaccagctccaagtgaggtgcgtcccggcgccccgaacccaaaggctcttttcagagccacctccaagctccaaaaggagcgtgccacctggtctggttgtgacctgtgattcaattggagtaatgagggaaagtagactgagccgtgggggcgcaagtcttagagacaaaattaggcttcttgtttgtaacggcatatttcccttagaaaggctgcgttcgtcttgtgttggccacaggcaaagtcagagagggggcagtacaggcgattgcgccatggatcccatccaaagatctgtgtgtggcttacgccctgcgcgcgaggagcgtgggtcacctccgggaagatcttgtgccacgtccccgcccccagtgcctcctggcggctgagactggaggacgtgctcactgaggtccggggttggaggtgagggggttatcgcgccgtctgggcggaggcgcttgggtccgttcttctcccgcccctttcctccctccttagccacaactagacactgtgagcttctagccaaaaccatttcagcagcgttgcgcctaagcagctctttatgccacgccttcctgcttgaaacatcaaaacagcaggctcacagatctccttatcactcagctaaaatttccccaattaagggattctcgtattttacccccaaaatgtgtgtgtgtgtgtgtgtacgcatattacacagtgaaagattattttgaataatgcaaatatagtgctttttaaaaaaaactccagcaaatcataggaaaaataagtatgatctctggatgacacattaaaaactaaggcatgcaggcctgactggggcccaggctgtcctccccctaaaaataccccataccggtgacaccccaaccacgaatacctgagagctacccaccctctaagcaaaaacgttgcctggaattagaattcggtttccaggctcagttcccactggtagaagatgcactctacccaggctcagttcccactgcacactcccaacacaatgacagccacgcatttatcaacatttaacctctctggcctcataaagtaaatccattttcttgggttagtttcttcttaaagggagttttctttcctccaaattctttttgtaaataggctttattttttagagcactttttcagagcaatatgcttttttattagtagtacgtaatagttgtacatatttggggggtacaaatattttgatatacgcataggcttaacaatcaaaccagggcaactgggacatccgtcatcatattcacaccctctttaggtcgagatcattccaattcctctcctccagcaatacaactaattattgttaactacagtcaccctacttttctaaccaatactagatgttaccatttcttctaagcatatttttgtacccattaatcaacttcatctcctcctttccccaccactcttcccagcttctggtaaccagcaatcaactttctacctccatgagatgcatgttcttagctcccacgtatgagtgagatcatgcagtatttgtctttctgtgcctgatttgttttacttaacataatgtcctccagttccatccatgttgctgatgacgggatttcattttttttaatggccaaatagtattcgaatgtgtaaatgtaccacatattctttatccatatatctactgatgggcactaaggttgactttctatcttggctattataaatagtgctgcaatgaacatgagaccgcagacatctctttgatatactgatttcctttcttttggatatatacccagcaatggggttgctggatcatatggtaagtctgtttttagttttttaaagaatgcccatatttgtctctatagtggctgtactgatttacattcttaccagcagtgtacaagcatcccctttccctgcgttctcaccaacatttgttattttttgttttttaatcaaagttggtttaattggagatgattccttccaaattattttatttactgcataataattagcaaatctgacttgaaatttccatctgagatgggtgaggggcaatctcttaaatacatgtcagattgtatgccagtctggagggattttgtaggcatacaatctgacatgtatttaagtgattgtcactcacccatctcagataggtgagatgaagcttagtttaaaaatttggcttagtttaagaatcttggcatgtctctccaacccagaaaatgcttccattttgttgagtgagtcctaattcccttagtctctgtggattctcacatatttgatgtgcactgccttcatttatcattaacatttgtctttctctgttgtaacactataattagagaaatgggttctggacacgattgctctgaattttctccattataaaatcttagtagcaaggatcctgttttaccttctttgcctctcccttaacagatccctgtcctaggagagacggacaaatcccattcattctgggcctgggggtgctaatgtagcaggaaaagacagcctgtttctacttcaagtttgtgccaggggaatcagaaggactgagacatgaattgactgacgtttgacattatccatcacaaaatgccttcttagagaattacacttggaaaatgtcatgaaatgttcatcttgtgccttgatttgatctctggcactaaccagtgttgttgccttgtgctaacacaatcattcactctctctactggagactggtttcactttattaaacctatgttttaagttcattaaggtggagaactatatgggtctgtgagagtagtttcacagctgcaaatgtttaaggtattgacttccaatccatgctggtaggaggccgagggcttggatgttccagtcattgggcacctgtttcatagtggagaggactggattcaacagcttttcatacaaatcctatatttcttgacagtactaagggtgttgacaagtcccacttacttttgatgatggatcactgtttaatatttggattataactagggatgcaaagaattgaataaagtgcctatgacaaaattgtcattcctgtgtattttttgtaaattttttttggagcatatatcaaaacaaaacagaatggaaatgaccccgtgcactgctagcattgtaaccatatggaaatgatcccatgctgtgctaacactgtaacaatatgaacactgcatgtgtgcagtcattgaggtggaaaggagaggagagaagagagtgggtgcaccatccagctcattaagagtcagtttcactaaaagtttatctgtttgataacatcaaattatttatgttttgaacaattgtgtactgtcgagatgatttttcttaacagtgagagactacccagaggtatgcttaaatttcaatgtagacttttttgcagagaacaatagacaaaacactattaaacatacaatagatatattatggtagggtgaaattgtaaggcaaatggagaatggaaataggcattcaggaggaaaaaaatcatctgaaacatcgcattgacaaagaaaaatttggtcatgtattttatgaattgattatactatcatattgatattccaaaaggcaccttgagactgatgtgagaattttgatttttaaaaagttccacgttggtatttgtatctttgcaactattttaattgaaaataaaaatattttagatagctttaaaacatgcgaggttctcaaagattcttgtagaggaatcacgcaggaaaaaaaaggtggggaataggggacaaagccgttttggtcgaggatgttcacggtgacctttctttccccatcccaggcacgcgacgggttccctttggagaaatgacttgggggaaaaatatttttcattgaattttatttaaaaattatttctcggccaggagaagtggctcacgcctgtaatcccagcactttgggaggccgaggagggtggatcacgaggtcaagagatcgagaccatcctggccaacatggtgaaaccccgtctctactaaaaattaaaaaaattagctgggcgtgggtggcgcacgcctgtagtcccagctactcgggaggctgaggcaggagaatcgcttgaacccgggaggccgatgttgcagtgagcagagatcgcgccattgcactccagcctgggcgacagagcaagactccgtctcaaaaaaaaaaaaaattatttctcatttaactttattgaatttttattccctgctggaaatggtgacacaaacgctcagtacttcgaattttcacaacggtttgaggaagcaattactggaaatcttctttttctaaagaagaaaagccaagtcatgaaaacgtaaacgatgccctttccaaagtgaaaactcttcgtgccaaagagctttcctgcgccaaaatggcactccccaaataaatgccgtgaatttggagggggtaggaaaggaattctgcgttgctaacgcctcgcagaaaataatgtggctaaagagggaggcagctacatttgctcagaaaaagggaattcttttcctcctaaattaaccccttcccccacccccactcccataagggttaaagttaccggcagctggggtcgcttattacatccggctcccccgcgcaggacgctgctttgacgccgtgcttcgattcggtatcaaacatcctgccatcgcggtatcctgccaggaaaatatcctcccggaatgttcattgcttaaatctaaacatgtctgtctggtccaggcagggatggaaaagtcttaagcaaatgcagagccaggcaccaccgccaggggaaagtgacaacacccatggcctcagagcccgtggtcttgcgccacgtctggcctcgcccatggggggcgggtagggttggggaggttggcacagggtcttttggggggaggtgacccgcactcctcacctgcacggcgcacgccaacctcatttggacccggtcctgaaccgggcgcaagcgctcaacatccaggaatgcaccacttgcttataaaagacatttggggccaggtgcggtggttcacgcctgtaatcccagcactttgggaggcagaggcggatggatcaccaggtcagaagatcgagactatcctggccaacatggtgaaaccccgtctctactaaaaatacaaaaaattagccaggcgtggtggggcgtgcctgtaatcccagctactcgtaaggctgaggcaggagaatcgcttgaacccaggaggcggaggttgcagtgagcccagattgcgccactgcacgccagcctagagacagagcgagacttcttctagaaaaaaaaaaaaaaaaaaagaaagaaagaaaaaaaaaagaaatctcgtcgtgagttaatagctctgcgcggagggaggggatggagagggggtccttgatcgcctcccaacattactgagctacatcacctgagcagtttctaccccgatttctgtaacgagcagtttttctcgttctgtgccggcgcgcgcgcgcacacacacacacacacacacacacacacggctcagattcggccgcacccggcaaccgctagggtgcatggagacacattaggttacataacccttcaccgtgttcgaaaccctttcttgatcgtgtgggtggctctgaaaagagcctttgggttcaggacgccgaggaacgcctcacttggagctggtgtacttggtgacagccttggtgccctcggacacggcgtgcttggccagctcgccgggcagcagcaggcgaacggccgtctgcacttcgcgggacgtgatggtggagcgcttgttgtagtgtgccaggcgggaggcctcgctggcgatgcgctcgaagatgtcattgacgaaggagttcatgatgcccatggccttggacgagatgccggtgtcggggtgcacctgcttcagcaccttgtacacgtagatagaatagctctccttgcggccgcgcttgcgcttcttgccgtccttcttctgtgccttggtgacagcctttttagaacccttcttgggcgcaggagccgatttggacgggtctggcatgatggctgagtctctccaaacagaaacgcgcggcgctcggagtaactctatttgtacgttttgtattcaaatgaaggctcaggatttgctcacttctgattggatcaaacgttgttctacgtcatcgctgggaaaggaatacgcaaattaggagtgccaggttctttttctgattggctaccatagccatccaatcgaacgccgcggtctagcctacctctgtaccatacataagggctcgctggccttcactgccctcttgtttttagtctcgcttttcggttgccgttgtcttttttccttgactcggaaatgtccggtcgtggtaagcagggtggcaaggcgcgcgccaaggctaagtcgcgctcgtcgcgcgcggggctgcagttccccgtgggccgcgtgcaccggttgctccgcaagggcaactattcggagcgcgtgggcgccggcgccccggtctatctggccgcggtgctcgagtacttgactgccgagatcctggagcttgccggcaacgcggcgcgcgacaacaagaagacgcgcatcatcccgcgccacctgcagctggccatccgcaacgacgaggagctcaacaagctgctgggccgcgtgaccatcgcgcagggtggcgtcctgcccaacatccaggccgtactgctgcccaagaagacggagagccaccacaaggccaagggcaagtgaggccgcccgccgcccccggggcccctttgatggacataaaggctcttttcagagccacctactatctcgagaaaagagccgcactgatcctgcagttctttataggccggaggcctgatcaccctaggctcatgaatgagcgcagtggccatggggaagggcgcaacgggaaccgagaccctggggactgattgggctgcatacttgcgaggtgggcaacgtgttctgttaacaacagggaaccctcgtccacaggtggccaccccttgctcttgagtcccacccaaaacctctagtagggttttaataacgctcaccgtaaaggtgtcttcataattactagtgacaagttctcttgactctagcaaggttcccgtgtggtcatcaagtacagaatgcaatttcttaatgatttatctgatattaaaagtatttatgatctctaagtagtttgcactttaattctgaagagtaagtctatggatttctatttaaattgctaagttttaacaatgtgagctccaccagtgttaagatttaatttatttggctgggaattctaaaggtcatgaggaaagtttcagtacttaaaaggaaccagattagtagatgctgaaaggtataaaccttttaagaagacttaatttggaataggataattatttaaaggaatttagtttgtttaattcgggttggtcaaacattaatcaaagatccccttaaattgattgctaaaattggagaacaaaataatttgtacactgtttttgaaaaggaaaactaaatttgcgagttaagcaaatttaaaatgagtattgttagaaccagatgaatgatgatacatgtggactttaggaaaataacggtttgtaactacatttttccttataaaatggagggtttaagagcgtcggagacctccaggcaaattaactgaaatggctgtgttaatagcccctaaatcctggaggagagaggttcattgatttaatccacgataatcccttaaaaaatgtttgccacaaaatcagagctcagaaagtgttattcttctgttgttatctgtacagttttcattaatctatttctcaaaatatggataattcctactttgtttttattttttctttaatccccaaagtgctagtatttagttaattgacacctaacaattgcatattatatggggtacatagtgatactttgaatacatttattatcagatcagggtaattagcaattattaagtatttattgtaataataaatacaggccagtaaaattattcaggaatattatataatttatatttaccctactaaaattgggtctactcaagtcagggcttcctggacaccagctaaccacaaatctgcatgtctttagaaaatatcccagtgctatgaaactatttgaaccaaaaattggtaagcagctgctccaacagtgtggatctaaacagcacaatattcacagtgtgtatcacgagtgggcaccatttcagtaaaacaaaactgcaaggactggccaggagagggtgtagccttccagagatcttttcattatttttcttgtgaaagccttcattttcagttgaaatttatctttatgtatttatatctatgtaggtcactctatctcttcaaataccctttagtggtatttaaggtttttgcagggtctggggacttaggtgtttcaactatcaccatggatttccagattttgtaaaaggtgctcaaatggggtgaagggggaggcagcgtggtgggagggctactttggggtagcactgcatttgttatctctgaggctatggtgtttcacagacagtaacgagccacacaagctatttaattttcagataattaaaatttaatacaaagatgtagttcctcagtcaccctaaccacatgtagccagtggatgccatgttagcacagatacagaatgtttccagcatcacagaaagttgcactggacagctctggtctaagatctggttctttatcgggttatctgattcagaaatgtagtaaattatccagtgctgcctgctttggtaagagaaaactcattagactcttttcttattttttatttttttaagacaaagccatgccctgtgtcccaggctggagtgcagtggcgtgatctcggctcactggaacttctgcctaccgggttcaagtgattcttctgcctcagcctcccaagtagctgggattacaggtgcctgccaccatgccgagctattttttttttttgagatggaatttagcattgtagcccaggctggagcgcagtggcgtgatctcggtgcagtggcgccatctcagctcactgcaacctctgcctccagggttcaagcaattctcctgtctcagcctcccgagtagctgggactacaggcgactgccactatgcccggctaatttttgtatttttagtagagacagggtttcaccaccttgttggtcagactggtcaacaactcctgacctcaggtgaccgacccaccttggccttccaaagtgctgggattacaggtgtgagccaccgcgcccggccacccagctaatttttgtatttttagtagagacggggtttccccacattggccaggctggtctcgaactcctgacctcaagtgatctgcccgccttggcctcccaaagtgctgagattacaggcatgagcctgtaatgaagcacccagcttcattagactctcgcataaagaagatatcaccgtatggccgtgcaattccagtcctaggtatacatacccaagagaaatgaaaatacacatttattcacaaacatgtacacaaatgctcatggcagcattcttcatgaaatacagaaggtagaaacaacccaaatgtccatcaactgaggaatgggtaggcagattgggatctatccaattacaatgaaatattattcagtcattcaaaaggaatgaagcactgacatgctactacagggtgaaccttgacagcatgctcagtgagataagccagatacaaaggccacagattgtctgagtccactgatacgaaatgtccaaaacaggcaaatccacagggactgaaggcagactggtggctgccaggggctggaggagaggagtgcctgcctagtggggacaggtcttcctttaggggtgatgaggatggtctggaactagacaaaggtggtaactgcacaacattgtgaatgtactaaatgcacctgaattgtgtactttaaaatggtacattgtgtgtcatgtgattttcaccgctcgatttttttaaaaatctgaacctaatacacgaatgtgtagcaaatcatcaccgtaaccaggagaacaagaaggaaaggcaagaaagcctggggtcccagaagggctatgaggagggtagaccagatgcccaagaggagagaggcccatcctagtgcttttcaggatgccactggcctaccccaggtataaagagggggagcagggactgcccttggtgcagcagcagccatcacttggggaccttgtggagagaagagggccctcttggtggctgtgggcaactcatctctgcagggctggctgtctgtcctgtggatgcatcgtgacttttccctgcctgttgcattccccgcccgctgcattcccaacatgcacccaccttcactggaagtttgctcatcacacttcacacatccctatgggcaggcactttatggaggaggaagagaaaaggagatatgtcccaggaggagaatgcagctgaagccagcctcaggagtaacccacagagagagcttgcagttttgcagaactctcggcttggctcagctttgtcccgcatccctctcctcctctctcctgactgtgggtctctccccagccccagctggtcagttcccacatgctcaacaccaaaatgctcgagtcttccaattgaaaaacgaaaacgaaacaaaaaaaacaaccaccctcttccctgcaatttcttcctctcctgagatgctgcattgaagcgtttgtgatgccagtccttcagggaagcagttttgggtatctgctctgacccctgtccagtgtgggtcgtgctgaactcgtcctcattgtccctgtctgtgtgttatcctgtcccacagaggccccgactctgatcaccagagcaggtcttgggcctgcctggaagagtctctagtttcctgcatgccgctcaccaagtgtcaggggcagtgggatgctggccacatctgtcccaccactgcctggtggcagctgcttctgtgcaggcggctggggatgccaagtccatggcaacacctggcttccagaccctggacccagcagccacccctcgtggagctgcctttgggccccaggccacctttgttgcccagtgggctgtgctctcagcccacccatggccctgagtgggccctgctggtcacctgctggccaggcccttctaggtgtctcctgccaagataacaaaccagcccaaagcattgtggctggtgggcctgtggggccggggtgggagccaggcttcctggacagcaggtgtctggtgaacaggctagacctggctcctggacattcgccacccactgagggccagtggagggtcaggagggttcagggaggggttcagctggtgagtcagggaagggtcagtggagggtcaggagggatcagggatgagtcagctgatgggtcgggggggtcagccagaaggtcagggatgggttagctggtgagtcaggaaggggtcagtggaaggtcaggaggggtcagggttgggtcagggaggaggcatgaggggtcacccaaagggtcaggaggggtcagctggtaggtcagggagggttaggaggggtcaccagtgactcagcagtgggttggtggtggggccaaggccccctggggcctcgcctggaagctgctcactgtacctcaggccgcacgctgggagtcacagcaagtcagcaggccaacctggtgtggtgtgctgagggacagctccaagaccgtgtgtgccagggcggggggtacctctcaccactcaccacaggtcctgcggcctccaccctgacacttcctttttcccatgagctcatccaaaccacgacttgagtgaccacaaaccatggactgtggacatttcccagagctccaggctaatactcaccctcttgatacttgcacctgttcaaggggcctgacttcaccctgcagagaatcccacagaaggttctccatgccccagccccaaccgaacactgagacttcccccagtcatccccagcccaggaatggctccatccttctttggtcactcagttaagtaaaatagacaaacgaaagttgcccatgcaggctgctgtaacaaaataccacagcctgggaaagttacagacaacagggtttagggctcgcagctctggaggctggagtacaagatccagaggtaagtcataagtagagcttgtgggcctcaaaggcagaggcggttgcgggaccaaaatactgaatatgcaggagacagtgagtaaacagaaggcctcagggcactaaacattgatgattgctaagtatataagcaccacttaatatgcatgatcattaaatatacaacagaaaggcactaagtattcatagtcataaaatataccagagacactaaatattcaggatcactaaatacataggaggatataaatattaatgatcacgaaataggccggggcggtggctcacacctgtaatcctagcactttgggaggccgaggcgggcgggtcacgaggtcagcagatcgagatcgtgccatcctggcgaacacggtgaaaccccatctctattaaaaatacaaaaaaattagccaggtgtgctggtgggtacctgtagtcccagctactcagaaggctgaggcaggagaatggcatgaacccggcgggcagagcttgcagtgagcagagatcatgccactgcactccagcccgggtgacagagcgagactcaatctcaaaaaaaaaatgtgtatatatatatatatatatatatatatatatatatatacatacacacacacatatatataccagagacactaaatattcaggatcactaaacgcataggaggaactaaatactaatgatcacaaaatatacaagaagcactaaatattcaggatcactaaatatattagagacgttgaaaatccaggattgataaatgtatgagaggcactaagtgttcatgatcactaggtatacaaagtgcacataaatattcatggtgactaggtgtacaagacgcactaaatattcatgatcactgactatacaagaagcactaaatattcaggattgctaaatttatgagaggtactgaatacttatgaccactatagatacaagatgcagtacgtgttagatgttaatgatccctaagtatacaagaggcactaaatattaagataaataaacatgaggcttaggtatctaggatgactagatatgcaagaggcactaaatattcaggacaacgctaagtatacaataggcactgaatattcaggatacgctaaacaggcctggctcatttgaggcactcccgttgggatcaccattccagcccacctttctctgcagcgtggccaggacatcctgtgtctcagtggccacacctgcgtgccattgcccggcactcttgctctcgcacctgaggcctggtcttcgtaagtaggactttatcctgggaaaagtctgacagcagagagagacaacacctatggacacgtgcacccaggatggaggggtggagaggggtaagttgactcacctagtgtaggtgtgacactcttactctaaaattgtctgtgagcccttccatgccacgacctgtagcttcaaggtgacttttcacgagtcctccgggcacagcagctgttggaggtgaccccaaggcaagggagcccagacacactgctttccatccaatcaccactttacctcccttcgtggcactgagtgggtgactgtcacgtcactcccgccacaagccgagctctgggaaggcaggagaaaccccgcctggctgcattctcaaggacacctgcacagtggatcactacaaccagtgggaccgtccctgaaggtgtgcggggcagcatgcttgtgcatgatagacttgccatcatcacattttttttttcgagacagcgtctcaatttgttgccgagactggagtgcagtgcagtggcaacaatcacagctcactgctgtctcaacctcaagcaatcctcccacctcagcctcctgagtagctgggactacaggcaggctccccaaacctgggtagttttttgtattttgtagagacagtggtttcaccatattgcccaggctggtctccaacacctgtgctcatgcattcctcccgccttggcctcccaattacaggcatgagccattgtgcctggccctatcatcacagttataaaactatcacatttccagccccaggagctttacccacacagtctcaaagcccttgcttcttggaaaacccccagaggcctcacagggccctacaaagaaaagccccacgctctttgttgttgagaatgctttactggtccctttttattttttcccagctttattgaggtactgttaccggaaaggggtctcgatccagaccccaagagagggttcttggatctcatacaagaaagaattcagggcaaatccataaagtgaaagcaagtttattaagaaagtaaaggagcttttcacaagatggcactgaaagcgaagaaggaaactcctgcccttcctaaagccgaagccaaagcaaaggctttgaaggccaagaaggcagtgttgaaaggtgtccatagccacacacaaaaaaagaagatccgcatgtcacccaccttctggtggcccaagacactgtgactccggaggcagcccaaatatcctgggcaaattgtccccaacaagcttgaccactgtgctatcatcaagtttccactaaccactgagtctgccatgaagaagatagaagacagcaacacacttgtgatcactgtggatgttaaagccaagaagcaccagatcaaacaggctgtgaagaagctctgtgacattaatgtggccaaggtcaacaccctgatcagcctgatggagagcatatgttcaactggctcctgattacagtgctttggatgttaccaacaaaattgggatcatctaaactgagtccagctggctaattctaaatatatgcatatattttcaccattaaaaaaaaaaggaagaaagtgaagggataaaagaatggctactccataggcagagcagctctgagggctactggttggccacttttatggtcatttcttgattatatgctaaacaaggggtgaattattcatgcgtttcccaggaaaggggtgagcaattcttggacctgagggttccttccctttatagaccatatagggtaacttcctgatgtttccatggcatttgtaaattgtcatgatgctgttgggagtatcttttacttataattaatgataattaatgtattataatgagcagtgaggacgaccagaggtcacattagtcgccatcttggttttggtgggatttggctgccttctttaccgcgtgctgtttcattagcaaggtctttgtgacctatatcttgtgccgacctcctatctcatcctgtaacttagaatgcctaacctcctgggaatgcagtccagcaggtctcagccttattttacccagcccctattcaagatggagttgctctaactcaaatgcctctgacagtatgatctacaaataaagctcgtacatattcaaggtgcacagcatgatgtcttggtacatgtcacgtggtgaaatgattaccacagtcaaatcaattaacacacacatcacctcatgtggttacctgtgtgtgtgtgcatgtgtctgtgtgtgcggtgacaacatgtaagatctactcagtaaattttatgtccatgatatgttattaaccagagtctccatgctgtgcttcaggtctccagaactacttatcttatagctgaagctttgtactcctcctcacccagcccctgacttttttagattccatatataagttggctcatgcagtattatttgtctttctgtgcctggcttatttcacttagcataatgtcctctgggttcatccatgttgttgacatggtttccttcttttttagacctgaataattttcattattatagtgtagtatagcatgtaacactaatatctataccacgttttctttattcattcactgatggacatttaggttgtttctgtatctcagctattatgaatagtgctgtaattaacatgggagtgcaagtatctctttatgacagtgattttatttccattgggcatactcagaagtgagatggctggatcaacaaaattaaaaggcaacctatggatgggtgaaaacatttgcaaaccaaacatctggtaaggggttaatacccaaaatatataagagctcctacaacttattagcaaaaaacaaaaccaaaacaagaaccaaataacctaactttaaaaatagacaaaggacctaaataggcatttctcccaagaaggcatacatatggccaacaggcatatgaataggtgttcaacattactaatctaggagggtcggtagggtggctcatgcctctaatcccagagcctaaggtgggaggattgctagagcccaggctttggagaccagcctgggcaacataggaagactccgtctgtacaaaaaatttttaaaaatcagcggggcgtggtcgttcctgaggtcccatctagtccagaggctgaggcgggagtatccctcgagcccgggaagtctaggttgcagtgagccgagattgcaccactgcactccagcctgggccacagagggagaccctgtcgcaaaaaataaataaataaataaaattcaggaaaatgcaaatcagaatcagaatgaaatgtctccgaacacctgttagaatggctaatatcaaaaagacaagagacaacaagtgttggtcacgatgtggagaaaagggacccttcgcacgctgttgaggggaatgtaaactggtgcagccatcacggaaaataggacggaggttcctccaaaaactcaaaacaaggtccagtctttctgaggcccccttctgcttgcctgtgaccacccttcttccaaccctccagttccaggtcccctctgctgcccttagacgcggcgtcttcgcactctgggccttaccgcggctgctcctccaggtttgctctccaactgcagccttccctgtcctacgcgaccaccggcctcctggcgccctctgcctatagtgaacacccctccaacaccgtgccatcacctcacgtttactctcacctcctcctccactaaattgcaagctccagggaggcatgttttcatctgatgcgttcaccccaagtactaacagctatgcctggcacatagtagatgctaaatggatatttgatgaacttaaaaaaaaaattcaaaggattcctttcctctctggtcaatggaagacggagaaggaatgaaattgaacttcaatagcttaacaaagggcgggagggtggtgtgttgaccgcccccccaaccccccaacgctgggccccaacccaccccgccccgcccccacgggatgcttttctacaagggtgagaggagctgactccggtttggactggaagaaagtttccaagaaaatcaaattagtggcccaaacacataccccttctccgccccgcgcagtctctgagatgcgtcccagcaattgcccagggacttggagggagcgggcattttcaggctgcacagaggccatctggggagaaggtgtgcggctgttttgctgaaatgtaaaaagagatgtcctttggagcccgggacgccgtttccggctggctacccgaggttgcgtgcaaggggcgggtccttaggcatgaaaatgaccctcccggccgcaacggcgcacaggcccagggccgctgagcccctccaagccgggattcgttttggagacctgcgcgatggagcggacagcgggactggggggcgccgcagtgcagggtgtacagctgcagagaagccggggatacaggggtgcggggcgcagggataacgggcgcaggggacggtcacgggtgctttctagtgggttgtgcaggctcaggttcccagcgctgggtggttgcgactctgcataaaacgctaagcttttgaggcccttattcaagctcggggacgtctcccagttggtcagttcaaaacctctgggccaggttgcgttggtggcagattccgcccgctaagtctccgcacgctgccgcgggtctgctcctcccccggggtcagaacctctgacgctctcctgcttttacacgcgttaagtcactggtttcttgcagcatcacgtgttccctagatacatgggctgaggcttattcttcctgaaagtgagggttttttcctttgggctttccagagccagcccgcgtggagagtgacgagtgacaggcgcctttgttccgggcttgcatgggtgggacgcgccccctcctcagcactcagcccggcgagcctggccctcccgtcgccccttcttaagtgcatttgtcccgggctctcgattttgtttactctttcctgcttacacaggtacacacacacacccagacctaaactttatataaacagacatgaacttaaagaaacaaaatccccctatgtgtcaacgcgctcctttttaacaaaatcaacaaaaattcaacacaatgttatttccatccttttgttgtcttattagaaacgtgtatgttaactttcctccttttataaatggggcatgttctaattaaccatttgtatggttgtttttagtgctcaaatggtcacattgcagccccggggaggtattttcaaaacgctgctctgtcattttaggatcaccctgattgttggaagcacctttgcttttgtttttgttttgtttttgttttgctgagacggggtctagctctgccgcctaatcaggctcactgtggcttcaaaactcctggctcaagcaatcctcccgcctcagcctcccaagtagctggtactacaggtgagtaccacagcgcctaattggttttttgttttgtgtgtgtgtgcgtgtttttggttttttttgtttgtttgtttttgtttttgttttgttttgttttgtaggcaggttctccctatattgcccaggatggccttgaactctaacctcggcctcccaaagtgctgggattacaggtgtgagccactggcacccggctcatctttgctttctgacagcaaaaagttatttcagacctatcatgggtgttttgttttgttttgaatttttgtttttttgactccagatatggacttaactgcactccaaggagtttatgttgctcttcatgaaaattagtattatagacaaaattgaagctgggaatcagctacttttgtctctcattttcactgttctcttttttttttagatggagtctcaccctgtcccccaggctggagtgcaatggtgcgatctcggctcactgcaacctctgcctcctgggttcaagcgattctcctgcctcagcctcccaagtagctgggagtacaggcgctgcgtcaccatgcctggctaattttttgtatctttagtagagatggggtttcaccatgttggccgggctggtctcgaatccctgaccttgtgatctgcccgccttggcctcccaaagtgctgggattacaggcatgagccaccacgcccggccactgttctctttttttaatgatggtgtagctgtctaccctgtggagatatattgatcttcaaaatcaccgtgatagtacagttattatggaaaacattattaaattcaaaatagaattcccaaacgatatagcaaccccactgctggggatatatctaaaggaaatgaaatccgtatccagaagagagatctgcaccatgttcactgcagcaccatttacaataaccaagacatggagttaacctaagtatccattgtcggatgaatgagtaaagaaaatatggtacatatgtacaatgaaatactattccggccttaaaacataatgaaattccctcatttgtgacaacaggggtgaaatgagaacattacgttaagtgaaattagccagatatggaaagacaaacactgcataatctcacttctatgcggaatctaaagaggttgatatcataaagcagagagtggaatgatggtcaccaggatctgggggccagagacgctgactaaagggcacaggagggggctagggcacgctgacacaggaggagtcagttcaagacatctaatgtacaacacaatgactataattcacagcaatgtagtacatgaaaattgctaagagagtagattttaggtgttctcaccacaaataaatatgtgaggtaatgtctatgttaattagcttgatttagccattccccaatccatattcccaacacaatacatatttcaaaacagtaccttgtacaccatatatacaatttttgtcagtttaaagaaataaagaagaaaaaaagtcaccatgatcattggtagtccttccatgataatgctgatgcctcatcctcaagtgaggacatttgtctcagtcacttcaagctgctatgacaaaacaccagagactgagcaatttgtagacaatagaatttttgatcacagtctggaggctgaaagttcaagatgaaggtgtcagcagggctggggtctggtgagggtcctcttctgggctgtagagtgcagtcttgtggttgcaacctcatgtgatggaaggggtgaggcagctctctggagtccattttacagtggccctaatcccatcagtgagggctccaccttgatgacctaattatctccccaaggccccacctcctatgccatcctcacattgagggttggggcttccacagatgagtttgggctggggacacaaatgttacccgaaaggggtcccagtccaaaccccaaaaaagggttcttggatctggtgcaagaaagaatttgaggcaaatccataaagtgaaagcaagtttattaagaaagtaaaggaataaaaaatgactaatccataggcagagcagtggcatggtgcgctggttgcccatttttatgtttatttcttgattatatgctaaataaggtggggattattcatgagtctcccaggaaaggtgtgggcaattcccagagctgagggtttctcctctttttagaccatatagggtaacttctggatgttgccatggcatttgtaaactgtcatagcactggtgggagtgtagtggtgaggatgaccagaggtcactctcatcgccatcttggttttggtgggtttggggcagcttgtttactgcaacctgttttatgagcagcgtctttatgacctgtatcttgtgctaacctcctgtctcatcctgtgacttagaatgccttaacctccttaatctcctgggaatgcagcccagcaggtctcagccttattttacccagcccctattcaagatggagttgctctggttcacacgtctctgacacaaacatttaagccaaagcaacattgtggaaagaaaggaaagacatttctgaaaacaaatgtgtggttctgcctgatggttctggtgaatcttccgcacttgctatgacaagaaattcaaggaaaataataggtgagagttgttttgtgaaaaatgctgcaactttggcattgttgctactgcaatttgggcccagggtcttgcaggttggggtttcaccctcctcatttcacataaacccggggccagccttcactggatgctaattggcatatctacaaataggccagccggtctgtgtctcctgatttagagactgtaaactaaaaataaaatcctaagcacccctaaccaactgcacagacactctgttggtaaaagggaccccatagaaccttaaaaactgagtttctggccatgatagggtgggagtcagacacatctcattatacccctttctgttgaggtttagacacaactgacagcattcatgttaacatagagacagtccaggtgaggttaagagaattttttaaaaaaacacagacacaggatggagtctttgtggcaataaggtgacaaattataaacaagacctaagggttaagtcagcaccctacacttaaagaataaaccatgttttcactgctgcaagggttttcttttactccagcagctaaccaagcactggcctccagctaagcaacattaagacaattgcagcttacccagctcacagaggctgactctccgaccccctgctccaccagccatgatggcagcattcactggacaagacactgacttcaagagctttctgctgatgagagaccacgaccttgggctagtcctggccagtttacagacgctgtgcacttgagcacctttgagtcctggaaagacctaattggaatacatttacatgtgaagcctccacctcaaggtaagcatgcatcacatgtcatgtgcatgtgtgttccgtgaacatgtgtgaaggctaccctcatggatctccatagtcctcccgtaggctgtggaatatgtgtgtttggcaaagccaaacaagcacagagctcctgccccaactcctccctcccccaaagtgcctgggcttggcccaggcactgggtttggccaaggctgtgcttccctgcccgagggatggccactttgcaggctgtaaccctctacaagaagtgaaatctgcttttccaatttatagatcctgtgattttttcagttaacgcaaagataaagctggacattaaagcagtgaaaacagatttccattcagtgccagctgcagtcagtacagagtcgcctccattgtaatttgtgtaggggtggcggggtgtcttaaagggaaggagatggggtgagcgggggctccgtgccaatcagatgagaccatctgtgtctgctagtcagccaggcccaaagtcaggattctaccttctggcagagactaaggccttctccctcctggtttcaaaggaatggctctgggttcctcgaggagccactgctagattgtaggagacacatggacatctcaacacgccaaaggaagcattcccagttgtgagctggtttcagtaaatgctctaggaaaggaagagcctggaccagtcttcaggtgttggctggaatagaacagcaaattcctgccacagctgctatggtctgaatatttgtgtcctctgatgtagaaaaaaaacaactgtttttcctctgatctcacaacacaacaatgaacacagaagacatctgtgaccaaacatgtgaggatttctccctatcagcaagcaagcaagcaaccaatgttttagtgggcaccagttaggtgtccttgaacccaatttaattccgacttcagccaggcacagtggctcatgccttggtaatcccagcgttgggaggcagaggtgggagggaattgcttgagcccaggaactggagaccagtctgggcaacatagcaagactctgtctctacaagaatgaaataagtagctgagcacgatggtgcatgcctgtagtcccagctgctcaggagactgaagtaggattgcttgagcccaggagttccaggctgcagtgagctagggtctcaccactgcattccagcctcggcaacagagcaagaccccatctcaaataatcataacaataaaaaaactaaataaataaacaaattctgacagtatctacctggagattgcatcagatcctataggttgagggctcagtccccgaggctgcctctacttcagacaccatgggcaagtccaagcctccagaacttctgaccagctgtaacttggagttccctcgactccctctttaagcttgattaatttgttagagcagctcataaaactagagaaacacttacttacatttacctgtttatttaaagaatagtttaaggctacaaataaatagccagatgaaggaatgcagagggagagttctgcaaaggtccaagcgcagggccttctgacccagcggagttgggctgcgccaccctcccagcctgcaaatgaattctccctcacccttcctgcaagcccccacgagttcagccctccagaagcccccaaaacctgtccccttgggccttttatggagacttcattggatggacatgatagaagacagccatgtagaaatgtgaccggacagaaagtgtggatgtaaccccaacagactgagcggggaaccccagcagagcccatgtgttcagactcttcttggcctctctgggcagcatccttcctcctgggtatggggcaggaccctctctgaactgggagtcttatgacccacaatcagaaaagggaagtcagaaaatgtccttatggccaggtccgagacagaaaggtggggaaagactacagttttcatttctgtggcctgcctggggagcaaaacgagtaggtaaaaggagggtgggagaaggtcggagagataggttctgttttggaggcctgagcaccccaacattctaacaaatactgttgctgcaggacttttccttagttcagctagagaactccggcctgtgtagtgccttcagctaaggcgaacagtgaaagatgtggaggaggggagttatgagaagcagtggtggagagggccggcgagttaaggcctggcatgtagatttcactggtgctgtctcctggctgataagcatctaaaatcatctcacatgattaaattgattccttcctggtggagaggcaaagacaactttgtccattttgtcctgcttttaggaaaataggggcaagcagaaagcttttttacatccgttgtttctcaacaatggattattattggccttcagctccaaataatccttgtgccaaagtggcatcctttggggaagaggtggcatcccttgaggagggggtggcaccttttagagatgggtggcttcctttggagagagggtggtatcctttggggaggggtggcattgtttaaggagggggtggcatcctttggagagggtgtggcatcattttggaaggggtggcatcctttggagggggtggcatcctttcgggaggggatagcacactctacagaggaggtgccatcctttggagagtcggtggcatcatttggggagggaatggcaccctttggagaggagggggcatcctttgggtggcatcatttggggaggggtggcatcctttggaggggggtagcatcgtttgaggagggctggcatcctttggggaggggatagcatcgtttgaggaagggtggcatcctttggagaaggtgtggcatttttgaggagaggtggcattgtttggggagagttggcatcctttggggagggggtggcattgtttggggaggggtggcaccctttgaagagggtgtggcatctttgggggaggggtggcatcatttgggaagggctggcatcctttggagagggtatgacatcctttggaaagtgtgtggcatcctttggagagaggtggcaacctttggggagggcacggcaccctttggggaggggtggcatcctttggggagggtgtggcatcctttggagaggagtggcatcctttggggagggtgtggcatcctttggggagggtgtggcatcctttggagagggggtggcatcctttggagagggtgtggtatcctttggagaggtggtggcacccttcagagagggtgtggcatcatctggggagggagtggtgtcatttgaagaggggtggcatcctttgaagagggtatggcatcctttggagagggtgtggcatcgtttgggggagggtatggcatcctttggggaggggtggcatcctttggagagggtgtggcattgttttgtggaggggtggcatcctttggggagggtgtggcatcctttggggagggggtggtatcctttggggaggatattctcctatctttcaagagcaatgtacgttgagtgtggaatgaagaataatgaattattatgacaaggatttgggctgttttagatttaatatggtccagctaatgctgactccccacctctttcaatgggatgaatagcattccctcactcttaaactaagaatccccaaatgagaggtgcactaattgcacctgagcacccccctttcatttgggggccctgtagccactcacagacccacaggcaggaaaggccaatttgcggttgtggggttgtttgttggcagttcacccctaaatcctggctaatgtgggaatccaagtccctgatttagtacactagagatatttagaagtctacaataaaaagctgacattattttattatcccaactatcctaaaaggaactttcttctattcactggctataaaactccttgaagtttcaggttctcattgcttaacagcttgatttaggggccaaaggctacataaggcagattttgatacttacaaagtgactcgcggttttaaccaaatagagatccaacatatggctgacctggtccggaagggaggtgatatttgcctaagaaattatcctcaaaacttagcagctccagacaacatatgcatattgtcccacagtgtctgtgtggcagtcgggaatcgcagtgctgcctagttggggcctgtcagaaggctaccatcagcgctgtccagggctggagtcatctcagacctgactcgggcagaacctgcccccaggctctggcatgtgactgtcagcagattcaagatccagttttatttatttattttattttttactttatttaatttgctttttgagatggagtccccagtctgttgcccaggctggagtgcagtggtgtgatctcggctcactgcaacctccgcctcccatgtttaagtgattctcctgcctcagcctcccaagtggctgagattacagacgtaattatcacacccggctaatttttgtatttttagtagagatggggtttcaccatgttagccaggctggtctcgaactcctgacctcaggtgatccacctgcctcggcttcccaaagtgctgggattacaggcatgagccaccaggcccggccaagatccacttttagattctttcctgtgggcttctgttctgcgctgcacacagcctggccaccagcttccccagacggagccgcacagggagagcaggagggaacccccagtgagaagccgaggtctttctataacctaatcccacaagtgtcatcactgctgccagaacccacttgttcaaaccagtcagtaaatcgaggggtgtggaccgcccacaggcacaaacaccaagaggcaggaatccttcaggcattttagaggcagctgaccacaggggattccctcaaaggcccatggctaagtttgtttgacaactgtgatcaggggtcagttttgcagtttgtggtgattctatgagatctcacatctatagtgactgtgtgctatacgctgaattatgtcacaccccaaaattcatatgaatattggaaataatatgtcctggcccccatcacctcacaatgtgaccttatttagagataggatgttcacagaggtagctgaaaggaggtcattagggtaggtcctaatccagtgggacttgtgtcctgataaaagggaaatttggacacagagacacgctcagaaggaagacaatgtgaggagccacagagagaacacagccacctgcaagccaaggagagagacctcagagggtaccagcgctgcccacagggtgatctgtacttctcaccttcagggctgtatgacaataaatggactttggtttaacccactgtatttgtggtaacgtgttatggcaacaatagaaaatgaatgcaaagtctgttttagaggtagccaggatagtttgggttaatagaggcttctggaattcttttttttttgagacggaatcttgctctgtcgcccaggctggagtgcagtggcattatccctgctcactgtgacctccgcctcccgggttcaagcaattctcctgcctcagcttcctgagtagctgggattacaggcacgcaccaccacgcccagctaagtttggtatttttactagagacggggtttcactatgttggccaggctggtctcaaactcctgacctcgtgatccgccctcctcggcctcccaaagtgctgggattacaggtgtgagccaccatgcccagccggcttctggaattcgtaagaatagacagagcatactgaagccctgtctagacaacattttcgttggcattatgaattgacggtgcacagttaactgctaaatacacataatctgtgtaaagaaggagaaagttactatataagagcttcagcactcctctgacatgaaaaagagatgagtgcttcaacccttttaccttgctgtgctcatccaggctgtatccatttagtacagttccaggtgaggacactgatttctatcgagtagcctttctgggatttctaagactcaggagaggacataagattgcatactctgtgtcaatagttcagactttcagaaagaatgaaattcctcctcacctcctttcaatcaagaatcccatcgtagttaccatgttattataccattgaggggcaggagggggtcggcccgaatgtacaaaatgacagtgacactaggagctggtattgtcagctattccccttgtcttttcatactaacttattttctctccacatttttgtcttttagattcagaaatccctgtgccaactagaaccctttgaaactaaccctgactatcatcaacaaggaatgtggctgcttccatagcatatttgaagtacagaactcaagaaaatgcttcctattgatggaatttgttagaccaccacacttcctgggaattcagttttcttccattaaattcatcagactcaggtggaattgagttgagtgtctctcacaagctttaggctggcaaaaagagctgacactgccaactacagcttttactgcaaatacaagctgcttccttgcagctggggaacttagtggagatgtgcacacttgtggacactaggtgcgtgatgggggagcttgtaacccgcccctgattattctgaacacaaaccacatctagcggtcaagttctcctcctaggtggagaaatggagtttgagtgggagacaaggcattgccttgcaaatgtcatttgcacagctggtcccatttgtatggcttacattcaaatgagggcttagagaaatccagcatctgattggattaaagtgcacatttaaataagatgctgccagttcagctctctaattggaccaaaccactgcaggatgtcagccaatcagaatgcacataccagcctgccaagccctctccaccgccagaatgaagcggggctactctcgggaatgggagggcttgtaaccattgggaaatctgtaaatgtgactcattatgttcataaattttgaaaagcaaaaattcttagttctaaaattatttttgctaatattggatagttatctttttaagtaaatagcaaagtttggataaaataaattgatcatttcttattatgataaaacaacgcacaccaaaccccagcgtcctgtgtgatgatgaaatacatccttccccagtgagaaggaagcccaggattacctggagcagaagcttccggagcctttgactggcaggaaatctccagccatcagtgtggaacagcctgagagtaagaatttcctggggactgaaggtgtttccattttgggaattttaatttttttcaatttgtggaaaattgaattccaacagtatgggtgtgggtggcccactcttttcttggtttttacctgtaggaaccccactaggttctcttggtgcaatagaaaagacccctccaggctgtggcaggaggcgggaaagcaaccatggtgaagtacactcaggacatgcccccaagaaaggcctacccttcaggggagagacactaacaggcttaatccagctgggggaggtgtgacccccaaatgtctgagacaggtctcaattagtttagagagtttattttgccaaggttgaggatgtgcatctgtgacacagcctcaggaggtcctgacgacatgtgcccaaggtggtctcagcacagcttggttttatacattttagggaaatatgagacatcaatcattatgtgtaatatgtacattggttcagtccggaaaggtgggacaactcgaggcaaaggcaggacaatttgaagcagggagggcgcttctaggtcataggtagataagagacaaatggttgcattcttttgagtttctgattagcctctccaaatgaggccatcagatatgcatttatctcagggagcagaggggtgactttgaatagaatgagaggtaggtttgccctaagcagttcccagcttgacttttctctttagcttagtgattctggggcaccaagatttattttcctttcagatttattttcctttcgagaaaggtattccctccacttcagccacctctagccttaaggagacaaaagcagctaggaaacacctgtgaaggtcacagtccaggggcacaggccaaataagaggctgagatttcatcataacactatggaatgcttcctccaccccaggccggccaccacgccataaggctccagtgtgagtacagtctgacagaaagagctactgttgatcaagcgagtcaaactccataaaatattttaagagatttattctgagccaaatatgagtgaccatggcccatgacacagccctcaggaggtcctgagaacatgtgcccaaggtggttgaggtacagcttggttttatatattttaggaaggcatgagacattaatcaaatattaagaaatatattggtttggttcagaaaggcaggacaactcaaagcaagtgcttccgggctataagtaaatgtaaacattttctggcagataattggttgagcttgtctaaagacctgggatcgatagaaaggaaatgttcaggttaaaaataaaggattgtggagaccaagttttattgtgcagaggaagtgctcagatagccaacttcagagacagcaggttgtaaattgtttcttatgggacttaaaagggtgcctggctcttagttgattatctcctggatctggaaagaaaggaaggaaaacaaaggggaaaggggattctctatagaatgtggatttttcccacaagagatttttcagggcaatttcaaggcatggcaaggaatatatattttggggttgaatattttttccttgtctcaaaattttatgccagagtcagattgaaaagtcagtcacaatatatagggtcaaataaaacccatctgatgagaatttatggtttgtaggggttgactccctagaccccgtaggtgggaatttgggtaagataaaaggtgagagcttatttgggtaagataaaaggtcagtgcttagtcctcactatgatacaccggacagtgtgtgaaggagctcttagggaagtttaaagtcaggaggggagatgagaacaaggaccctaggtaaacaaaacttcggctataataaacatgaaaaagagcccagtttcgagccagatgatgtaaatgctcacgctaacggcctatgttcccgattttttttttttaaacagggtctcactctgtggcccaggctggagtgcagtggcacagtcatagatcactgcagactcaaactcctgggctcaagcgattctctcaccttggcctcccaacgtgctgggattacaggcacacacgaacatgcccagctaagttttttttttttttaattttttttttcttttagagacggggtcttgatatgctgcccaggctgatcttgaactcctggcctcaagcagtcctcctaccttagtctcccaaagtgttgggattacaggcatgagccaccacccccagccataccagagttctgattacctgatactttatctccagcttcaacacaaaatgacaagacgtgccaaaaggcaagaacacacaatctgaagagacaaacgagaaccagaaccagacccacacggaccattcctgacgtcaatgtttattgagtgcctactgggtgcatggtgcaggtgtgggagttatttggggtcgttgtgacctgggaagctaacaggccatttgcaacaataagaacacagcgcatttgccaagtgcctgtataggccttgtgctggcactgtcactgggcctagggggcatcagcgtttggctccttctctttttttttttttttttgaggcagggtctcgctctgttgcccaggctggagtgcagtggcacagtctcagctcactgcagcttcaacttcccaggctcaaggaatcctcccacctcagcttcccaagtagctgggactacagttgcatgacaccatgcccggctattttttcgtattttttgtagagacggggtcccactatgttgccctgatctcaaactcctgggctcaagccattgctggccttggcctcccaaagtgctgagatttattacaggcatgagctaccactcctgatcatgaagcaggatagtgttattaaaagtagacttaggttgtaaatgtatattacaaactccagggcaatcatgaaaacattgagaaagaagtataattgatgtgcggagagaggatggagttttattacagtgcagtcatggcaaatatctttgaagacccttaacacccatcacgactttgaaatgacagtagctacaaatacttcctaattcaaatgttatttaatgcattcataaagatgcacatttataactctatgacaagttaattttatatgttttcacaacttatttcaatataattgatttcctttgtattaataattttttaacatttttgtgcatttaaaaactttttggcctggcatggtggctcatgcctgtaatcccagcactttgggaagctgaggtgggtggatcacttgaggtgaggagttcaagaccagcctgaccaacatggtgaaaccctgtctctactaaaaataaaaaaaaaaaattagccaggtgtggtggctggtccctgtagtcccaactactaaggaggccaaggcaggagaattgcttgaacccaggaggcagaggttgcaatgagcagagatcacaccactgcactccagcctgggtgacagagtgagactccatctcaaaaaaaaaaagtctttctaagacagaatccataggcttcatcaaactgcgacaggggttcatgggacaacaaaaaaagctcatggtgtgaggaattcttgccatctattcaaactgaacaagaaaagaaatctccttaataagaaaatattctagagcacccaatctggatggaagttcatcttacctgtttaaggagaaaaatttgctttagtgtgttctatcatggatagattaataccttgttttgcagacaaatttaaaaagtaaagaaagaaagaagaagacattataaaggatccttcagaaaaacactgaacacatggcaggattcttttttactattgaggcggtggggaatcaggacagtggagacacacccacgctggggcccttagaaagtggctatgaacacagcaaagatccgattgtaaaaaaaactggctacagccaacatactcccctgctttagagatatgtcagtgtttcctgcagcttctggaagctccaaggtagatgactggcacttggctccgtcccaattgatgatgtgactgtggactgactggttcatcccacagaccgtactgaaagtcgtctcccactggcaccctcctggacacacatggagcactcaccatgcaccaggcccacagaatgggaagatggaacttggggatggtcagtatggacaggacttgtgaggagtttcctgcagagtgggccagagaagtgggatgccagatggaagggcacattggatggagagggaaggcgttctttctaacaaacagtgggaaaccctagtgcacactggctttggaagagtcttaggaggacagagctcaccatcgctttgtgcactgtttaccccagacctagaaggagtgcctgttcctgtaagacccccatctctgcccttacagtgagtttgtgaaagtccagatggtttcaggcttgctgctgcccagactaaggagaaaagccaatttataaattggagaagcgatagcatattgtttgctgatgggaatgctcctacagagatgatgcaatatgaccaaccacgtacgacccccaaatctcaaagaactttaacacgaggatacaagtcccgttactgcctcagctgtacatgcaaagaccataaggagagaaaacgaggagacagagaaaaagcactgatttacagaatgcgtgtggcctcgacagaccagttccttgtggggaatgtttgtatctcacattctcttcagtttgcagaggaaatctctcttgggaagttttcaggggacatttttctctacgtcttggtccttctaggggttttaacgacatagaactcaatgattggagatcaagaaaatgaactgttcagctaatcatctaaaaagcgcttttacatgtaatatagaggctattttcaagccttgccaggggtgggtgggtccgcatttaggcagccctttattctgtgcttcatgtgagtgcatttgtttgctcagacacatagaaccaggtggcatcctgtgctatgtctgggtggtttgggagctcaaagcccctgagaatctaaaagcaaaagcccttatgactggaaaagtgaggtcgcagacatgtgcccaaaacctatgagcctcttggctgcactcggagaactggccaagcctgtgccacactccacagggaggcctgggtagagtcacgaggcagaaagggctgctttgcaggtgctcctggggaggtcgcagcaggtgcctggaatccatcatccgcccatcatcagccccgttagccctaaggacacctggagagtcccaaggctgcctctctcgagtgagggacagctccaggaagatggaacgtgtccaaatcctcccaggcagttaaagggttgagcagcatctggtctggccaggtcagaccccacatcatttacaccaggggcgagcctgggtggacttcacaggtggatggtcctagggtccttccatctgtctgcccagccaaccagacccgatgagcagagggcagcaggccttctgtgtaacaaccactgtccaataaaaaaaccaatccagatttagtaaggagatatctttatgcaaaaggatattgcaataggagataccagaatactgcaatagggagaaagcattgaccttaatgtctgcaagctcccaaaggtgacgcagagaaggagttttcttatatagggaggaatgaatgaggctggaaagaaccacgtctggggaagtgggatgaagggtggctgaggggacaagagattgaggatactttaccctgagcctggcctgctccaggagaggccaaacatcagggcgttgggggaggggagaagctgaaccaaggctgggcaaacaagcatcttgtgtggattgacgcatggggacaaggagttcaggtaatcattgataaggcaaagatggcaatgtagtgggtgctatagtttgaataaggtgtttgtctcattaattctcatgttgaaatttaatctccagtgttggaggtgcagcctggtgggaggtgcttgggtcctgggggcagatccttcatgaatagactcctgccctcccttgtagggagtggagttcttgctctattagttcctgccaaagctggttgttaaaaacagcccggcacctcctcctctctctttccctgtgacctctgcacacaggggctccccttcatcttccaccatgaatggaggcttcctgaggtcctcatcagaagcagatgctgaagccttgcttcttatacagcctgcagaaccataagccaaaaaaagttttgataaattacccagcttctagtattcctttacagcaacgcaaaacagacaaagacagtgggcctgtcatgcatcaacaaggggcgctgtaggggaggcagaattctacctccattatcttagggtccagggtgggcccaagaattagactgacattagagagatgagcaggagaaaaacatacagttatttaatacaaatttaatgtggtacaggagccctcataaggaaatgaagatgcaaagaggcagttagagtcacttatatacagaggtggacaaacactattaagttgtgagatttgatacggccacggggcttgagtgaggatagttaatggggtgaagaaatgactaagtcaaaatacttacacactaggttgaacaaagagtagtaactgtggcaacaactaggaagataagggttagtttaataaagtttgtttgtatagatttctcttggcttctatcttggtctgtttcatgttgttaaaggaatacctgaggctggatgatttattaaaaaaaaaaaaggtttatttggcttatggtttcgcaggctgtacaagaagcacagtggctgggcgcagtggctcacgcctgtaatcccagctactcaggaggctgaggcaggagagtcgcttgaacttcccgggaggcggatgttgcagtgggctgagatcacatcactgcactccagcctgggcaacagagtgagactcaggtcaaaaaattaaaaaaaaaaaagcatagtggccgggcacggtgtaatcctagcactttgggaggccaaggtcgggggatcagttgaactcaggaattcaagaccagcttgggcaacataatgacagcccatctctacaaaaaaattaaaaatttaaaaattagctggatgtggtcccagctacttgggaggctgaggtaagaggggcctgggcaacagagcaagatgaaaaaaggagggaaaggaggggaggggaagggagaagaaaaaaaggaagggagggagggagtgaggaagggagggaaggagaaaggaagggagggaaggagaaaggaagggagggaaggagaaaggaagggagggaaggagaaaggaagggagggagtgaggaagggagggaaggagaaaggaagggagggagggagaaaggaaggaagcaagcatagggcccacctctgcttctggtgagggcctctggctgcttctgctcatggtggaaggtgaaggggaacccatgtatgtgcagaggtcacagggctgccgcgagagaggacgccagagagagaggggagaggggtgccaggctcttttcaacaccagctcttcagggaaccaacagagtgaaaactcaccctaaaggagggcaggactctattcagagggtgacaccccaggacccacacacctcccactggcccccccctccctgggctccaactttagggatcaaatttcaacttgagagttggaggagatttggaagcttccacctcccgtccttgatgataagaacgttcccttgcttttactataaggagaacatctttcatatgggaatttcatctcttgtatttaagaaacaacaagaaattcagaatgatcttcctacacctgcttcttcttttttttttttaagtgcctttatctcaaaatagacaatatgccagaaaggcacatctttaccttcttcagaatcctaaggctcatctaagccgtacaggtaagggagttctttgcaggtcataaaaagtgggagattcctttaactctggctgcatcccagagctttgtcactgtgtaaaagtggaatgccggccgggcacgctggctcacgcctgtaatcccaacactttgggaggccgaggcgggcggatcacgaggtcaggagatcgagaccatcctggctaacatggtgaaaccccgtctctactaaaaatacaaaacaaaattagccaggcatgatggcgggcacctgtagtcccagctactctgtaggctgaggcaggagaatggcgtgaacccgggaggcggagcttgcagtgagctgggattgcgccactgcactccagcctgggcgacagagagagactccgtctcaaaaaaaaaaaaaaaaaagtgaaatgccagctgggcctggtggctcatgcctgtaatcccagcactttgggaggccgaggcgggtggatcacctgaggtcaggagttcgagaccagcctggccaatatggtgaaaccccatctctattaaaaacacaaaaaattagccaggcatggtggcggacacctgtaatccctgtaattccagttactcgggaggctgaggcaggagaatcgcttgaacctgggaggtggaggttgcagtaagcagagatcacgctattgcactccagcctgggcaacaagagtgaaactccatctcaaaaaataaaaaaataaattaattttttaaaaaagtggaatgccatgtgctggcttctggaaggctcttgccacccaagtcatggggaagggagaagaggagcgctgagaagacatgaggaagcttgtgctggagagagatgatccccaccaccgcggcctacccgcatcaacccttcacaatgctggtgccagctctggtggccacgaccaacaggcatgaatataagggagaggcgcccgagtggagttccctgtgggccaatcagagagcagtgggccatcacgccacctgaggccagccaatgggaacgcggcaagctctataaaagcgagcaatccgctgaggtctgggcagaggacaccgcggggccaacagtttcggattcatggcccgaaccaagcagactgcgcgcaagtcaacgggtggcaaggcgccgcgcaagcagctggccaccaaggtggctcgcaagagcgcacctgccactggcggcgtgaagaagccgcaccgctaccggcccggcacggtggcgcttcgcgagatccgccgctaccagaagtccactgagctgctaatccgcaagttgcccttccagcggctgatgcgcgagatcgctcaggactttaagaccgacctgcgcttccagagctcggccgtgatggcgctgcaggaggcgtgcgagtcttacctggtggggctgtttgaggacaccaacctgtgtgtcatccatgccaaacgggtcaccatcatgcctaaggacatccagctggcacgccgtatccgcggggagcgggcctaggagggctatctcgccacctgagaggttgcgcaacgttcaccccaaaggctcttttaagagccacccacctggtcgaagagttgctgtagcaagctagtctcttgggtttcggggggttccttccgctggcctgtgctggcttacctacttctgattagggtgggaggctggtgaatcctgtgttcaccctgtccagttaggaggccagctactcacacgcgttacctctcagcctgtctccagtcacaaatccagctagtagtgtgtggggctaacttggcctatccgtttagataagaatcatggttggtctgttttggggacggggtgttgagggtagcctaattggtctatctccagttaggtaagcaaccccagctagttgtgtcaactcagcctatctacagttaggttggaaggctggctggtcttgtgtgttctcagctcagcctctttcaaattaggttagaagtcctgcgtgtgtgtgtgtgtgtgtacacgcagcttgtttccagtgaggttaccagtccagctagtcttctgccttgacagcccatctcctgttaaggccagcaagtagtatgtattatcttggcctattttaagttagaagtccagctacttcaccagcatagcagcttacgcctgtaatcccagcactttgggaggccgaggcgggtgtatcacctgaggtcaggagttccagaccagcctggccaacatggtgaaaccccatctctaaaattagccgggtttggtggcgcatacctgtaatcccagctacttgggaggctgaggcaggagaactgcttgaacccagggggcggaggttgcagtgagccaagatcatgccactgcactgcagcgtgggcaacagaacgagactcaatctcaaaaaaaaaaacaaaaaaaagtccagctacttgtgtgttttaactcagcctacctcctgttaatttagaaggctggctagttgtgtatctttttaacttgggctatctcccattaggttagaaggctggctaggggtgtgtgtgtgtgcacgtgcacccatgtgcacacatatgtagctgtggtgttggcccatctcgggttagaagtccatctcattgtatgtgttaacatacccaatctcccattcagttaaaaggctggctagtcatgtatgttgtaaattcaccctgtcttctgttagggtagatgactagctagttgtgtgtgagaagcccagctaggcatgtgcattgttaattcctaagtgaaatcaatactgggaaaccccagcccaaagttcaaagagggcactctgccctggaagtcagtttactgagcagtcgcagacaggcgtggcccatgtgcccagcactttgaaacaggcttcccagcgccacaaagtagtctggcagtgctctggggatgagagacacagagaccaacttgctgagaaatcctacagctagggcagcaggccacagatccaatagtagacttatgtcaggaaaacctgaggatggctgtgaggataaggatgtagggattgtctccctctggtacaggttggaatcatttatttgtgaaaggctttattaaattgaatgaggccaagcactaccccatgctgggatcatggagggaataaaatccatttcctgtggctgctgcccactctgctttcaaggtgcttatgcttgagtgaagggggcctgtattgtgtgtagaagcaatgatagtaaaaggtgctcttatacatagcaagggatgtgcataaagtgctatcaataggcaacagtggattttataagtctctttgaacccaatttatagcctgttgactcaaaattcaaaagcttcatcaatttattagtacacacacaactgaacatcataccctttaaatctcaggatgtatttaaacttatgagtgccagatccttggagggctatccagaaagcctagaatattcagggacagctatgttctggttttgaaagtcagctctgactttcaatactagactcctttgggataaatttaagttttccctttttgttttgttttttcagagacagggtcttgccatgctgcccaggctagagtacagtggctattcacagacgtgagcatagtggccagccttgaactcctgggctcaagccatcttcctgccttagcctcccgagcaggtgaagttcaagtcttctgtgctttacaaagcccttgtcctaacaaagtcttgcccagtggtggagagctaaacctatgtaaccttgctgatgatcttgctggatagcctggagggagcaggaatttgggcagttagctacatttgcggaactggatgcagataatgcattcttgacaggatcatgatcaagctttgccttctgtaggagaccaagccacttaagcagccccctgtcattctggtctttgtatgaagaacagagtctaagttgggcagtgtggcacatgcctgtaatcctagctactggggaggcgagaggatggcttgagcccaggagtttttgaggccaatctgggcaacagaccctgtcaaaaacaacaacaataacaaaaacaacaacaacaacaacaaaaaacaagagcttggccttatatgttccttgttttcactgattaatggagtggatagtgcactaattgtgccctataaagatacagcaaggcaatacagggcaatttgtatctcagaactgattgctgaggacctaaggtgaggagctaaggaaggaagtttagacacaggaaaaaagtaactgaagtctttctgggtcgtgtaagtgggcacttgaggaagtctttccagccaggcatagtggctcatgcctataatcccagctttttgggaggctgagatgggaggatttcttgaggccaaggagttcaagaccagcctggacaacatggcaagactctgtctctacaaaaaatacaaaaattatctgggcatgatggcgtgtgcctgtggtcttaactacttagaaggctgaggtgggaagatcgcttgagcccaagagttccaggttacagtgagcagtaagccgtgatcacaccactgcactccattctgggcaacagagccagacccttacaattacgaccagagcctttgcttctgtatcctgtgggttctaacgatgtgagatagtaactgaaatgtggatatctgttcactgtgtactcaactcttcgagcgcatgtacactatggaggtagcctgagcatgcagtgtttataaaagtggaaagagtggttctaaatatcaaaaagttaaaattccagaaataatagaaaggagagttaggcattaagagatagtgctatgggccttggtggactgaacaaaggaggacaaaagtgggaataaagacaaagacaaaagagtatatttggaaaaaggggtcagggggctccttgcttctagtgaacaagggccctgagcttctagagcccttcttattaagtaaaggagacagggataagggggtggttgtggtcagctgcttgacttagtgcaggcctgcatgactgcattctttgaacagtaggctccagatgtcccagtagataacctcaaggagcacagagccagggaatgaggccctcagcgtaccttctggtggcaggcacagatgcgagtttgcccacatcctgcattcatgataaacagtttgctgtttagtcatatagcctccagtggaatgctgagttggtcacgaccctcaggctttcagctcccaacaagatagcagaatagacctccccaaaatatgcagatttgatataagaattattttgagctgaaggcacttgaagaacagcaggtgtaagaagggccctctgaccccttttcctgaaagcaggtgatgaaccctccatgggaaaggtgcttgcctctaccagcagggagaaacagcatgactaggcatggggactgaagtgcagcaaaatgtatacaaacaggctttgttaaagtagctcttatcgccaggtagagtggctcatgcctgtaatcccagcactttgggaggccaaggcaggcagatcacctgaggtcaggagttccagaccagcctggccaacgtgaaaccccgtatctactaaaaaaacaaaacaaacaaaaaaaatcagccaggtgtggtggcgcgcacctgtagtcccagctacttgggaggctgaggcagaagaattgcttgaacccaggaggtggaggttgcaatgagccacgatcacatcactgcactccaggctgggtgacagagtgagactctgtctccaacaaacaaacaaacaaacaaaaatagctcttaccttccccagcctccctaggtattccagttgctttctcacaattactaccctttgttccatccagtggataagcacttaggcctaactactcttgaggtcttcattttgctgtgaaggctcccatgtacatgtacaaatgaaatgtgtatgctttctcccattaatctgtcttctttcgttttagtctatgcaggctgctataacaaaatgctatggcttggtggtttataagcgacaggaatttattgttcacagatctggtggctggcaagtccaaggtcacggtgccaacagattgagcttctggtgagattctgctttctggttcacagacagggccttctcactgcgtcctcatgtggtgcaaggggtaaggtgaaaataaatctctggaaaggcaccaatcctattcatgaaggctccacccttatggcataattactttccaaagaactccatctcctaacaccatcaccttggaggtgaggatttcaaaatgtgaattttggagacagacattcagttcataacaatccggatttgtttttctgtggctcagtggactctcctgttgagcagtctgaattgaagacataaagaggccatggctctcttaccctattttcaggagcccctcttcttttccatttaattcagcctattttaaattgcatgagcacttaaattttgctctcgaatcttttctacaatgttaataacttagtgggggctgcattcagtaagggcaaaggatatttaccttgtagcagtgtaagtaagacttgtgtttcaagactgacattgctgatcctttgcttaaataatttgaaaaaaaaaaccacaatccacagcagtggtatttaatttaagaattaaattattaaagtagaattcaatttaagaattccaaaaggatatatagtgaaaattgagcctccctcaattagggggttcctcagcccttaatttccctcatcagatggagtttcttgtttatttcttgtatattttccaagagatacatatacagtaattatgtttacctaaatagtggcagactacatatactgtacatcctgccttttattaaacctaacaatttatcaggacacataactgctatctgattttttcttaatgacttgaggatatgaaggttattccaattgttttatcatgatgatagatttctcagctcaataaccaggtgagcctaaaaagcattaataatgagcatcctgggctgatgccacattttaacaagtatttgttgaattccccacatcatgctagtatgggaggagactgtgaattaaattgaccaaagacagacgaacaggagaaaggcatccatgttgtattgatcttaatatttttatatgcatggggtgtacaggaaagaagtgaaaacccaaagaagttgttaggctcagctgcttgtaaaccatttgtaacaaagggtgataacgtgtcagcaggtgactaggacatgtgtggtgctatgcaagatatagatatattccatttcccctctaattctgtgattctgttttcccaattgaaggaaacctgcagctcacaatcccctcactgatgcaaatgacaggcagaggattgggtctgcccaatccccaatttattggggaaaataaatcttgggccccaaaatcactagctaaaaggaaaagtcaagctgggaactgcttagagcaaacctgcgtcccattctattcaaagtcatatctctgctcactgagataaatgtatatctgattgcctcttttggaaaggctaatcagaaactcaaaagaatgcaaacatttgtctcttatctacctatgacctggaagccccctccccacttccagttgtcccgcctttctggatggaaccaatgttcatcttacatatattgatcgatgtctcatgtctccctaaaatgtataaaaccaagctgtgctcggaccaccttgggcacatggctgtgtcatgggcgtgtgtccttaactttggcaaaataaacttcctaattgacttaaactagcctcagatattctgggttcacaagggtaattcacttaatcggccagtgtgcgcagccagcccgcacctgacagcacacagacccctttgtgtgtgcgagtgatgagagaccacagaagaaacactctaccgagtgagcccagggaaagccagccatctatgcctgtggccagctgtctacacccgcacacccaggagattgcagaatggtgcctcttagccttcaaggccctgttttcctgcctgtctgcaccccctgtgtgggccaagccttagtttcttcatctgtcctctctctccaatcccaggactctgactcagggcacgcaggcctctggctcctgttcctgaaagcaggagatgaaccctccatgtgaaaggtgcatccctctactggaggatgaagcgtgatgactaggcgtggggactcaaggccaggagaaatggccaccagtcaggacctgggcagggctgggggcggcattttggctgaaaccgtaagagacttttaaaccagagcaactccatcttgtatagaggctgggtaaaataattctgagacctgctgggctgcattccccagaggttagacattccaagtcacaggatgggataggaggttggcacaagatacacgtcataaagaccttgctgatgaaacagtatgtggtgaagaggccagcaaaatcccaccaaaacctagatggcgaccagaataacctctggttatcatgactgctcattatatgctaattttaatacgttagcatgctatgagataccctcaccagtgccacaacagtttacagatgccaagacaaggtcacagttaccctatatggtctaagaaggggaggagccctcagtttctggaattgcccttccttttctgggaaactcatgaataccccaccccttatttagcatataatcagtaaatagccataaaaatgggcaacctgtagccctgggggctggtctgcccatggagtagccactctttattcctttactttcttaataaacttgctttcactttactctatggatttgccccgaattctttcttgcccaagatccaaaaccctctcttggggtctggatcaggacctgtttctggtaacaaaaccacctggggtgtcggcaagacccaccccgtcccgcctggttctaggggacctgacctgccaggtggtccctccaaactggtccgcccacaggattgggacgcccctccctgtaccctcagcctgatgctgactgccaaccatgtgggcagacctggcggctgactggctgctcctggggacccccttcatagcttctcaacaggcactcgctcctgctgcctcgcccccaccccagcccacacaaactcctctccatcccctaccccgaccaacttagcccctcacctaaccctccagcctggggctcgcgtgccctcccgcagccccaaccccaggttgagaagcctcttccaatcccactccccccaccctgacgctcgcctgcccgcccctagccccaccagctgtccccattccactccccacccccaagtaaccccccaactccccaccctccacactcccttaacctcccctaaaagtcccaccccaggccaacaagactcctcccttcgctgggctgtggaccacatcctccccaccgcccagtcagcacccgctgcgcctgtccccggctcgtccagagccttccaccccctgccgccttccttccccaagccacccccaacctctcctaagaggcgccgccccagtcccggccgccgaacactccctcgcccagcattcccctcccccgccgccccccagcccccgctgacgccacaaagtccctaggcctcccgaccccaggtccccacgccccgggccgggccgcagcctcctgggcttcgtgggggcagacccagcctttcccggcagcgagcgctcggccaggtgcactaggcgctgtgcgggccccccttccccgcggtgagtagcccccaccccgccgcctaggctaccctcctgtggcgcctgggccacgacctaagcctaacccggtcctcctcgccctccaacgcccggccttcccgcctccgccggccgccgcgtccctggaggggctagcgcgcttcaacaaggtaactctaccgggaccctagcggaccagagcgggaaggacagccatcccggcagccagagccagagccccaggcccgctgccgctgtccctgcccggcttcggtcagggtgggctgggtgcctccgttagggctcttggggggagtcggagggctggcgccgggtggttggcgtgcagaaagctccgagaaactggacgtgggacagagccggggaagtctgagacccctagacgccctcgctttaggggatggcagaacggaaggggagaatcgtgcttgcagtgtagacgcgattttcaactccttctgcaactcggtccccatagcaaccccgtggcgtaggcgaaagtctgtagatctccactgcgtggggtcgcgagtgttgagattgcagggggcatctatgtgcatgcttgtgtgcctgtgcgtgtgtgcgcgcgtgtacctgtgtgtacatgcatgtatgtttaccgatatgtgcatctgtgcctgtgtgtgctgtgtttgtggatcagtgtttctgtgcgtacatgtttgtatttgtgtggtgtgtatgcgtgggtatgcgtgtgtgcacatgcacgtttgtatacatacatgggtatgtgtatgggtgttcgtctgtgcgtacatgcacacgcgtgttttttctgaaccccacctcactaccgaatggaagagagcttttttcctctgatagcccatcccttcttcctttggtgtacggggttttgttaaagaaaaaattctgacatttgaaaggctctttagtcaggctacttgcaatgggagagttgcgccagcaaagacagctggggatgtatgggggagttggagtggggatctgggtggggtcagtggatggaaagtgattaagggaaggctccaagggtaggggcttctccctaagctgacctagcaggcttctccagaaaggcaggttgaaggcctagccggcaacggtctgtcggggaggaggagctgatgagatgtggagctgggggtagccagcagcaggcggaagtggacgggtagggtccaggcccagtggagaggagaggcggaggggcctgcagagcattggtcagggagggtctgtgtagtttctggggaggcatctgtgtctgttgttgacaaggctaaaaatgatgactctggactctctaactggactgcagtcctagccctcctctgtaaagggaggctgtacaggacggttgcacactgccggcgcccagatcatcgggctgctccctccaactctctccagagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaaggtaggccacatcggggcccaggtcaaggggccggggaggaggcatccagggggacaaggtgacccagatcatgggggagggaggaggtgtccagggacaaagtggcccgagtcaggggctggggaggaggcatccaggggacaaggtggcctgtggctgggtaggggtgtccctggggacaatgtgggcctacactgtatgatgcaggcattgcaaaatcttacctctcctctcagagtattttgggtggctctgagaaccaaactgatttgagacagataagcagaagcaaagcactgaaattcattccctgtaagctttccatgacccaggagtcgctcccaaggagccagaggcccatggaagcatgttagagccaaacatgtacctgaggaggatgagggttagtttagcagggtccctttgcacagatttctctggtttcggctttcccgcccttggtaagaacatggctttcctcctggcctagggcagtcctctctggcatggtggctgtgccttctgctcttaggaaggccgagggtcacagcaattcttacacctgcccttttttaagtgccttcagctcaaaataatccaaggtggcacattctgggtgacgtattttgatcccctgcccctcctgaggagggtctctggggtgggtgcagtttcagcgagcacaactggactctaggcaggaggtagggggatcgctgatcccaaatcctgcggtttgtgtgtcccacagttgaagctggaggaggacatggagtaccttcgggagcagatcaccaggacagggaatctgcaggccagggaggagcagagcttagccgagtggcaggtgggtgcccagggctgtccagtccctttcctgctgctgctccatcttcctgcatttccacgtctgtgtctgcccgtggggatatgctgccgcagtggcaggaaaagaagaaagttgcctctacccttctaggttctgtggctggcctcagaatgaaactgacttaagacagatgaacagcagagaaaaagataaaaaggcaattttaaattacagatgcacacatagggtggagagaaggggcctcaaaaatcagactcaaagaggcagccagagggtaggggctcagtaccacaaaggaggcagccagagggcgggggctcagtaccacaaaggaggcagccagaaggtgggggctcaataccacaaaggaggcagccagagggcaggggcgtaggtcagcaccacaaaggaatagggcttgggggcctctgggctggggaggcaggtgatgttggttaagtatttaaacaagtgtctcaggtgaagagttgtttttggaactctctttctggtatagatgccttgaccactggaaattccttcatgaaagggcactttttaattttttttttttttttttttgagatggagtttcactcttgttgcccaggctggaatccaatggtgcggtgtcagttcactgcaacctctgcctcccgggttcaagcaattcttctgcctcagcctcccaagcagctgggactataggtgcccaccaccatgcccgactaacttttgtacttttagtagagatggggtttcaccatgttggtcaggctggtcttgaactcctgacctcaggtgatctgcctgcctcggcctcccaaagtgctgggattacaggcataagtcatcgcgccaggccaggcactttatttttttaggcagctaatgggggaggcaaacaggttttcctgcttctgcgggttctcaatggcctttagttaaccttaatcctaatgcctgtcaaaacacaaaattaaaacagatttagagatctttgttgttattttttgtttttttcttgagtcagagtcgctctgtggcccaggctggagcacagtgatgcaatcatagctcactgcagcctcaaattcctggactcaagtgatcctcctgcttcaacctcctgagtagctgggactacaggcacttgccaccaagaccagcttttttttttttttttttttttttttttgtagagacaaggtcttgctattgcccaggctggccttgaactcctgagctcaaactatcttcccgcctcagcctcccaaagcactgggattacaggcgttagccactgcacccagctaagagaaaagatttatttgcaaggccactgagtgaagaggagggagaacagctcttaaacctgcctcccaagtgatacagcttgggagtctttatgaactacggaggcagggtggtccagcaggcccattctgtgcaggtgtcgtcggggtgcatggcatttcacaggacacaggtaccagaaacggcagccttagcatgatctgaggttggaagttttggccctctcacatcaaaaggccacctcgggcactgggacaggtccacttgaagggcagatggtctcaactggtttcagctggacaggagctgccccacattcctgaagcgaccagtcccatggtgacctgtgaatattatctataaagagccagtgaagggtgggcgtcagcattcagaggcacagccttcagcttcatggaaaaaggaaaaacaaaataacaaaaagcaatcagggcaggctgacctgatcagtgaaccccttggtttcattagcaccagtgactccattctggttgggtctggtcttctaggacccagcgcaggagcccagttcaaaacagtggcccctgaggatcacctgagcccaggagtctgagacagcagtgaaccatgatcatgccactgaaccccagcctgggcaacatagcaagaccctgtctctacaaaaaaattaaaaattagctgggcatggtggtggtgacacatgtctgtcgtcccacttccttggaaggctgaggtgggagggtcacttgaggccaggaggtcaaagttgcagtgagttgtggttgtgccattgcactccagcctgggcaacagagcaagaccctgtccctacacaaaatttaaaaactagctggatgtggtggtgcatgcctgtggtcccagctactcagatgacttgagcccaggaggtcaaggttgcaataagtgccactgcattccagcctgggcaactgagcgagaccctgtctcaaacaaaacaaaacaaaaaacaatggccacccataaattttgtttaacatgcccaagaggcttatctgggggtggacattctgaacctcctcagagcaagggtgcatgggtgtttggatgtgtagaagttgcagttcggggctcggagggttacactcagtgtatcacaggatggcagaggtgggggcctctgtcacagttcctggtccccaactaaagctccagttgctggtgatcttgtgggtcaccagggccctggggagaggtgccagcatccctggagctgagccacctgctggcaacatgctgggcttctccactcctgcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggtgagccagtaggcttggcaggcagggtgggatgtgagctctgacaggcatgggcagggggcgctgggcttggggaagaggcagccaacgggaaagggctgttagctcccagtctgctagtcctggaggctgggtggctgaggccaaggtgcgggcaggcctggttcctcctgagcctctctcctaggcctgaagatgccgtctcctccccgcgtcctcatggcatcatctctctatgcacgtctctgtcctaatcatctccttgtataaagacaccagtcagactggattagggcccaccccagtgacctcaactccctccttaaagatgctatctccaaacacagtcacattctgaggtcctgagggttcaggcttcaacctgtgaattagtggggacacaagtcagccccttacaggttccaacctgagacagtgtccccatttccttccaagtccagagaggtggcttgggacacctggcagccaggtgtggctttgggacagggactccatgtctcggtgtggaggaggtgcactgtcccaggagtgagttgtgtggcaacggcagtggggaggtgaagcagccagcctgtctgccgggaccagcctgtgtgccatggccctggagagggggcttgattacggctgataagacgccatctctacaaaaacttaaaaatattagcagggcatggtggcgtgcgcctgtggtcccaggactcaggaggctgaggcaggaagactgcttgagcccgtgagttcaaggctgtagtgagctattgcgccactgcactccaccctgggtgatggtgagatcacatctaggaaaaaaaaaaaaaaggaaaaggaaaaacaaagcagcctgttcacaacccactacattggtttgctgaccaactgagggaaaagcccctgcagctggtagaagggtgctcctatgagcagagggccaagcgcgccacctgcatgagagtccctgcctagagttagggtcacgctctggcaactagaaatatggcctttggaaaacaagtcccttgtagcttccaggccagagaagtaaacagtgatctctttagggaactctgaatccctaaagaggctacagaaaatccccaggtgcctcagtctcttacccacccccctccctccccaaactgcacccaattgcgcccccaccccattcctgctgagtgggctgcacccacctgaaatgggagaggagggtcagtgttgagtggccacttgcctggaaggggtccctccgcctctcctgagttgcaggacctcaggcgtgtggccgtgggctgacagggtagctcagcttaggtgaggcactgggggctctggtggtagtgggagctagggcagtggggaaggctcaggagtgccatgaagctcaattgtgggaagggaatgcccaggggacaggatgggtcttgccctaagacacggacaagaagggagcagggacattgaggtgagccaggagcttggctcactccccaccctccgtccctgtcttttgcaggacatgaaggaacccctgagcaggtatgtggtcccctcaggcaggggcgggggcagtggcagcggtgggcgggggggacaataagactgtcgggccaggggagtcaataagactcccctgtgtgtgcccaccggaggaagaacaacgtgagtgtgcagtgcccagaggttgcccccccaaccagacccaggactgtgtgcagagttcccggacagattgaagtgctaagaggctttctaggtaagtgggcacccagggccaggacctctgacccaggatctcttggcgatgccccactgtaccccctagcctcggaagccaccaatggggggggttctacaagtgcactgcctggtgacggtcactggctattcactgtgccttcgtagggcggcgttactggtggttctaattcatgggatgaatcttgttgagttcccagtggtctctctgcccagccccctgtaccttattgccaccaaggcccacacacaattggtgtgtggaagcatcaagtaaccccagattcacagcaggggaggcctctgcggagttaggggaccattggccacatccaccactagggcccggggactcccacctttgaccctgaatgccccacacctctccccatctctccaccaccacgcccatctacagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacaccaggaacagcgtggtcacgttttttttagccatgcccccacccccactttggaatgacaggaatctgtggctcccagcccccccaggggtttaggttactctgtcaaagaagtagaaatatcctatggtggggaggagcgggggtggttgctgtgtcagggatggtcccaggctgcccatagaaatgtcctatgcatcctattgggtccttcgatgggggaaaatgggaaaggctgaacccgtaaaaagcctcagagctgcccacccccatcccgttcgatccccaaagttgcacgagcaggggcaaaatcccaaagagattaggatttatgtaggggcctcttttccacagcgcccttaccttttccaaggaaccccccacccacccctgcagggtcaagcactttaacagcctgtgtcagtcactagcaaggcagaattccagagtaagcgtactcctacctcgacaaagccggagtgtctgcgcgaggggctgcctggaacagcatgcccctttggagtggttcccgcagaaagaatgtgggcctcctggagagctggtcctggagggatgcccccgtcccatcccccaactccaatcattctgaccttggcctgccaaggctgtgagggccgggccttccgaggatacccgccctgggaagcacgggctgagggggtgaggacgcactaggggtatggcgaagggctccaatgccccaggctgcggactcccttagtccttgcagttgcttccgtgtgccccgccctgagtccccatccctccttgccctgccccctgctccatccctcccctgcgccccgccccctgtccccatccctcccctgcgccccgccccctgtccccatccctcccctgcgcctgagtcctccccagggcaggggtaaaagacctggccacaagaaccggagcggtggtgacgccaggtcagcaagtgaaagctctccaattccgtcccgcccgcgggccgcgtgactggcagcggccaatcggaggcaaaagcgggttgttccaaaaaaaaaaaaaaaaaaaaaaaaaaaaaaaaaaaaacacacaaaacccacccagtcgcttcctgcttccgcctcggctcctcttcctgccggcatccgggatccctacgtcccgcgtcccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatggccgcccccgacctgtccaccaacctccaggaggaggccacctgcgccatctgcctcgactacttcacggatccggtgatgaccgactgcggccacaacttctgccgcgagtgcatccggcgctgctggggccagcccgagggcccgtacgcgtgccccgagtgccgcgagctgtccccgcagaggaacctgcggcccaaccgcccgcttgctaagatggccgagatggcgcggcgcctgcacccgccgtcgccggtcccgcagggcgtgtgccccgcgcaccgcgagccactggccgccttctgtggcgacgagctgcgcctcctgtgtgcggcctgcgagcgctctggggagcactgggcgcaccgcgtgcggccgctgcaggacgcggccgaagacctcaaggtgctcctgggcgggggtggcgtgcaggggcgtcggggagccggggactggggaggcctgggcgggtgggaggtttgggggactgctccgggagtaatctgtctctgtctagggcggggagctcaggatgcagcctgctgtgggcctgtgaggggggtgtcgcgcagggtggctgtgggggctcatgacacagcctgtttcaaccaggccccttgaggctgggaccatggccgccaatgagaccctgctctcgggggtgaggggcgtacctctcatagatagaggctaagagaggaaggtggaaggtggaaggtggtggagtgggggcaaggaaaatgtggccataccctggccagcaaggagctggaatcagaggaaagtgggagaacctcagaggtggccgatcctagatggactccctgcagggactgtgttagcaggtcagtacttaagtcctgggaaagccccagactgggcaggatgagggggacacagtcgtttcctctctaacctcccctccagggctgccctgcatttctgggtggggtactgggagccatctctgccatctgagatgccagggctcagcctgccttttctccccttgtcttgctgcttaaaacccaaataaaacccgagctgaagggcctggggcacacgttccctggcctgcgctccctcccgctgtcctctttcctcgctgacctgctgcaggtgtgctcctgggagcctacgtgtggggcagatggcagcatctttggagctttcttgattgcactttgtgtgttgcatcatggtcacttgtgtgtgccagatgagcagttaaggcagtgttagaatcagtactgagcttgatctgtccctatcacagagcaaacttctgggatactagaataaatctgaatctgtccccttctgctttggattttagcagaaaggtggtttagagccatatccgtgggcttgttcagacacagattcatttgggttttcttttctttgcccatgcaggaatgtctacacctgaaacatgttagcccagcagaattacccttgtgacaccaattaccccaatgggtgcagagagtgcccaatagctctatagagttgactcgatatagtttcatgggatagcacttaaccctttcttttgcaggtgaagaaaaaaatttccctctaccctgttaggttcagtggctcagggctgcaaattaaactggcacaagacaaattaacaggaaaaaaaatcatacaatttgattaatattttaagtttcacatgcacaagaacttcatagaaaagcgtatttcagcaaaggtttgtgaattgtggagaagtgactggacacagaaatgggattgggcgtctaggactgataaattgtgggaaagtgactaggaaatagatgggaagaattaacacaagataatggtcattgtagtaaggtctgtttaggcagaatcatctcccaggattagagtgccctcctcttcctggtagagagagggtgcctttctcatggggaatgaataccctacttttaggcagataggagtacagagagctcttcctgcatctgcttttactcagaataattcttgtaccacagcggtatatttggggatgacatcctgttcttcactgccttagagcctaggttatgttaaccacagcaaactgcttttacctgcccccatgggcctagaaagctcagtcccacctatggggctgtgtgtccacttgccagagctggggcccattagctccatgacaggttcactccttgcctggccctgacctggggtcatgacagctgaacaagccccaggctgggttgccccgaggtggtaaacagggaagtcccagtaagctccagttccaggaagcagcaccatgggagagagaagatggcccccagatctctctgggttgtgtgtcagatggcacttgtgtggggagggggtttgccacaggaaggaggaggccagggaagatcccaggcctgcaccaagccccagcatcccagttctgactacacgcagggtaagaggtttctgttctgatctggccagagacacaaagatgcaggtacctgaaatgcaagatctttgccatgctgggtatgttgtgctgctttacagcccattccatctgatcaaatgctgtttgtaaccttagtgttgaaaactgaaaacgttggccaggtgtggtggctcacgcctgtaatcccagcaatttgggaggccgaggtgggcggatcacctgaggtcaggagtttgagaccaccctggccaacatggtgaaatcccatctgtacaaaaaatacaaaaattagctgggtgtggtgatgggcacctgtaatcccagctactcagggggctgaggcagaagaatcacttgaacacaggaggcagaggttgcagtgagccgagatcgtgccactgcactccagcttgggggacaaagcgagactccgtctcaaaaaaagaaaactgaaaatgtcccgtagggactgaggcattgagggagaagtgagaggcactgggccaagtgtttgaggtggggttggggtcacaggggccaggcctgagttttctggaacaggtcggcagcagtgaggagagaggcctggggacagggaccgccatttggggttcttgtagctcacgtgagagctgagcctaggcagagacagtaaagcagttggacatgtccttggtgctccagcggtcttcccgaatcgtgaggccaagtggtgaactaaagtgagcacctggagccaggcagctgggctgaagtcctggctctgctaccggggcagacttctggaccctcccagcacctccatccttccagagcgtggatagcgagagatgagagccaagacttggggtggctgagaagcaaagaggtgtggccagcacagggcccgttgctgataagggtgtcagatggggtggaagtgagcagacccttcgagaagtgggttcagggcaccccaagcacacacagtacagtgagcttgtgtacaggattttcactgcttcctggtatgcacagcatgaggaaccgtgggaatgagaattaaggaccaagaaagcagaatggaggtgtacccatcctggagcttattacagtgatagctgatgaagctgaaaatgcacaaggtcccgagtggcttggagaaaagatagggtgggtagccaggcatgtctgtccgtgctgactgtcctaccaaaacaccatggtttgcacatggcagatgtatacaagctggagactcacagctctggaggctggaagtctaagatcaagccctggcaggtttggtgtctggtgagggtgcttcctggttcacagacaacaccctctcactgtgttgtcatatggtgaaaggggcgagggttcctttataacactaatcccattgtggcggcactgccctcctgacctagtcacctcccaaagcccccgcctcctaacatcatcacactgggtgttgggatttcaacctatgaatttgtgggggcatagggcagaatttttggaccccagcataggcttggtccaaggcccttatgtgagccagcaggtgagaaggaagaggaggaggagtagacactggcttgggaacaggagagctcagcaccttcagagccagcttggggacagatggggtgggcagccagaacccttgaggtagctttgcaaaggggggtgaggcctgggctagggtagcaaggtcgaggactagaaatgccccatatgagaaaaaggaaagaatgtggctggggctgtcagcctctggcaagaggctgcccacctaccatgagggctcacgcttattggagggcattgagttccctgattcaccaggcagatttcagtttgtccccattgtctttgaggaggggacagggtgtcaggtgcaaaagggcaggcttctgtgacaggactcatgtctcatggtcctgcctggcctctcccgcaggcgaagctggagaagtcactggagcatctccggaagcagatgcaggatgcgttgctgttccaagcccaggcggatgagacctgcgtcttgtggcaggcaggtgctggggctcccagggtcctgggtggcagggtagggggtgaaggtcctgtataggagaccccagggggcgatgctggccaggcacacttgcccttggcgccccaggaccagtcactgcttcagcctggccccaccgagcccactgaagggctggtcctttcccacgtgcacctgtcctgccaggtcgtgggcgtgggctcccatactgcaagggccccatcctggggtcccagcatgcttgggtggcaactctcaggtgtatttagggtctgggccctggaggtaaatttggaggttttgagggactaggtcatagatgtgggattcagccatcctgaggagtagatttgggatctgtccagttctggggtagatttggggtctgggaggctctgggtggtggatttgggatctgggaagccccaggggagaatttggaggtcaggagggaccctgggtggtagatttgtagtccagctggccccaggtggtagatgcagggttctaccaagccaatgggtggatttggaagttggggagggactagatagtggatttgggatctagtcggccctgggtttagatttggggtctagccagtcctgtgtggtagaatgggatttggctctccctgagtggtggatttggggtttgggaggtgccacaggtgggtttggggtctggccagcaccaggtggtgggtttggggtcctgccacacctggtgctgtgctttggctttagcaggccccgggggtggggttgggtgcagccaggcctctgggtgggcttggggtctgaccaaacttggggtctggctgggcctggggtctggcctcagctgtccttctccctgggctccacagaagatggtggagagccagcggcagaacgtgctgggtgagttcgagcgtcttcgccgtttgctggcagaggaggagcagcagctgctgcagaggctggaggaggaggagctggaggtgctgccccggctgcgggagggcgcagcccacctaggccagcagagcgcccacctagctgagctcatcgccgagctcgagggccgctgccagctgcctgctctggggctgctgcaggtgagctgggcggggagcagccatggtggccacacgggcatggcctggccacactgggggagggagaaccagaaagtgcaagaagcaggggcagagaggttgtctgggctgagaggtgaatggcatggctggatgtgcctggctgttgcctgtgaaatgctgagtcagcagcaggacagatgtcccacccccaaaacccacgtgccgagaaagggaaaatcaattttcctctgtagatgtaaacagttgatgtttcttaagtgattacataaggtcactccatctcgtcctgactgacactgctgctccctgtgggcacagcagagtgggcatgtgctcgctgggaccaccttgggcctcccataggattcctgccatggtgtccccagcaggaagtcctcgcccttcactctgtcttcaccccgctggcacaccccatgcatctccattatggggggcagtctcctcctcctctgcttccaggagagtcttttcccatgtgtgggctccactccctgagccggccccctgggcctgggctttccttggtgcacccccaaaccagaaccagtggacgccctggcctgtggcctggcggcaggtcagggggcctggagtcagctctctccgcttggcaagcgtgcactgatgaggactgacggcactcccatgctgagaggccccgtgtgggctgggagtgtctgctatcatcttcccgtggggttcagctggatgtttttcccacaaaatggagaacgtgttccatgcccagcatggtgtagactcaaggggccccaagattcagagggaaatgggcccctgggcaattctggctcccacagaggagagaggccgtgtgtgagtgaattcagccactggtggggcagggctgccagacccaggtggagcccacaatgctgcagatgtggctgggcggctttgcacagggggtgacctgctgccggcctctggagcccagcagaacatcagtccaggcaccggctcctggtttcgattgtcatttctattgtaagcttttttctgtttttttgttttttgtttttttttttttgtttttttttttgtagatttaaggggtacaagtgcagtcagagtgtagccatcacccgaatggtgcacactgtacccagtaggtagtttcccccacctccaagtctgcagcatctgctcctccactccgtgtgccgcgtgcaccagcttggacatcagctggctttgagcctgggaagcgggaaggacgctcggctagcgtctgtagaaagactgaggaatattaggagagggtcctgtggtcagtaaattgtggggtggggaggtacccagaagactgaggaggagccctcagggagggcagagaggacaggtgttggagaagccaggaagggtttagaaggaaggtgagttgacctggaaatggggacccacagggtttgtgtgaagatgcaatttgggctttcagctgagacattgtggcatgtgggcgggtgggtgggtgttgggtctcatacacccacctgcattcaccccgctgagtggcccacccgtccatgccttggccaagctccctgcccaggtttggcctggctacaaggcttcagggaggtccctcctgtccccccaacctgccagcacatggcctgcatgctgtgggggtctgcccacatgggggttgcaggagagcagcctcagcagctctgtgttgatgtgagctgtgtgctggtttgagagggacaggtggggatggctttgcacccttggcccccggttgggtaggggaacccaacccgggttcccagcacccaggccgaatggacaggggttgcacagtggaggtaaaggcttgagtgactcccaggaatccacccactggggctctggctgctgtggactctggggccctggctgctatggactctggggtcctggctgcccccttcagcaggccctgcttgtagccgcagagtggttttgttcaagtcaatgctgcccctggagggcccgtgttctgtgcagagaccaaacccccttgtcgaggccaaggttctcctctacccccaagcccttctcctgccgcccctgcacccggccttgtgacagccaccacctgtttccaaatgacaccaggggtgggccgcccaccccaggtagaataaccaaggtggagctgctcccagctgccttgctcacaccagcaccatctgcccctgccctgtgcacacccctccctcaccctgcgcactccccctgtgtctaccaacaaattcttcttgggcttcagaaccctaccaagagtctcctctttatttatttatttatgaattatttattgagacagggtctcactctgtcgcccaggctagagtacagtgatgtgattatgactgcagcctcgatgtcctgggctgaagcgatccttccatctcagtcccctgagtaggtgggactgtaggcacacaccaccaagctcagctaattttaaaatttttttttagagatgggaccttgctgtgttgcccaggctggtcttgaactcctggactcaagtgatctgcctgccttggcctcccaaagtgctggcctcctttttaaaaaatttttggggcctagagtgtgttgttgtccccctagacagaattaactacccgtatgtgtggaaatcttcctttgccatttctcctacatgtagggaaacccttgtctgggattatgtcttactgacctctgcatcctggcctggtagctggcaccacgtgtgttagaatgaacatggtgtgggatcgtctatttgacagtgtgggttaaatccttgcagtgcactgaagactgctctaagagatacaagaccgtgtctcctaagagctgatgttccaatacctgggtgtatcacgccagctcgggctgccacatttagtaccacctgccaggaggcttccccagcagagactgattgtctcccagtcctgcacactggaagactgaggtcaaagctggttccccctgaggcctatctcttgggcctgtagatgccttttcttccctgtatcctcacagggtctcccctctgtgggtgtctgtgtcctagtcgccccttcttatgagactcaagttattttggattgcagcccaccctaatggcctcattttactatgatttcctctttaaaagcccttttttctaatagtcaagttctgaagtcctgaagtttctggcttcaacatacggatttggcgggatggacacaattcgggccctaacatggagtcagatgctatcacgtatcaggcagtgacacaggaaggacgcacgcccaagagtggggctgagcagggagcctgcagggcaggtggagctgggagaggaagcagtgcaaccacagggttgggctccagctggggtggaggtgcccctatgctgaaggctgggatgtgtgcctgtcctgtccttggcacccagaggcgcccacttggggctctgggtgagtgagccaacagccagatgccctacatccaagtgtcaggcagaagtgggccttggtccgcagggctgggctgcaccccattggtgatgcctcctggcacacatgtcagagcctctgtccagcattcctgtgtctgagccttgctgcgggtggtttatggccccctgtgtgtgtttttgctgcctgacgctcaaatgtaggagagggggacggggcgaggctccaggggcggggaggggactccaggagcaagcgatggtcactgacaccgagtgtgctgtttctcctccccacataggacatcaaggacgccctgcgcaggtacgaacccagcctctcctggagggggggcaggagggagtggggtgggacccagctgttggccatggcgacaacacctgggttgtcccctctagggtccaggatgtgaagctgcagcccccagaagttgtgcctatggagctgaggaccgtgtgcagggtcccgggactggtagagacactgcggaggtttcgaggtaggtgtggaggccccaggtggggagatgactccaggaggggacctgccaaggacctgggcagccagccacgtgttctgtgccctgccactgccagctccaaactcacagtgtcatggtggtgggttgttgggaaaacgtcctctgctcatacttctgacatcagttgtgtgggtattttcacaccaaacaattcttcaacttctggaaacgaattgggtatccaaggattccattcagcattgaacagaattgccagtgctgacactacaggagttagtacagaccccacagattaagggctcagtcccataagactgcccccacttcagatgccagtcacaacttccaggggctgcccatacttctgttccctcagcgcctctgcagatgtgagcattcgctagcacagcccatggaactcagaagagcactttacttactgtcattggtttattgtgaaggataccactcaggaagagccaaatggaagagacacatgggcaaagcctggggaagggctcagagctttcccaccctccctgggtgcaccttcccagcacctcagtgtgctcaccaacctggaaactccctgagccccaagagctgtttaggtgtctttgtggaggttccattacatggttatgattgattaaatcattggtcattggtgatggggctcaacctcagacccctttccccttcctgaggtcagaggctggggctgagtgttcccgccctctactgacaggattggtctttctggtggctggccttatgctgggctctcaggtccccacctcagccactgcagtggcatcaactcaggtgtgatggaaaggggcatcttatgatagcacaagatgcttctatcagtcaggaaattcccagggttctgtgagctctgcgccaggaactgggcacaaaacccaaatctgagtcttgtatcacagtcacccaaaggaagtactatcctcagctcttgctagcaggtcaggagcctgttgtgtaggaactgtgtgcaggcctccagaggtggatagatctgaaatcggagtggtcagggttgggacagctgccctaattcacatccttcatttggagattgaaaggaaaaacagactggatgcattggctcacctctgtaatcccagcactttgagaggctcaggcgggaggattgcttgaggccatcagttcaagaccaacccgggaaacatagcaagactcccatctctacaaataaaaaacaaaaaaatgagccagccatggtggcacacgcctgtaatcccagcagcttgggaggatctgaggcgggaggatcatttgagcccaggagatcaaggctgcagtgagccatgatcgcaccactgcactgcagcctggggccacagagcaagaccctgcctctttaaaaaaaaaaaaaaaagcaaccaagattccctcttgatatctgaaggcaaaacatggaccaatttgtaggacattgtaagttgcaactggacgtagctaagtggggagaggatgtccacttggagacagttagttactccaggaggttgtgaggctacaggcccagggcagagagccaggccgtccgactgggaggattgtacctacatgcccaggacatgggcagatggccccagcttgcctgtggctgtgcctgggtgaccttgggcctctctctgcaggggacgtgaccttggacccggacaccgccaaccctgagctgatcctgtctgaagacaggcggagcgtgcagcggggggacctacggcaggccctgccggacagcccagagcgctttgaccccggcccctgcgtgctgggccaggagcgcttcacctcaggccgccactactgggaggtggaggttggggaccgcaccagctgggccctgggggtgtgcagggagaacgtgaacaggaaggagaagggcgagctgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatctttcccgagatccccttctcggggacgctgcggcccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagctgcacagttcctgcagctttgccagccccctgaaagtcttgtgtaccccacctctgaagatgctgggggaggcagctgggatgggagccagccccatgcctgtctgtgaccccacagtgggtgagagcccgtcacagtcctgggtgtggctgctctggaagaattaggaggcagccataataagagtcttcagagagatgatgggaggggccagtgaggacaggaacagagagtagatgtcctataataaaggggcttctgggaggtgcctgggcacagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtcccagctgctgcttggggatgtgcactgctggccgccggccttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctacaagtcatcctgctggtgcctgcttagtccaggaacaatagcgggtgccccactgcccagcagagggcagagccccagggaggctgttgacggggcaggcgggaagctcaggcaaagtaagggccgggacgggcagccacttcccacacccaggcacagatgggctctccactttctgtgctcaatatatatgttccttatgtggagctattgccggaatgtttttttcgagatatcctggtaaatgtttcctgcattccattgtgcttaacgagtagtctcctgattatcatttattcagtcactctcccattcttgtcttttttttggcaggggcctgggggggcattatgtaataccatgttgaacaagatcagcagtttcattcagctgcaacaaagagaagtctgagtggaaaccaggggactgggcatttctctgtgttggggtggggtttttgtttgtttgtttgttgttttttgagacagggtcacccatgctggagtgcagtggtgcaatcacggctcactcactgcagcctcgacttcccaggctcagctgatcctcacacctcagcctttcgggtagctgggactacaggtgcacgctacagatggggccatgcccagctaatttttgtaaagatggggttttgccatgttatacaagctggtattgaactcctgggctcaagagatcctcctgcctcagcctcccaagtagctgggagggactacaggcgcacaccaccatacccaactaattttttttttttttggagaggtgggaatctcactattggccaggctggtctcaaactcctgggctcaagcgatctacccatcttggcctccaaagtgctgggatttcaggctgagccaccaggcctggtgcggtgagtattgccatagcctgtttccaagcggctgtgtccagggcttccctccaattgaagactccgtctgctgcgtttgtgcctcctggagtgaggcagcccccgccacctcagaattgctgatcttgttcaacatggtattaggtaatgccacctatccccctaccaaaaaaaaagacaagaatgggagaatgactaaataaatgatactcaggagactgtaatgaagcacagtggaacacgaaacatttaccaggttatctcaaaaaacaattccttcagcagctccacataaggaccatacacctgagcaaagagcggagagcccatctggctggtggtaacagccgggggcagccttgtgggtgagaccacgggtgtgcacccaggatagttctggccatagctttaaaataaagctgcacactccataagagaagggcagacttcatgactcatctttccggatgtccccctgctgagtgctgaggccctgtgggtgtcacccatgcttccaggcagtggaaagatgatgggaacatgcaggaccctgagcagggagccagtctctcagaggaggtgacagtgaacggcctgaacaactgtgtcctgcactgtcagggagccccactgtgtgcagcttgcagttgaccaaatatttaggttcccccaaattcatatgttgaaatcctcaccgcaagttcatgttatgaggagatggggctttggggatgtaattagttcatgaaagtggtgccctcatgaatgagattaggccctctgcaatgggaccaggtctggaggtctgcacagtacatcaccaatgcaccgtcaagcatggtccaaagacagggttgttgtgcaggctcccattgcatgttctcctccacacctgctgtgcccacctgacagtagctggccaccctcagagtgcccatgatgtcccaagagctgcgggacattgtcatgccgtgggctgcatgcagggtgcccagcaccacctgtgcagcacccaaccgtcctggtgcccccctgcgcccttgagccccctgcaccccagtgcccatcttgcatgctgcaccctccccatctcacccttgcccaccacatgccccctgtgtgcccaatgccatcctcccacacctgcagcctcccagtgagcagaccccccagggcccatgggtcacccacgcaccctagatccccttatgccctgggtggccacggagcccattgcctcccatgttagcagtgcccggagcctctggtcaccccacacccagccccgtgcactccaggcacccagagaagccccgcacaccctgtttgcttccacgcctcccatgtcctgtcccttcccaggtgccctgtgttcgcttgggcaaccctgccatctggaggaaggcctcctggtgctggtgtggagctttgtccccgccgtgccccggatccctgtgctttccctgccctaccctgccctccccagcccggagtcacctctcccgaccaccctgactttttgtaacaacttaattgtggtatagttttcacgcagtaaaattcagctatttcaagtgtaccattaaaatgatttttactaaatccaccgttgtcatgattcaattttagaacattttcattcctcagaaacacgcctctggcctatttctagtctcctaatatagcatatttcattacctgcttttccaccactgaaccagtcttaggttcctggggtaaatcccacttggtccttttactgtcttgctctattgcagttcactaatacttcaagatttttacacctgtactcgtgagggatattgctctgcagttttctaaaaggacggggtctcactatgtttcccagaggtctcgaacccccagcctcaaacgatcctcccgcctgcctccccggttgctgggactacaggcctgagccacccactgggctgtggtccatagtgttttcgtggtgtgtttgtgtggctttggtaccagggtgatgctggactcctgagttaggaagcgccctcccccactgtcctgaaagagtttgggagggtcgctttctccctttatttaatattctgtaatctccagtgaagccgtgtgatcccagcctttcccttgtagtggattttaaattactagctcaattgctttacttgttatgggactggtcagatagttcatttgttatgtcagttttggtaacttttgtctttctagatatttgcttattttctcttggtcagtaaaactaacgtttggtcacaaattgattttttttctttttttgaaacagtcttgctcttttgcccaggctggagtgcagtgccacaatctcggctcactgcaacctccgcctcccaggttcaagcaattcttcttcctcagcctctcaagtagctgggactacaggcatgtgccaccatgcctggctaatttttgcatttttagtagagacaggatttctccatattgccaggctggcctcgaactcctgacctcatgatccacccacctcagcctcccaaagtgctgggattacaggcgtgagccacagcacacggccacaactttttgttgcatttaattttctctattatgtttctgttttttatttcaataattttcaccttcctctttattgttttctttatttttcatgctttgagtttagtttgctcctctttttttttgagatagcatctcattctgtagcccaggctggagtgcagtggcatgatctcagctcactgcaagtctcagtctctcagtctgtggccactgcaagtctcaatctgcagcgggctcaagcagccttcccacctcagcctcctaagtagctaggaccaccagtgcacaccaccatgcccagctaatttttaaatttttttgtagagacagggtctccctgtgttgcccaggctggtcccaaactcctggactccagtaatcctccctcctcggcctccccaaaatgttggcattacaggtgtgagccactgtgcccagcctctttttttttttttttttttttttttttttggggatacagggtctctttctgttgcccaggctggagtctagtggcatgatcaaagctcactgcaacttctatctgctaggcttaagcaatcctcccacctcagcctcccaaagcactgggattgaagacatgaaccactgcacccagcctttttctgctttcttaaaattgaagcttaggccaggcacggtgggtcatgcctgtaatcccagcactttgggaggcccaggcaagtggatcacgaggtcaggagattgagaccatcctagccaatatggtgaaacctggtctctactaaaatacaaaaaattagccaggcgtggtggcgcgtgcctgtaatcccagctactcgggaggctgaggcaggggaatcacttgaacctgggaggcagagattgcagtgagccgagagatcacgccactgcactccagcctggcaacagagggagactccatctcaaaaaaaaaagaagcttaggttattgatttctgatctttcttcttttctatttatttatttttgaggtggagtctcactcttgtcgcccaggttggagtgcagtggtgcaatctgggctcactgcaacctctgcccctgggttcaagggagtctcctgcctcagcctcctgagtagctgggattacaggtgtgcaccaccacacccagctaatttttgtatttttagtagagatggggtttcgccatgttggccaggctggtcttgaactcctgatctcaggtgatccacctgcctcggcctcccaaagtgttgggattacaggcatgagccaacacccaaccctttcttcttttttcttttttttttttttttttgagatggagttttgctcttgtcacccaggctgtagtgcaatggcatgatctctgctcactgcaacctctgcctcccaggttcaagcaattcttctgcctcagcttcccaagcagctgggattacaggtgcctgccaccatacccagctaatttttgtatttttagtagagacgggttttcaccacgttggctaggctggtctcaaacccctgacctcaagttatccacccgccttggcctcccaaagtgctgggcttacaggcgtaagccgcccagcctcttcttttctaatgcagggatttatggctatacatttccctttaggcactacttgagctgcaccccatgactttcagtatgccattttcattttcacttggccaaaatacttcctaattgtgtttgagatttcttctttgacacacagtttattttaaagtgcattgtttaattttcaaatatttgtaaattttccaagtttccttctattgttgactttaattaaactccattttggtcagaaaatgttctttgtgtggtgtcagctgagaccggttttacagcctagtggattgccaatccggagaaggctccacgtgcattgggaagaacattcattctgctgttatccattggagggttctgttctgtccatgactatacccacgagagtttaatttatggagatgactgaatgacaacatggagagcctaatgttattgaaagaagaatttatggctgggcattgtggcacacatctgtaatcccagcactttgggaggccgaggcaggcagatcacttgaggtcaggagtttgagaccagcctggctaacatgttgaaaccctgtctctactaaaaatacaaaaattagtctggggtggtggcacacacctataatctcagctacttaggaggcaggagaatcacttgaacctggaaggcagaggttgcagtgagccaagatcacaccatgcactccagcctaggtgaaagagcgagactccatctcaaaaagagaaaaaaaaaaaaaaagaaagaagaatttatcacttacttttcccaagagaaggagcatgccaggacaccagggccacctgaggaaacaccagggtcagccagggggtataaaggagcaggggcaagcctgggccagaacctttgatgggatttctgtgggaaagacaaggcaggacagggtaacacttaggactggtgactctataattctggtgggctttgggctcagagaccatccctagctgccaggtgcctggccctgggttaatttaggcatattggcttgtgctgagggtttgataaggagcttgttgggatctgggctctggattggttggtctgaaggttaaaggtgtggttctgggcaagccctctggctgtctctgagaaatggcctgccctgggaggaggaggctgtctctcccctgccatctaggccacatgttcagagcaacaagaatatagaaaataaaaatatatagtgaatacagttggcactgtgatgacaggttgccaaatagacaaatctagaatcttagaacacacagttgtggccaggcatgatggctcacacctgtaattccagcactttgggaggccaaggcaggcagattgcctgagcccaggagttcgagaccagcctgaccaacatagtaaaatcccatctctactaaatacaaaaaattagccaggcatggtggtgcgtgcctgtaatcccagctactagggaggctgaggcaggagaattgcttgaacctgggaggcggatgttgcagtgagccaagatcatgccgttgcactccagcctgggcaacaagagcgaaactccgtctcaaaaaaaaaaagaaaacacagaacatttatggatgtcagttttgcccaattggctgatagtgttttgtaagtcttctatattcttggtcattttttctagttattttgttcattattgaggaagtgctattggaatcattaaccattattgttgaattgtccatttttccctttagttctgatagcttttgcctcatggattttgagactctgttgtcaggtgtgtgtatgtttatgaggcgattccaatcttcctaaatttattaatacttgttttgtggcccaacgtggtttatcttgagaatgttccctatgtgcttgagaagaatgcgtcttctgctgttgttaggtagaatatttgtatgtgtcttttagatctaattggtgtataatgttgttcaagttttctgtttgcttattgatcttctggttgttctattcattattgaaagtggggtattgaaatctcttactattattgtgttattgtttcttcctttagttctgttcatgtttgctcggctgttaggtgggaaaatgccatttagcatttcttgtaaagaaggtctagtggtgatgaactccctcagcttttgtttgtctgggaaagtcttcatcttgcctttattttcaaatgaaagctttgctaggaataagattcttggttagcagtttttttttccttcagcactttgaaaatactatcccactctctttcagcctgcaaggtttctgctgagaagtcccccagtaatctgattggagctcccatgtatgtcactttcctcatgctgctttcaaaattctctttttgtctttgactttggcaatctgattataatgtgtcttagtgtagacttctttggtttatcatattgggggccgtttagacttcacaaatctagatgtttatttgcctccccagatttggggagttttaaggcattatttcttttttggtttttagggcattatttctttaaataagcattctgcccctttctctctctgttctaggattcccttaggctttctttattcctttttattattatttttttgctcctctaactggataattttaaatgacctgtctttgagtttgctgatttttctatttgatcaagtctactcttgaattcctctagtgaacttttcagtccacttattgtattcctcagctgaattcctgtttgattcatttttatatcgcacaaattttgacatagttttttttcattctcatttggtctcctttgtcatttcttctctgactcatggattacttggaagtgtattgtttatgtcaaacacttggagatttttcagatatatttaactggttactggttttcaatttaattatgttatgggcagagaacatactctaaattatgcagttgccttaaatgtatgcatctatctaactatctatctttgtatatctatctctacatctctatcttctgtatctctgtatatctatcatgtctatctattctattacatctacctatcatctaactctgtctctatcttctatctctatacctatctcttctatctgtagtatttatatccatccatccatatctctatctagcatatctagctacctatctgtgtctatcttctatctctatcaatccatttatctatatctgtagatatctatcttctatagctctattatctatttttcaatatatctttgtctctatctctacctatatcatctatttatcttctctatcttctagatctctatcatatcatctatcatttctatatctgcctctatctgtatctttatatctctatcatatatttatatctgtgtatatctatctacctatcttatctcttagcccagttgcccaaggtaccagtatccttatctgcaggtgagcatgaggacctctgtgttgaagacacatcaacctttggatacagaatgcagagtctcaggagataggccaattatttgcattttgaatgctatctgtttctataccatatggtagtaaaaatttgcatggtatgattttaaaaacttgaatttttaacttaatgttctatgttctgtagtaatctcattttcatgttaccaaaggaaacctgttatgaccagaataaattattttcccaacattgaactaagaattcctagagctggggaaataaaggaatgtcctttgctgccagcctccttccttcctccttaggatacctctttaaaattaattattaggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaattaattattagtttggttttcccatttaatagagaaattatttaggatgttttctaaaatgtccaagtagctagctataacttgctgtttattctttgattgacagtgactaatgtcatttcacagtggccaggaaatgtgggctgtatgatctccactttgagaggattttgacccaatgcctgggtcatttatgtggctggcctctggatatctgaaagtaatatgaatccttcatttgctggtttcaaagtactatctacctatcttcctgtctatcacataaatgtttccagtgatgccatcaatagttacagaaattgattgatttttatatatctgacctattgatttctaaacacaatatattaaaatcttctactatgattaccaatgtaccagttatcaattttgccttttattgccatagctttctgtttcctagatactaagttgttgtgattttatatagatagatagatagatagatagatagatagatagattgattgatagattttcacccacagttattggctcttaactcataaaatccttgggatcgccgaagtgttttctttagaataccttttgtctgataggttccagggtggggctggtccctggaaagacaaaggcaggagtagagagttgggactttcagccccacacccaatctccagggaagggataggggctgaaggtcaagttgttcaccaatggccaatggtttaatcaatcatgcctatgtaacaaagcttccataatccaaaaggactgggttcagagagcttccgggtagctgaacatgtggaggttcctgggaaacggtacgcccagggagggcagggtggctccacgcctcttccttccttcatactttgccctatgtgtctgtatcctttgtaacatccttcttaataaagcagtaaacataagtaagtgtttcactgagttctgtgagccgctgtagcatattaatggaacccaaacaggggtttgtgggaaccccaacttaaagccagttggtcagatgttccagaggcctggacttttgactggtgtctgtgtggggggcagtcttgggaagtgagccccaatcctgtggggtctgacactatctccaggtagacagtgttggaattggactgaggacacccagctggtgtctgctgcttggtggtggggagaaacctcacaggtttggccacagaatcttcttctgtgttgattgctgctgtggtgtgagagcagaggagaaacgccatttaagagagcttttcccttgtatagttttgatatattaggataatatgagtaatttccctgcagtaatgcctaaagcataacaggcactataaatggtgttaagccctgttgttagtgttaattgttattattcaccatcattttggttggttggtgcccaggctatgttgtatttgtccttactggaaagttacttgggagaagagacacagacctaatccatactatgtgtccagtgttctggtccttgaggggtttcagattcagaccatgtttatttcacacataactctctgagtggacggtccagcaactcctatggcgactcatgctcattcctacagttcttgctctggttcaaacacattttgtccttcccccttatccactgtgattttctgactcccccaatatgagtgagacctgtgagcaataaaacagccctgagaactattcgggaactcctgatcagtctgaatgttggcactgcacagcctagtcttgcaatcaagcaaaaccaccatggatgaacctggaagacactatgctaagtgagataagctggtcacagaaggcaaatgccacagcattctccttacgtgaggtatcaaaggaagtcaagttcataacgacagaaagtagaataggggctaccagggcctgggaggagggagaatgggttttaatgaggacagagtttcagttttgcaagatgaagagttctggagatggacgatgataatggttgcaccacatgtgaatataattaaaaatacagaactgtacacttggctgggcacggtggctcatgcctgtaatcccagcattttgggaggccgaggcaggcggatcacctgaggtcaggagtttgagaacaacctggccaacatggtgaaaccctgtctctaccaaaaatacaaaaaattagctgggtttggtggcacatgcctgtagtgacagctacttgggaggctgaggcaggagaactgcttgaacccaggaggcggaggttgcagtgagccgagattgtgccactgcactccagcctgggcaacagagcaagactctgtctcaaaaaaaaaaaaaaaagaactgtatacttgaaaatggttgaatgataaatgttatgtgtattttatcacagcttaaaacttttttaacaacttttgccctgtgaaagaccctgttaaggtgaggtggctcacgcctgtaatcccagcactttgggaggctgaggtgggaaaatctcttgagcccaggagtttgagaccagcctgggcaacatagtgagaccccatctctaaaaaaaaaaaaaaaaaaagtaaattagccagatgtgatggcatacacctttagttccagctactcaggagcctgaggtgggaggatttcttgagcccaggagttcaagactgcaatgggccatggttgtgccactgcactccagcctgggcaacagactgaaatgctgcctcaaaaaagacaaaaggctctgttaggaggaagaaaagacaagcccaaaagtgggagaacatatttgaaaaccacatatatggcaaatggctggtctccagaatatacacagaactcttcatcctcaacatttaagtaaacaaaccatctggttagaaaatgggcaaaagacatgaatggatatttcacccatgaggatataaagctggccaatgaaatgacaacacgacgcagccattgcattcttgggcatttatcctagagtaataaagatttacagtcacacagcaacctgtgtacatgaatgattatagcagctttatttgtaattgcccaaaactgggaatgacccaaatgtccttcaatggataagtggttaaacaaacagtggtgcatccgtaacatggaatattctgcagcaatacaaaggaatgaactattgacacatacagcagtcttcatgaatttccagagatgtcaggcaaaagataccacatataggattattccatttatagaacgttcctaaaatgacaaagttatattagtgcagaacaaattgttgggtgccagggttaaggagtgttactgtgggaggaaagtggatgtggttatttttatgcctttttgggcagcataagggtttcctcgagatggaaatgttctctgtcttgactgtaccagtcttaatggtcgtcatattgtactacagttttgtgagatgtcagtgatggggctcagaatgcaataccccaaattacggcaccttggcatgctgagtatctcaagctgaaggaaattgtgtctctctgaccgtctcctgcttttctgccttgaaggaagccataagagaattctctgacctacctcccccaaaagcgggtcataggatcctcattccagaggccaagaagaatctgaacaaacgggccttggcaagttgcccccagtttattaccattaagttgcacctgctttttgtctaagcatatttttacatgactgttcattcttcatcaaacccaagcataaaaaatagacagatttgcctgtttctttgggtttttgtttctgaaggctcacttgtcacataaaaccttttgttaaatagatgtgtgtcatgctttatcttattaacctgtctttgtgattggggccatacgtgcaaggttcatccatgcgccttgcaatgggtgaggaaaagatactaccttcccccccaccccgccctgacatcagtgtcctgggaaagtgagtgcacggtgcctgtaccctttgtgatgcattgagtggtgacatgctgactctcaggaggtcgtaaaggaggaggaaggtaaagtcagaggcagtgtgggggcagagggagtgagggcagtcagttcaagttagaagatgtttgttttctttttagagacagggtcttgctctgtggtccaggctagagtgcagtggcacaatcacagctcactgcagccttgacctctgggctcacctcccgagtagctggtaccatgctggtggcatgcaccaccatgccaagctaattttttattttttgtagagacaagagtctccctattattgcccaggcttgtcttgaactcctgggctccagtgatcctcctacctcagcctcccaaagtgctgggattacaggtgtgagccactgtgcctggccgatgcttggattttgattcaaagtgtcctgggctcagtaagatttcaggggaggtgttcagcatttggacattgcagaatggacccatcagcatgtggtcgtcattgggcccctgagatgagctgagaatcaggagggtagagactgctgtctacaccctgcagccccagccccccaggaacgaagctgtcgtccaacgtcagccttgttgctggggacagtggagatcatatccccaccccgggaaccctggggctgctcgagaagaggatgctatgaagagctgactgttttggtgattaaaaggagtgtttaaaacaaccgggcctcattctgggttgcatgctgtcagagagagccaggacaactccatcactggatgtccccataaatctaagctggccaggaatcagcatgacccattttagccaagaggggtcggttagcctcctctccatctatgcttagacataggtatgaggggcctggccttgtgtctgagggacctctgcaaaaggttttatgtgcaagaggagaaggccctccctgccagctcccaggtctcctgggctgcacctatctcaagttccctttcccacgtcaaagaataggagaaaggacattcagcagcgtttgagagacaacgcgcgcaccccacggcccaggcttcctgcactcctggcaaggggcagggcggggctcggccagcgtagtcattgcccatggaatctcaaacactgggttgcttttcaccgaggccacgcgccagcgactctgaagcctcctctcctccagcggatcgtggcccgcggcttctcgccctcgcttgcacgctttgcccaagaactcttcccggggcagagaagttgtggaaacaagcggctggcccgacggcggagaaagcgggctgcggggctgcaggtcagcgtgatggaagagaggaaggcgcacggcgggtggaataaacgcgcatgggtgtgaggacggagacgccccgaggggctgaacgcgcggagcatcggagtgagggagcgacccctaaggacgccttctaaggggctcacaggcccaaacacagcggggcagcctgatcggcgccccagccagaaaggcggggacagagccctcactccctctcctccccaaaagaaaataatgcaacgagacggaagacttctcgcccggctgtgcgtttttattggcgcgtctgcagcgacccccagcggggagaccaagggtgtggccggggcgaccctcagcgcacctgggccaggttgtgcctcttgtacagcagcgcgcgtctcttctcgcgattgcgcacgaagacgcgcagccgcgcggtagggaaggtcacgggcgcgggccgcgaacaggccgggccctcctctgttagccacgggcactgcaggcagctggacgcgcagggccggcccctgggacggacataggctcagcacgtggcccagcggcgggaggggtgtggggaaggcaagtggaaaaggggagagggggaagggagagtaccgaggggaaagggagtgggggggcggggcggggcgggacggaaggaggagggggcgggacgggaggagggggcggggagaaggaggaggagaggggcgcgccttaccagggctgggcgcacagagtgctgcgcaggaaggccacggcgcccccggacagccccgcgtagcagcggctcagccggaccagccccttgcgcagtcctctctgcaggtcgcgtgcaccctcgctgctcaccgggtactcggcgctcagcctgcgcaggtggcgggtgcacgggccctgaggtcaccctccttgggtagaccagggcggagggggaggggatgcaggagcactgaggtcaccctcgggtggccggtgcaggggccgtgaggtcatcctcgggtggacgagggtgcaggggccgtgaggtcaccctcaggtggacgggggtgcaggggccctgaggtcaccctcgggtggaggggggagactgccccgcccacctagcaacccccagacaggttggaggactcacatgatgaaggctgtcacaccgatggcccagatgtctgtctgtggaacagccccctggccctccaggagctctggagctgggaggggcacatgtggttgggctcaggtggagggacacaggtggtgggcatgagtgagtggtcccaggtgggataggtggggcacaggtgtgtgggccaggtgtgtggctgagtgggtggcagtggagctgggagagaggacagcactggaggagagggggcttcttcctgccccccgccccaggtgaggtccccccaactgtccacacacgcacccatggtctctaggtagtccttgaacttgtctgagggcagcaccttctcctggctgaggctctgtgcattgcccaggtccacgaccttgagcaggttgtattcggtgatgatcatgttctcggacctcaggtccaggtgcaggatgtgctggttgtgcaggtactgggtggcactcaacatctgccacaggtagtccttcacctcggattctgagtaggaggccctggggggcagaagctgctcagcccaggctccggggtgggggccaccagggccagggctgagactactccccgtggactgggaggggcactggctgtgcagaggggcctggtcctccagccccaccccagaggcctgggtccatcagtccatcagtccgtccatcagctcaaccacaccaccccaggccaccctcacctctcggccaggcaggggagcagctcgggcccagagcacagctccaagatgagcaccaggtgccgggggctgaggtaggctgcgtgcagctgggccaggtgcgggtggcgcaggcccttgagggcctcgtattcgcgcagcactgctgtcttgtccttggggtggtaggggatgatcttggcggccagcgcccgcccgctggccttctcccagcattgccgcaccacgctgaagcggcccctgctcaaggggacagcggtcaggctggtgggtggtcccctcccattccccgattcccaacactcagagcagcaggagcccagttcagcgagatggtgggtgtgggggcatgggtggtcaacaagggggggtccaggccctggccccacccgcctgcagccccccaggccactgcacctctggatctgtgtctggaatgcgaaggtctttgtgctgggcaggggttgggctgaccgcccctggctctcctcctcagaggctgtgggaggaggggcagatgataagagggggtgaagagggcatccccacagccccagctctccccacgtctcccatcaccccttcccaggcaccttgacagctgggactttgagttacgcactcccacctcttgttcctcaggttctgggggtatggggacagggagggggtacagcaagcagtgagaggcaacctgagtgagggtgtgtgtgagggctgcaggggcatttgagaatggaccacccatagcaatcatgccctctcttcctcccttgagcccagggcagacattactaatcaaccctagcattcctccaccaaagctagaggcagcacaggccagtcactaccaactctcactaccaacactcagaatgaagcagaatggacttgtgtgctcgtcaatgagtgcatgggagtgtaggtgagtgaagggggggcctgggggtgaggcggcccctaaagtgtgtaggcctcgaatgccaagcccaggagcagctgtctccccagaaggaagtggacagctatggagaccctgcacaggagggagcgtaatctgggtcttctagctgctgttcccaccctccaagccccgagtgtggtgtggctcacccaggtggctgggccctcccaggaggacttgctccgaggggctgctgtagggacccattcctgccttgctgacacatgccgtgcggaaggtgtaggtgccaccccgggagagcttgctggtcaggtagcagcagtcaaagatgtcggaggccagtgtggtccagctgccgcctggccacacaggagcacgtgaggggccactgaggcctccacacaccacgtcagtgggggtggagaaacccttccctgaggccacccatgggaacacagcaggccaggcatctccccaagggcccctagacatggctcccgggaggggtggccggagcctcgggtacaggggccacctcataccttctaggctgcactgcacaatgtaggtcacagggccgtaggattccacgggcttccagaccagcagcaccccatccgcgtacacctccccgatatccgggcatggcgaagatgaggggcgctctgcaaggcactgcccaatggtcagtgactccagggtgggcacccagcctccaggggccaatatctggctggcgcctgcctcaccctggcagccaccagggctctggagcccaccctccctggtcctgttcattcagggtccagtcacagtgaggaatggtaggaggggcctctcctggcgaggggctggggaggtgtctgccctgccagatcccactcctgggctggcccatccacctgggtgtgaccagaaccctgtgcaggggccgagcctctggtcagaagggcccttggtggggctgctgggcttcactgggttgccctgcacaggttcaagcaggccggcccactctgggcattgggccaggggtcccagagctaggcctgtagcccccatcctgaccacctcagaaacacgccccagggaactgtgttgtgcttgtaactcgactttgattgaggcatggaacgggaagcagcccactcctgcataggctggagggatgggcatggaaggaacgtgggaagatggtgcaatgggtcatgcgcccgagaaactcagttctcccggcaagtggccaatgggatgggctttctccctggcagggagcgtggatgaacaggcttccttccaagccctgtaacgtcagcagctgcgtccggccatccttcccaaggctggttgtttctgctgggaccagctcagggcctcctgccagcccaaggcagcctgggcggtcagaactctgtgttgaccttctcaggcctcctgcagccctggccatgtgtggtgcctggccccatagggatgtgggctgctcagggtcagggagcggatgcctcagcggccaatgcacgggcccggaagcattccacgcaggatgaggcttcccagcagccccagcccagcctccctggcctggtgggacccccagtgtggcccacgtacctgccttccggaggacgcccgtggtggtcactgtccccagcgcattgctcacgctgcaggtgtacacacccaggtcctcagccaccaccaccaggatggtcagaagctggaagttcttgagggtggcagagatgaggacacggctgctgctctccaggggggctccgtctgcaaaaggacagagcaagcctcatgccacagccaggcctcacacctctccctgggcctcagttttcctccagacagcgaggcatcccgtggggccagctcacaggatggccactcacccgatttcacacagcccccagcccctgggacagcttcttacctttgctccaggtggcctgggcagctggctgggctgacacctggcaggccagtgtcactgactggcccaggaccacagtctcatctgagagctcccttaggaatgtcggcgctgaggagggagggtgaggtcagccttcaggggtgacctccaggccccagagcatggcctggaccctggagacaccaggaggagccctgccccaccactgccaactccccagcctggcccatctgtaccaccatcacctcctccaggaagtcctccaagactgctcagttcactacacccaccaggacccctcatctgttcccgcacccatgtgagtgcaagcttgctccccaccggtctggccacgctggtgggaccctgagaggcagtggggcctggtctctgtgttgggcctgctcacctcggtcccagctcttcagacctgagagccggaaggaagcaaggcctggcttcttcctggggggcccctccttctccagacctgcaggaggaagagggccagtgaaggtcatggtcaggaggcctggcccctctgggtagtaccagctgcctctggctgcaaggaccccgagcagctgggacaggaagaaattggggtcggctggcccgctgcccactccccagacttccaggccacagaggacagaggaaacatgaagaccaggcaccctccccacctccaggcacggggtcaggagggtccagggccagggaggactatgtggttggggagaactatggggttgtgaacggtttgggggtctggaagggttttggggtcagggagggcctgaggtcaggagggtctggggtcaggtagggtatggagttggggagggtctggggtaaggtagggtctggggtcagagaggactatggggtcaaggaggactcaggaggatctggggttaggaaggtctgcagtcaggcaggatctggggttgggagagtgcagcgttggggtgtctggggtcagggagggcctggggccgttcgggaggactcggttcagggaggattatggttcaggaagactctggccccttcaaatgctttccccaggggcataccacctacagcctccccagacctccaccgctatgttaggtcccagggctgggtcccagctgccctgtggggagggttgtcagggctgtagaggtgatcccaagattcagaggcctgaggcagggacaggaggtgtgggcagcacctggacaccagcggggggcccctgggagcctcctgccgtcacctggagtgcagtaaccttaggtacagaatgggggcccctggacatgcaggatgcttggggtggggtgggggttcaccttccggcctgcccttcaggatccgggagatgtgctccacggaggccttcactctctcacgcagccccagctctgcaggctcatccagcggcaggtgcctcccagggaagtggaagaggctgcgtgacggcgaggaccacttgcgcttcctgcccacggcagcctctgccagcagcgcgtccacatcctctgactcctctgtgatctccaggcctgcgtgggggcccagttcacctggccagggccacgtgggctccgggaactcggccagctcctcctcagccatgggggagggcggctctggctgagcggacttggggactttcctgaagatcataaactcgaatgggaggtacttgatatcgtacaggtctgagaggttgaggtaggcggggtccacctcggaaatgtccagggatattgtgtcggccgcctccgcatcacctgacaggtcccggatctgcaccagggagacctgcccgatgtcctcccatggggtgggctctggagagctcctggtgggagccctgccgacctcaggcacaggccttgcactgacctggggcagtgggctctcagccctggcctcctgctgctcctccgactgggactcagccctggcctcctcctgctcctcctcctctgactgggacacagcccaggctatcctggcccacatgggcccctgccccagcatgccccctgcatctccaccaaaggcaaaggtgccatagccagccacgcctgcgtagcccccgcgaccacccagggagaacttgcgcatggtcgcctgttcctgaggccgctgcaaggtgggtgtggagtcggacagatcctcagcctcctgggtccagccctccgcatccagggaggggccaggctctgtgcccacctgggaggagcccaccctgagggagctcacttgggaagagctcgcctgggaggctgaccctggggaactgcaggggccgggttttggcctcccaggaagagagatgtctccaggccccatcttagagtccaatggggggcttgctttggcaggggcagggggtgcctggggctgtcccaagaaggggcttgagggtactaagggggcctctttgcaagatcctggagggaaggagccaggagggcatggggcaactgctgggtgggggctgcagccctcctggggggcagaaccctgcttggggtggcagaaaggggctggctgcccccaagggctgtccggggatggcctctctggctgagcagtgcctgggtggccaccagtggatggaagctgcttggagccctgagggtgccccatgtccctgataggggcccccccggagggggctgaaggcagtcgctgtgcctcaccgcaggcctccgaggaggggcggggggtgctcggagagtcatgttccagggagtggctgtggccaggggccaagtgggtgccagaggcaggcagccggagggcagtctcgaatgagggggctttggccaggagggtggcctgctcctccctggcggcctcctcctccagcacgcggtgctccatcagtggctcgcgcaggcctggcagcgcccccgcaatgtacccgcccttcagcaggtgccgccgccgggccgggtgccgcctgctccccggggccagggccccgtgctcagggctctcacccgcctggtggtagaacaggctgcggatgacgctgtgccggggcacgcagccctgggcggccggtggcccggcaccctcgggagatgcaggcggagctggggcctcggtggagcgctcactggcctcggcttcctcaggcaggctggccgagggccgcaggaagccccgggggtgcagcagtggtgagtgtgtcaccggggagggtggcagtgacttagcccgggcaaatggggcgagctcgttgtcagaggaggaggaggaactggaggagccaccagtgtccctgcagaggtgccgggctacgccgagggaggggctgtcgggtgggccccgcagcagctcagggatggagcgcatcaccaggatggacttgtagctcatcagggaacgctggaaccgcatggggggcagcaggcatcaggtggggagacccaggagctctggggtcctctgcccccagggtgcagtcattccaccctcctgccccatgggattgtgtgcacccaaccccgctgtgcccagcagatgactcctgcctcctttcagcatgctcaaaggagcccagccccgcttccctgcacttctgggtgcgcagctggccccgtggggcctcagtttccccttcactggtccctactcagatggtcacggctcacctgccagcgacttcgggccaggaggaacttgagctgcttggtgttgatgaagtgggcctcctccgcaggcatggatttctgggagaccgaggtgggcagccacatggcagggagaccatggtgccctgataggggcccctcccatgatggaagcccttctgggcagccccagccctgggattccctggatccaggacaccacagccctcacccaagatgtccaggtggggcagatggcaaaggccagaggtcagaggtgacagcgaccccctgtccctgagctccttgcagttctccctgcctcctgctgggggttgggggctggggcactgaaatgtggttccagcctgaggttcccacagccctctcactaacgcacagggacaaacgtcctctgggctgggcagaggtcgggccacagccacagttctgtgctcacatgccctgttgcccagaggccctgcccctgttggcctcaggctccccctgcatagtgtggggctgaccctgatactcaccaggaaccaggggtgggagaggcactgggccgcactaggccgggccctacagggagaggaaggctcaggaggggccaggtggtcagctgcccccggggcagggctgactggccccgggcaggagaagcctgggggtgcactcactgaggggctctctgcagcgtagccttgatgaagtctttggcgtcttcgctgaggtgggcagccatggggctgctccatgacacgcgcccctccaggacgttcaggagggtggcacggtcactctcgccggcaaatggggatgagcaggtcaggctgaagacagagggagggtccagccctcagatgaggccctgaccgcagatgggctcttagtcccactcccatctagctctgagtatcccagcaagtttctctcatttccccagtgagatccaggctcagcttggaacagggacccagactgagcctggggtgagtatctgggctcaagtagcagacgggatctagggtcagcttaagtgggcactagccttagtctgaggtagggatccagactcaggctggggcagggatgtagggtcagcctgggtaggctccagccttagtctaagatggggatccaggctcaggctggggcaggcatctagaatcagcctgggtggcaccagccttagtctgaaatcgggatccaggcttagtctggggcagggatcaagatcagcctgagttaggaattaaggatcagcctgctgaggaggtccaggctcagtctataccataccaccatcatcctcagggcagcagtggctgttatgagcggctgctggacaacccccagtcctgcagggcagtggtttggctgcctcgtgacccagcacagccctctgatgacagggtgtttgtgagacactccgggcaggaacctcttatcagggttggctgaccgcctgttcccaagatagtagccccttgggtctcaggtttctgatatggggagcagccagcagtgcacatgccctcggtgggcctacaagggaggggtctcatgtcagctttggaggaggcagctgatggggcagggctctgctcacctgaggtaggagatgacacccatggccctgcaagacaaaagcgcacactgtgtgtcaccccaggcctggctgtcaggtaagaggcacacacacagggaagtggggagcccagggctgcaggaggagacaggttcagggaggaccccttggctgaccagtaggctgcctgctgcctccccggggcagaggagagggcccagccatctgtgggaactggcttcccggagaagttgcagacccagacccgttggcccagccacccactcaccaaatgtcggaggcttcgctcacagggttctgctggatgatctcgggggagacgaactcaggggagccgtactggctgaactgcagctctgctggggtgatgttctgggcaaagccaaagtcgcagattttaatgtcttcccgggcaggatgcaccatcaggatgttagagggctgttggggagagttgggagtgggtgagagccgtgccctaagggggtgactcctggggctgataggcctggtggggacacccagaggcccgggggcagggtgggacagtggggagcacccggtgcagccatttggggacagcctctgctccaccagagccacgccccacctgaaagggctgcctagaggtggtgagctccctgtccctggaggcaagcaagtcctctcagactgggagtggtgggcctgccccacctggcctgcaggccccaggctctggggtgcaggggtgaggacatgcgaacctttatgtccaggtggagaacgccatggctgtgcaggtagtgcagcccctccaccagctgctggatgtagaccttgacctgcggcaagggccgctattcaggcgggagcccagccccagcctccctctccactttaagcccagcctcctcctggcttcggcagctgatatgcaaagcgctcctgggccccgtgtgcccctaagccaggagatccctcaaaggtggggaggatacaatggacttgtgaacctcagtgggggaggggcaggcagggctggtcagctggccaggtgaggcggggtggcaggctgtgtagagcccaatgaggggtcaacacgccctggggagccccagaggcccctgagctagagaaggctgtggctgggactgtatctgcagggaccggatgtctgagcgggggctggggcagggtgcatggctggggcagtggcgggcggcagcccagtcacctcggcctccgtcaccacgcccttcctgtacaggcggtccagcagctcctcggatgagcacctgggatcccatcaaggaaaagcaggcttgggaggctgaaacctgcctgtccccagaaacccacactcacagtgaggcagccaggtctatgggtacatctgatctctggaggcagcaggggatgatgctcagggttgaggagggtggagcggggacccctctgaaccccagatggcacccagccctgaggagagggaggggctgcaggctgaccctggggaccaaggccactcactgcagtggcacggtgggagggggcatcctgtcccctctgtacagagcccatccagcaccctctccctgcaaagaggacaccgactttgggcagggggccatgtgtccagctgacgccctgtcaagagcaccagaggagaccccccaagacaaggccatgtgggtggcggggtgagccccagagtagccgggccaggcagctcctttctctctaagaggccatctacagagtgggagaggacccccgccatccctgctgagggcatcaggtcatcagggccagctagccaccagtagcccctggggactccagttactgctccgtggaacagaagcctccccacccaaattcctggctgggtggctgtcgccaccacccagccaggcaggggacaccgtgcacatggctcctctgagccccggcctggccctgcctgcccctcctcaagccgtctcaggggctgagggcaggatacagctccaggatgaggatgagggtcttgcgggtctcaaactggtccagcagccccgtgaccagcgggtggctcagcgcggccaggatgtctcgctccctgtatgcctgggcccgagttctgctccgtagggggatgaacttggcagcgcacaagatcttgtttcctttgtgctgcactctttttacgaagccaaacacgcccctaggaaggagggagtgagggaagcccaggtggcctggggaaaggagccatccggcagtccaggggaaagggggctgggtgctaccttccaatctcctccttgacctcatagaaggagtgcagcttcctccggtggctttgcttctctgagtccggctcattgtcccctaaggagtgggaagcggctggtatgggcaaaggtgaccaccctgatccccatggaacccaatgctgtggtgttgacgggagctgctccatggacccaagactatggaaccacactcacccaggtaccacacccacccaggtaccaccatgggaagagaggttgccccatggagccaagacctgtacccagccagcccggctgcagagcctggggcccaggaggggtagaccaactcacccccaagcaccagcagctctgccttgcagagcacctggccaccagtgttttgggccaggcaggtgtaaacgccggcatccttcgaggccacatgcctcagcaccagggagtatgtggtgccttcttgctgctggctaagccgggtgctgtccaccagctggacgctgtcctggaggcacaggaccggcagggctgctatcagcccactctgggggaccccgtcaccccacccttcactgagcagtgcttccgacacctgctgtgtgtccagtctaggggggatgtgggggaagtgcacggtgtggactgcacccacctcccgtgggccccccagctcctggggccatcccagaatctcacccacttggacctgcgcgcctaccttgtaccaggtcaccgagggctgtgggtcgccctcaatgatagcctcgaattgggccgttccgcctgtctgtgcctgcacatcctcgatggttacctgcatggatgggggccctgggagggcagggagggaactgtggagaccacctccccagccacacaaccctgggtgccagccacagcctaccatgcttggatggttggtgagaccctgagatacactgtgggcaactgaacaccccccgcagcccaagcgacagcaccccatcctgaccgcccaggcttctgacagttaggagtactccttcaatggaaccactgcctctcccactctgacctcagctggccaggtgatcagaaggagttggtggggccggtggagctcactaactcagctgtcgctctcagggacagggtcctatggacaccaagttcaccgccacttgcctctccccagtggagggttctggcccctctgaggagacacggtgagtagaatgtgggggtcccaggctggggcagggctgggacaggctgggaggcctttgcagatgtgcaaatgccccccagccctgggcagggggcatggggatcacgcttataacccagctgggcccaaccccgtacgtgcggtgtgcgtgtcgatggcctggtatgtgtaggtcctctgtgtggtctctctgaccacgtggctgtggacgtcccagagcagctcccctgtgcctgccccgggccaggctgcaccctccatcctggggttaggaagtggggtgaggctctgccgggccgccacacgttctgagcagccaggcctcccagtgagataggggatccctgctcaccactactcggaagaggctgcagcaaagcctctctgggatgagatgtacagatgggggcccaacccttagtgtggagggggccccccaacacctctcatcccaagggtggcctctcctccctgccctgccctgtccggggtggctgctggcaaggagtggagtgagggctgtgaggccaccgcggtaactcgtgccctgccctgcctgccctgggatgtcccatgggggttggcccccactgcaggacccagcagtctggggaggttaccgaatgggcacagtccattcctgggctctggcaatggcctccggctcctgctctgggccttcgtggaggaggggctgtggcaccctcgggggcacggctgctgggagacagggcaggtggctgtaggagtcgggtacacgtgagcttcaagcaggtggacgagtgggacggatgcctgccacaggcagggtgggtggggtcatggccagagcaggacaacccatgcccactctgcagaggcatcggacagagtgaacgagcgtcaggcctgtgaaggagcccgcgatctgcccaggatgggccaaacggcacctggggcaggtttgtctgctcagccactgtggccctggcacacaggccattggatgtggcggggtgcactccacccaggaggcagagtgagagtgagggtcagggccagtcctcccagacccccgccccaaccttgacctgtccttcccttgcagacaccagccctcgatcactgcggggggaagggtgacaggccagaagaatgagaagagaccacttcccagggtgacagggatgctgtgccccttctcctgggccaggccctgcacccagccagccccgtgataggtgcacggagcaaatgtacaccaaggtggggcctagagggacgccccttggccctaggtggccccagggtgcccaggcagctagagggaggagcctgagctcattgaaggcctgggggcttccgtgcctgttgtgggaaagcagacccgaggggtggccctctcatctcatgggggaaggtggcctgcttgccccgaaccctatgccccctggccctgcgggaggccacagaagcagcacagggactatgggactgttggaaactccagttggagcatgtgtttagggaattaagcgtgagaccatggtggggggctgtgccctggaggtctcatcctgcttggctccagcctgacggcctttctccaaggtgatgggaccaggtaggggtggctggggagggtgcatcagggaaggccctgcaagatggggtggggtgaccagagtgggtagacacgcaggacgcaaggccgtgatggtcctttgtgtgaagataaccaaggcagggtctgggccaaacaaggagaaggagaagggcatggacccgagaagcctacacaagcaggatgcagaggacgctggacggggcaggggaggagtctggctgccatcctgccctagctctggcctcgctccagccctgtcctcatggctttctggacgcctgactccagggcccccatccacctgcggtgagcagcagggcctgggatgagatttcccccaacccaggcctcagtttccccagatgcaccatctgtccctttaggaaaaggtccttgatcagggagctgaggactgggctggagcgaggccagggctcgagcaggttggtggccaggctcacacctgtaatcccagcactttgggaagctgaggtaggaaaaaggcttgagcccaggagtttgagagcagcctgggcaacacagcaataccccatctctacccaaaaataaaaaagctagccgggcatggtgccatgaacctgtagtcccagctacttgggaggctgaggtgagagaatcgcttaaacccaggaggttgaggctgcagtgagctgtggtcgtatccctgcacactgcactccagcgtaggtgacagagtgagaccccgttccaaagacaaaaaagccgttaaagtgcttcataacaggagacccccaacacctgggggaaggggcttaggtgatcataacacctgggggaaagggcttgagtgacccacagagctggctcttgtagcagccagtttggtctggtctgtctggggtactggctgcttctgcccctccctcctccacctcctcctccttttctgtcttcttccccctctgcccctctcctcctctccctcttctcctctctctcctcctctcctttctcaccccctgctccccctcctccctgtccactgaggagcacagggcacctgaattggccatcacaggccaagcatgggaagcctctggctcctggaacagatttagagcaggaggaaccttccagaacccattctgtgccagattcagatggggaaactgaggccaagcaagaggtaggctttgcccaggacccccagtgcatggagccactgggattccaaatcggggtcactggggcctggccagttaatgcccatgggatgggcacccctcatgttgcacagccagggttggggtcaatccctgggggtctttgtcatcagcatgcatctgggcctcaccaggtgcctccgaagttccggtgactgggggctgggagccggtttcctggagtgcgggtgcccccctggggcaggggccagggccagtgaggtcccctgtggaggggcctggcgccttggggcccagcagtctcttcaggacagatgtgacctcctggtccgctcgctccagggtggtgtctgtagaaggggcaaatgagtgcagagggggtgaggcccaggggtctgggatagctgcagcctgcggaggggtctccaggaaccccatccccctcctcagagaccgcccaggtgggccgacactgggctgctccccacccactcccctctcaggaggctgcctggaggtggaggcctgggacacagaaaggaaaaaaccacagacccatgctgcaggcaggcacttcctcctcctagaccccccgcgagctcagcctcgtcctccccgggaaccttcgggagagtgtcgccacctccagggagcagccaggcctggatacccaccccaggccctggctctgccactgatcacaaccccccaccagggctggcctctcctcaaacctgggcacagcctagtgccaaggtgagaaccagaggaagcttgggttccgtgggcgtccaggcggccgtgactgtggacccttccccggggatgggccctccctcccagggcagcccctgcctgcacccgcctgtcgggcgtctttctctcctccacctgtgacccaaatctgccctaccctccacctgcaaccccggccccggccgccccacctggccccttgctggctgcaagagactcctgcagagccctgctgggcgtggtccccactggcagctccccctcagcagcctccccgtccacctggtcatcagccaggcacctcacacgtgggtccagcaggtcacctgccccaaccctcccgccttgcttgtgtcttcaagcccttgctgaggacccctgctgcatccccagtcgccagccaggagaggacacccgggctgctctctacactgccagggcaccctcctctccaccctcctcactccaaggcagtcagcaggacccctgagccagcctcggggctggagggcttcgggttttacgctaatggtgctgggatcgtccggccagagacaatgaagttgacccctgatgctgagatcctgagccccacggggtcaccacatccccacgtctgccatgacaacagtcccagctgcccagggctggggaaggcctgcctggcaccccgcataccaggaaggagcatgattggctgttctggccatgccatgtgcccctgtgagtggcccctccatgatgggaaccagctgccgcaggtccactcagggaccccagggtgggccgggactccacaggcagtggccagccaggggacctcacagtcaagggcagatgagggtaggggctcccctgagggctgcaggtagaggggacccagggctgcccagtggagaggcaaggagaatcagagaggtgcacaggaagctgctttattcttgctgagagacaggggctgctgcccacacacagaccctgtgtccaccctgcagaaaaggccaggagggcctgcagagctgggaagcgccacccaagggtctcagtcaccaagactgcaggagaggcaaggccatgtcaggcctggcagctgtggctggggccaggagggagggaccaggcccatgtgggaacaggacaaatgcccaaggccacatccttcgtccacagtcctgaggctcctgccaggctgacaggaaacagcccagagctgaggtctttgagccggtcattccaacattgcaagcaccacccagtcctcctggctgaagttgagtgaggtaagaagggcccgtggccagggacagggagggccctcaggaggctcccagggctgctgctgaggccgggcagcgtcctaggcctcaaggacactcctttctccccgctgccccaagccaccatggcagcagcatcagggctgtgccgcctcatccccatccctgtctgggcagatgtgaagggtgaccgtctcccccactgtcccgaagttgacggtctgggtggaaagctctgtggtgaagctgctctggccactgtccgcagaacgccggatgcgggtgcagaaagactgcgtccagggagcactgcccacaggccgagccggggcctcccgcaagaggaaggaggtgccctcaaggctacggacctggggtcccggtggtgacgccccacggggctcaggcctaaagaggccgagagggcctcggggacccagtgcatgccccacgctgagcagcacaggctgccccaccgtgggctccccgatctctctctggatcaccgagacctcgcagggagggtcatcaggggcgccaggcccagggccaccacagtggaaggtctccccttccccaggcacgtaatcttccaggtcagccagtgtcagcatgcggccgttgtgcgtgaggatcttggggtcacgatccccaaggctgtgtgtgtcctgggactcctccgtcacaaaggcgtctccgtcttccccctcttcctctcccgcctcctccatggtgccctcctcctccaggctgcccatgccagaagcagcccagtccacactgcctctggcatccacgcggaagacaaggggctctctgacgccgaccatggctgtgccctgggcccaggcctcctgggccagcagcttgttgttggagttgttggaattggggtcccctccgggggtcgcaccgggcagtgtgaagagatgccccgatgagctcctgggcacctctgtggtgggagacacaccctgcgggcccatcttcttcacccggacttcaatggtctcctccacctccacccacttgggctggggccccgagagtccgggcagagctggagagtgggcctcggcctccgtcacatacagtgtgggcaccacgggcttctggcctggttctgcctccggcctgcggggctggccagcacctggcaggtacagcaggtcgggggccagtaggcctggcctcagcgggctggcagagcagcgggaaggtgagcgggagggggacttgctgggggaccgtcgttggccacgtgggctcttcaccacagtggtgatggtctcttctctgggggagggaggagagggcccgagaaaagatgggcacagcgcccaggattgccagggcagcgtgagagctcaggttattgtaccagcaagccagcagtgagagtgcacaaagaactcttacacatgcatgtgagcccaacctacagagtcccccaccccctgccacagaactaaagaaacaaagcacaaggtcccatgtggccaatctgtctctggtgtgcagatctgaaaacaagaggtgaggtacgtggggaggcccgtgccgcactgcataggcaagcgcctccaaaaaccgggtcacatcctgattgcagtggccccggtgcccgtctcccctccaggtccatcccacctttgtgctttgtatcacgggggatggtgcgtggccaactctcagagggcagggcctgcacaccctgaaaatcctcagccagggacgggctggacagcttatgccgtgggggtggggtgggggctgagctcagacctgttctcctggcctttgggtctgaaagtgtgaggcccagaaaggctttaggcaggccaagggagaaacctggctgatacgtggccccagacttggcttggccatgatgagccgtgtgacatcagacaagcccctcctcctgcctggctccatctcccaaaatgggatgggggaggagtgacggaggcagaatgcaaggttggctgtacgtggctgtgcgtggggcactggctgggaactttgcaagctctcttgtctgactctgcagtaacctgggagagggtctgatcccactttataggggacagagagggtcaaagaggctgaaaatctgcctggggccaagagggagaagcagagcagtcagcccaggtcctcctctggtgcccggtgcccctgaccttgctgagcactgagagcaaactgagttaacacgtagggaagcagaacgtgctgagtaacacacaacacataccagttccctgcctgttactcattttgccctcagccttgcacttccctcaggctcaagacaagggatgtggcatgtatgaggtgacaaagtcgtcaccaagtgagctactgccagctgtctgctttgtccaaagtactgtctctctctcatttagttttgctttcatctaactcagggctccatctggaagcagttgctcccaggcatgagcccagagatgtgtgaccaccccttggggtgcacagcaatgacaggtcctgcctcctccagccctcagctattaaggagggagtgatatattccacttaactgatggggaagctgaggctcagagatgtggcccacttgtgcccacaggcctgatttcctgcctcacacccaggctctagggcagtaggcttgttgctgacagcctgggcctaaccccatctgctcacctcatgttgcctgatctgctgatgcagggtggtaagttgagtgcagcccaacaggtggatggggactcctaaatatcccccaaatgctggactcactgccacccccacaaggacacatgggcatcctgtactgagactgcaagcacagcatatggggtctgtctccaagccctgtttccttctcaggcctactgcctccccagtgcctctgcctgtgtggtccacccttgggttcagcgctatgcctatgcagttggctccctccaatcctcaagctgagtgggtaaattacgctttgcagagtgagggttgccaccttcctaagcctggaacagactggacttgtatgcttgtaaatcacctggtcctcctttccctaggcgtgagtcgcctctgaagctttgccagtggggcattctggctccatctctgctcctccattttcttatccataaaatgtagataataatagtgctcccaaagggacaaaatgtagacctactctatgtgaggctctggcaccgttgcatacctccaggagtggggtgctcaccagcatccaggcagccccatctattgtggggtggcatcataggagcaacttgttttaggggaggagggagaaagccaaggaagggttaacccaggatctcaacaaatgtctggcaatgggattttcccacaatacggccaactgaaggccccttgagaactaagagttttcccatcctggagcttctcagccatctggccttaggaaaccacagtctttcctgcctcctggcttttgcaagctcttccatcactcccgcctgcacacaccttctattggaagtcctctcagattattcaggtcaaaaccaactctacatttatgggttcacccagttctggtcctcttgtgttacctcagcagcagcagcatgtgtgattttcctaaatccttgaggcactgaaggatgaagaaaaggacagtgggtgtggcactggggaagtggcttccagtcattagccacccagagctaacctcctctcttccctgaacttcagtttccccatcttccaaatgtgaaaatcgggcttggggacctctaagggccctaaggctgtgctgtccactatgaatgcactatgtaaattaaattcaaatgaacaaaaattaaaatttaaaatttgtccttcaatcacactggacaacattccggatgcttcaacagacgcaagtggctagtggctactgtggtggacaggggagatatagaacatttctttttgttttcttcgcgacagagcttgctctattacccaggctggagtgcagtggcacgatcttggctcactgcaacctctgcctcccgggttcaagcaattctcctgcctcagcctcctgagtggctgggattacaggggcccgccaccacacccggctgatttttgtgtttttagtagagatggggtttcaccatgttggccaggctggtctcaaactcctgacctcaggggatctacctgccttggcctcccaaagtgctggtattacaggcctgcgccactgcgcctggcagatatagaacatttctgttaccacagaaagttctgttggacaacactgtcgtaaatcccagggtgctgaggattagaattctgtctctggcccactgaggaaagcaggtctcaggcctagctcctgatgaacccctggatgaaccactgtgaagtgtgtggaataagtctactctgctgaaacagtgggaccacggagtgtactgaggccctggaagagagcgctgtgaagtgtggaagtaatcgaggccccaggggaaggtgcctatgcaaggtaactgcaagtacctgtaaggtgctggcagtcagagggtgcatgttatgtgagcagacaggcagcaagcaggtggctgggccacacaggcatgatccaggcaggtcagtggcatgcaggaggcactgcagtcagaaggaaggttaggaacacgcctgcacttacatgatgacggttttcttggggactttagtctcttgctcagtgactacaaagaaaacagtcggaatagcgagggttacagaccagccagtgctaggggctgagctatcggagtggcacagcgttgtagtcacctgctaagctgcccctgggcagcctgtctactcagagccccagttcctgggcctctgacatggaggtgacgatgcctgtcctgagtggctgcggaatgagggctgaggacaatgcttcccctcgtgaaggcaggacccactgtccctctcgagggtcttgcagggactggggggagaatgaggaccctacctacgctccctgcacagaaattccagcttctccttcaacccatgtgccaagggagccccgtgaatttgtcagacctacaatcccacttctcagacatagaaaccgagtcctagaagggaataaatggcctgtggctgcacagggagccagcggccacactgaggctgaggcagctggggactctgttacaaaaaatcctcaggagagagggactctggagtcctgaaagtggcacaactgagctttgtggcgcaaagccacagaagtcctaccaagaacagccccaggggatgcctgggcagggtgctgagctctgagtgagcgtcagcccaaatctccctataggagcatcctcagtccacacactccatggtctctccaggttttcctagctgcctccctccccagagccagcaggatggggcctgtggttccagtgatcggatgggacgcatctgggatcaggcagctcctcctcccagtcacctcaaggactctcccctgcagctcccgggcagaatcatcagggcacaaagatggccccctcccagcccaagccagctggccagcgggcagtccacgggccaccagcaccttcacatctcagtgaccctccccagcaccctgagggaaaaaaacgagcaggaggcccagaagtcaagtgacgtggcctggggcacatggcctcacagctccgggtcagggggtgggacaccatctgctttgctagactgccatgtggagaaaggctttacacctgtctcaggtgaggagcacgtgaatttcagggactgcctgcgtctatatgtgcacttgggagccacagtactgtgcatttctgtgcacacacatgtgcaagtgtgtgtatgtgcacagatgtatgtgcatgcatacgtgtgtgcatgcacgtgtatacatatgtgtaggtgtgtatttcacaggctccccctggagagaggagagcccatgtgaggagagaatgagatccaaccaaaaggctctgtgtgtttagactaagctgaccccagagaaagccaatgtgtccactacctgcaggccagtgatgggaactgcacagagtgatgggaaaacccggggcctccccactcatcctccctgcacttggggctgacagccaggcacctctgggcccatacactctctggcaccttcattcatggacctaaactgtcacctgatcggctgtgggccagagtgagtatttgcgactacaggagggatgcagccgtgcgcagcatgattcacaagtgagggggcagcgcccaccccgcagaggcctgccagggcctgtttgggctgcagagctgctgggttaaagatgaagcagcaggataggagttagaagcggggaggcgttggctccagctccaggctcttcaaggacctgcattctcaccttgctgaggcgctgacactctgtccagcactggtggcctctctcccctgccaccccctcctccagacccagagaaagacttgttgtgacagccaagtgaacgactgtggaggacgctcctgtcaccagcaagaggcagccctgggtgtcccagctggccatgagacacaagactcatgggaggctgaggtgctggcggctccagaagcagttctgtgtggtgctatggccaccagttgtggggctgacggaggtctcagggcccccagagacacgtcagacatggggcactcacagtcggaggttggccagtgccagtggcaccgtgtgggctgaggaacaaggacctctgcccagcaggggaggggtctccctgagggtcatggagggcatcaaagatggcccagctctgtggggtccagatgggcaactggctttcagacactgggcactgggagagacagttgaggtggggttgcaggagccaatgtttaagacttggaggacatgtattccaaccactcccacagtggcagctgcagctctgccaggtgttgggccagcctccacttgcatgtccccagggatggaaggctcaaaacctgtccagacgggcagctccaactgggagcccaagacggatgcccgatgaccctcttcccatcctggctgcccctgccctgaacaaagcatccgggagcctggagaaatgaggtgatgtgccccacctctccctccaccccttacctttcatccctagtgaagtcattctgcagcccaaggccctcccaggaccccaggagcagccccaaaccaggccaggtatctccacagccagccctaccctgaatagaggggccaggcccctgacacttgctccttctcctgggagccaagctggggcccagcggcctggccctctgcagagatgtccttcctattgttcctgctgcaacctccccactgccttaggcccaccgcctcctgtctgccaccggcgagctgccctgggtgtaggcctggcctctgcgcacaggcttcccctctccggaacgcagcggctttgggaaccccgcccacccagagtgacctctccagcctccatccaagccctgggctcaggggctaccctccaccagcccacacaggtgctgcctccagcagggggctgggacctgtgcctggcccacagcagcctccccgtctaccatctgtggctctccctgccccacggtgccagcccagcccctcctccagggtcctccaggcagcagaccctgactgggaagggtgagagtcttgtcctcctggacacggccaggcctgtgagggtccagcctgggtctgggccgtggggagccgccttggtggcgaggacaggggtgggacttaccttccactgcagccacgagctgctccctgtgacactgctcctgggcctgcagcatggggctctgaatgcgcagctccgcactagcccgcgcggagcccagccggttcaccagctgcaaggacggcagggccggctcagagcccaaggctccccacgggtagggccctctccctgtggccatgttgggagcacgggcagcccccatcctggtgtgtctcccacaaggggaagggccccagccccgccacagcatccctgggggacccacacggccttagggccccctgcagtgatgaggatgctctccatctgccctgtccacgtgcggctctgagcatgggacatggggccagagcagccagggaactgaatctttaactgaacttaacttcattttatgtattttttaaagctgggtctcgctctgtgacccaggctggagtgcaatggcacgatctcagctcactacagccttcacctcctgggctcaagggatcctcccacctcaacctttcgagtagctgggatcacaagtgtgcaccactgtgcctggctaattttttagcttttctttttttttcagagtcagggtttcaatatgttgcccaggctggtctcaaactcctgggctcaagtgattttcctgccttggcttcccaaattgttgagattactgacgtgagccacagcacctagctttggatttaactttagttgacttaaatttaaatttaaatccccgtgtgtggctagtgatggtatcagacagtgcaaatcaagagctcacttgggtctctggcttctccagccagagtggtgtggggcaggctccccacaggctcacagcagcagccacacggcgggaggtggtggccggacaagtgcccctggaggaactggacagaagctagcgcctggagcctggggcacccgtagttggcacacagccaccacgaccaccacgagcactgcaggctttgaaggaccggaggactggaactgggcctgggccccaccctgaggagcccttgccccggccctgcagacacagtggctggagcagaaggcagctctgtccacccgtaggctggatgtctccacaggtaaaaggtacctgagcagggccgggctacactggatgactgacactccatttgacacgaatgacaaaattcatgaggccagccgggtcccccaaaggcaaaaaccaagcggcatccttgaaatggccagggaagtcaaggaaggcatccagattgacatgggagcagagaagaggcttagaggcagaggaagaatgaggccagggcatggggcagtggtgtggccagggatgacagtgacagtggcatggtggcccccggcctgtgatggggggtgacagtggcctggtggcccccggcctgtgatgggggggtgacagtggcatggtggcctctggcctgtcatcaagggtgtagcagcgggtatggtgtcccctggcctctgccgagagccccctaccttgaggacagggaccgggctcttaagcccctccacaatcagaccccagaggatggccagcaaggatggcctgggtcccgaggccggtccccactcctgcactcctcacctcacactcgtagagccccaggtcctccttgctggccgcccggatcaccagcactagcaggccgctgcgaggctcactcagtgtctggaacttgttgccagtggtcagcagggccccgtccttgtaccacctggaatccacccggagggcacgtgaggcaggacttgggccatgctctaccccgccggcgacatcctcctatgtcctatctcagggccacgcccagctgtgctacctgtgctcacgacccggttgccctgccctcagaccccaggggtcctcagagagcccacccttccagaagccaagacagagcctggccgtgtcctcccggctgaggggggccgcacatccagaatgaaccagagccccacgaagcccattctcagctgaaggccagtggccatgtctagcccaccctgacacgggaacacatggcccgtgccccatgctccaggtgggagccgaccccctcatgccccatccccgggcaggcctgggccccacctgatctgcgggtacggggcgccttcgatggtgcaggtgaactgggcgtcctctccctccacaaagggtgaggcccggaccttgttcacgaaccgtggtgggactgtggggttgtggagggaagagacagagagagagacagatagaaacattagagacagagacagagagacagagacagacacagagacagagatagagacagaaagacttacaaagaaagagacacagagacagaaagaaagagatggagaaacagagagacagagataaagatacagagacagagagacagagaaatatagagacagagagaaatagagatagagagagacaaagagacagagatggaaaaacagagacagaaagagacagagaaagagaaattgaaacagagatagagacagaaagagacagagacatagacacggagacaaagataaagaaacagagacagacagagatggagaaacagagaaacagaaagacagagagacacacagatagagatggacagacagaaacagaaggacagagacagaaaaagacatacagagacagggtgacagagacagagatcaaaggacaaagacagagatagagacatacagacaaggagagacaaagacagaaagagatagatacagtgcatcagacacagagacatacagagagacagagagatgccatgatggagctgagagtgatgccagggaaggggctgcaggatccccacccctcccagtgccctctatgatcccccaatgatcccctcagaacatggtcagatgtgtccaccccactgtcccaccaccccgccgcagctgggcctgccatggtgggaggctcagggcggctcctcccccaggaaggccttcaggctaaccttgcaccaggatcttgcccagggtactgcagttgccagcggcgctggccgcgaagcacatgtactggccagagtccacaccggtcaggctgtccaggatgagtgcacacgagccatcagggtcttcaatgaggatgtggtgggggtccacctgcactgctttcccatctggaaaggacgagcgggggccgtcacccaggtggggacccaagggctcacctcatcagcggggagaagctgggcctggcctgggggctgcagttatggtcggggaggggatggaggggccacgcttgtagcacaagggccaggcacaggctccctgccaggtccagcttccaggctgacctgcaaccctggagggagaggctgacacgagctcaccttctctctgtgtctctgcctctctatctccatctttctttgtccctctgtcttagactcagtttctttctttgtctctatctctgtgtctgtttctgttttctgtctctatctctctttctgtctccttgttgtctctgcctttgtatctctgtctctgactccatgtctctgtctttgtctgtttttctgtctgtgccttttgcacctttctgtctctgtgtctgtctctgtctctctgtctctcactgtctgtctctttctctgtccactttggacactagctagaggcagggggcaggccaagggacctgagccccacagagaacatcctctatgggcagctgagtccttggtcaccccagctctcagcagtcctgtgatactctgaggacctctaatgcactgactgcaccccagctcacagcaccttgatcccctcttcacccctgcctgcccagcctagggcctgcagccccttctcaaaatcactgcccacagccctccatgcctcctctccctaaacctgcccctgcagaggacacagcagcccaaagtctcaccctcaactccactctcctctcccaggccacatcctcgtgcctccaaacgcacggctttctaatacgaaaatctgaagactgaagaatgtgaagtaaatcaccctggtatgaacacacaaccgactacacctctggccaaggaatgcttccttcccgggtgagggatgggaaggcacggcctctcactgtggagaactccttcccacataatgtctaaatacataaaacggcatcgattcacattccaatagtgccgggtgtgccccacagattgcttaaatcacaaaggtcacaaccagcaccgacttatgatttgtatagaactataagatatatatacattatacacacacatacacacacacacatatacacatatatatttgtggagacggagtcttgctctgttgcccaggctggagtgcagtggggccatcacagctcactgctgcctcgaccttatgggcaaaagtgatcctcccgcctcaggtgcaccaccatgcctggctaattttttaactttctgtagagacagggcctcactctgttgcccatgctggtctcaaacttctgggctcaagtgatcctcccaccttggcctcctgagtagctgggactataggtgtgagccaccccacccagctcagaaataattttaaataatttttttcaaaaaccttctggttaccacctcagatctccacacccctttatggcaactccagaaaggagctgtgctcacaccctccaaggcgtctcttcccatccccactaagcccatcccctgggccccagttctctcccccaaagctcctgtcagggccgccacgctaccagcagctctgtcctcatcttgctgtgggaaaacaattctccctggaattcagattccacatttcagccctctgagcaaaggcactcacagccaggtttagaatagaagaagaagaagagagtagagtagaaagtaaggagagtgaagcagaagatgcccatctgcctggctgtgttccaggacaacagagacaaaacccttccattcctttcctgggagacatttctgcatcccagggtaggaagtcaccccctatctctggagtgaagcatgggcagatataccagcagccgcataaaaagagctccatgtctcctaagattcacggtttctctctcatgggacaacccctgcatgcaactaacacctagctccatcacctcctcacagaaacgggtgggggcaatgatgagagacactgaggcactgctggtaaaaagtctttgtctctgacccatgagtcttgtgtcttttgtctatatctggctggcaggctggcttgcaagattgcaagtggggtaaaattttgggcccttcacagtttttggtttacaattttggggacagggaagtgacactgtcagaggcatggccttctggaagggaaagaagaagcggccctgtggatctctttctctactttgttgccctgctaaggagagaaactaggcaggtagttgcatgctgagcactgagaagtgggttcaaacacagacacctgggcagtgccttggttggcactctttctccaatccctgccagggactttgctggttcagcctcagttcagccatttcacaataaatgccagagccagcgctggatctgaggaagattctaaccctgttcagaccacagccacggacactcgtgcctgaactgagtgcttggggagggccaccagcagccacgatgggcagaggcaggagagggctcagcccatctaggtctggctggtttggaggggagaggatgggcaccgagcctgcactaaggaagaacggccacagcttgggcgtcttgtggagcagcctcctgcatccaccatgctggccttccattcttctgggggtgacagtagaggatctctgtgtttgcggtagagacggggtcctacctccatggttggctgagccacagaggggtgccttgttccgtcattgtcctctgaccccttccatcccctctataccacagatcctttcctggctcaagcaatttccccgagacaacaaactcccccaagggaaggcagaggggacacggcagggagtgcatggactcctcccgctacggcctgccaagcagccaggatcacagtcatgcgacaccatgccaggatcagagataattttaaataggctggcaagttaaagacacctcttcctggggcaatgaacaatgaagtgaatcaaggctgctgatggggacaccccggccagaccgccaaggctcctgtgcagagcccccaggacaccacatcgctgagccccaccacaggcagggcacagatgcagaaatctacatcacatgtcagactggggacatcctggagagacattctcaagcctacaggaaaggaagacacagtacacatggtgaacccactctccatcctggcataccgctcctatgaacccagtgttggggctcagaaaacaagaccccaaaatgagggcttcccaagcagcctcagaagcaaaattttatctctgaccttctcctcccctcctgtctctagcccctcattctcctcccaggctgacatagaaacagaatccctcttccccaaggtgggtcatagaaaccaggacacctttttctctaaagccagccagaaagcctaaaaataggactccaattttctctccatcgttctgtgtaaaacctggccatgaagaaatgatctgacctactttgtttggctgtggatccaagacccccattccagcaagggtcctgcttctcacccagaagaaaagggcactgctcagaaggccaagaagaatccagacagacaggcctagcggggtgtccccactcagtctgttctcactagatccaaccctatttgcccaatcctatttccacacagttgtccatactttatggaacctaagcattaaaatggacagcttcttctgggtctttgggtcttcattctgaaggatccagtgtctacacattcaataagtgtgtctgcctttcctcctatctgtctgccttttgcaagtgattgtttagtgaacctgcagagggccgaggggaatgttctccatggcccttaggccagctgtccctctccagggtctctgtggaggccacctgctgtgaggctgctttgggtctccagccacaccatgaaagcgtgtggctaacatgagccacgtgtgccacacacaccccctgcagtttgatgtcctatgacatctaccacaagagccactcagcaaggggatggcggtctgactgcgcccacctcctactggcctgcggacctttggaaggcagtccggtcaccaagtgcagctgtccccagagaggagctatctcctgcaagctgcctactgggctggtggttaggaagcaagggacaggggagggcctccatccacagggaaacccaggctctgccatgaccaccccttggtggcagcctggtccaaagggagcggggctcagggcattcaactggcttctggcaggctttgataaaaaagcttttgttcctcttgaacctaacctcccggaggagaggtctggacaggtggcaggaggggagctcctaagaccccagggagcaggcgttaatgacccacccaagccttcctccagaagtatcccagggcagccctccaagccattgcgttcatcagctccgaccagtggacactgggatggcccctcccacacaccccggcaaaactccctggagtccttcctctccagccccgtcctcagtcatgggcagacccgcgggcccggctgctatggacagggagaacaggaagggctgagtgcccagatggtgcctgcaacaccaggacagcactcggttataaggactgaactgggggcttggaggccggtcagccaggccagatgaggttcacctgacagcccaggtgaccccctggggggtcatctgggaggtaccatcaatcagtactgatgtgtgccttcgtaggagcccccaaattgtaaacaataactgtgttctcaagacttcctgtgtgggagccacacacatgttggctggtgccttggggtggtccagggcagtcccacaggctggcatctcccctgctgagaggcttgagtaaatgcagcctgagtcacaccggaaggacggcataccagccagcatcagtcagattagccaggatggctgagggctgggcacaagtgtgggaaaatcccccaggggctggagcctgtggaagtagggtggagctgggtctcttggggcacaatggcccacagttggccagcccagatgctccagacagcagcgctcacacaaggagacattccaggacagtggagcagagatgcctccctccctggagacacccgaggtggtgagatgcagcccctgaaatccatggtgcagcgcatgcatgtgcaggtttctcccacaccacccctgagagctgcggcaagagcctgtcctggctgctgcctcatgttgagtgatgaaccatttctgtcttggaccaacaggtcttgtgtcttgtgtgtgtgtgcaagtaactatacatgtatatatgtgtatatgtaccatttgtgcatgtttacatgcagatatgtgtgtagtacatatgactgtgtgtacctatgtatatggtgggtctatgtgtatatatgtgtactgtgtatgtatgcatgcacatgaatgtgtagtatttatgaatatacatgtgtggtgtctgcgtgtagcatgtatgtgtgttgcatgtatctgtgcatgtgtattgtgtatggtatgtggctatgtacatatgtatatgtgtgcagtattatctatgtgtgcacatatgtgtggtctctaatatgtatatttatatgtgtacagtgtgtgcatatatgcacatgtgtagctgtgtataaagtgtgtgtgcatatgtaaagtatgtacttgtgtgtgtaatgtgcatacatctctgtatgtgtatagtgcatgtttgcatgtatctgtgtatatatctatgtagctgtataggtgcatgtagtgtgcacttgtgcatgatccatgtgcatgtgctatgtgtgcatatatgtgtacctgtataatgtgtatctatgtacatattcatgtgtgtggtatgtatttgtgtatatgtattgtatactatgcatgtatgtgtagtatctgtatgtgtgacgtgcatctatgtatattacacatatagtgttaatgtacatgcacgtgtaatgcatatatatggtgtgtatgtacatatgcatgagtgtgtagcatgtatctatgtgtcgctatgtacgtgtgcgtacaagtgtgtgtaatgtgtatgtgtgtaaaccgtgacaggctgacttgcacatgtgtgaggggtagaatgggagattccacagttctggggaccctggcagccctggacgccccctgcccactccccgttggcttctccctggctggcttcctgggcccccacctccctggccgctccttcccctgggttcgtgtcccctcatctctgcagactctggaagtgggggctctcaagcctgggtgcttgggcctcacccctccacacgcactctgcgtctgcatcgactggcaggtcagacgctccgtgagctgacgacgttccattcatcgtttccggccacatccctctcctgagccctacttgtatttctccgaccgcccctcagcgcctccgcctgcatccctgcaggcacctcgattctgcagggtcctcccaggcctggtgcttcctcctcccacccagccctgtctgcacatcaccccgcctctccccagccttccacctttgtaaaaggaaccaccctggtggatgtccagccccaactgtgtgagcatctggatgccaagctctttccacacagccagccaccccatcagcaaatcgggccagttcagccttcaacacggccctggaatccacagccacccctgagcctgggtccccagctccagcacggtggctcccaggctggtgtcccaggtcccctcttggccctccccagcaggttcctggcattacagacaaggtgacagatgacagagccaaactgtgtccctctgctgctgaaacccaacatggctccagcacaagggaggattgatgctccccagggagaggcccccagctcctgggaggtgatctcaggctcttaggatatcctgtctggtaaaagcatctgttctccttgggagccctgggccacatgggatcatctatgctgaccgtgagatttctgagattcctaggggtccctgggccacgcagcatcaacttggcctccagaagggctggagcccaaggcccaccacagagcagtgagccaggattccacagctgagcctgcaaaaccctggacaccatggccagggaagcacctggttggcaccatcccgtgcatgtcgtcacgtgctgtcactggcagaaatgattccccccaggaggggacaactggaagttcatgcatagtgccgcctggacctttccctaggtggctctcccggcagctaatttaacctgggccctttggccacaatcagccctgactatgggactagcagctttgcagagccgagtgcccccactgaactccctcctctccaagcctcggcatctccgtgtccccaaccatgctgtctttgattcggaaggcgggtggcaagtgaacatataaggcctgtccatgccccagactcccagccaaatcccatattgggtccccagccctcacagcctgtttctctcgggcagctcttttctgttgcagggcctgcatcctggacaggaaggccacagcccctggccccggggtttacctttgtaccagctgatgacaggcttgggtgtgcccgtcacgcggcaggccagcttgactgtctcacccagctcggctgtgcagtcggccagctcctcttcaaagtccgggggccctgaggacacacaacagccctgagtgctctgtggggggacatcgggctgcggcacccccaggtgcacctggcaggtcacctgccctgcaccatgagccccacatctgatggtgtggcccctatggggactgtcccttgtcacccctcatccaaggtccccacctggagtcaggtgagtgaggcaggtgcatgttaaatggagagcagtgggggctcgggggaagattctgttctggttgaggaagcagaccccgggctgccagacccttcacagcccctgacatgatccggatgggtgccttgagcttggggaccccatggtatccccgaccttggatcagggccaacccaacacccagcccaggggctccccatgaggctgtagccgtctgtcccaggaacgagcccacccctcacacccacccaggcagggacctgtgcggctgcagccgggtgccccatcctggctcagccacctgggcccccgggaaggtggacactcacgccacacaggcagggccagacgctgctggatgccacagatctccttcacccacgagctcttgataatggctgtccgtgcctgcagcaggtacttgcgcaccgagtcctcccgctcctgccacacctcgaaggcgcggtcatccccctccacctggtcgttcaggtcgatgctgctcagctgtgggtgggggagggtgtcagcacagggagggggacacgggctgaccatcctcaacagatgtgggacccgacgaggaaacattcaggccaccctggaccagcggctgcaggtgtggccactggcatccaccccggcgctgagggacagggagccccgcccagcagcccagagcctgcagaccttcatcatgttccggaacacgtagctgacggtatcggtgcgggagtctcgccggggcttgcagattaccaggtggttgcggaagaggaacacgtgacggttgtggcccttccagggcatgcgggcccccggtgcaccctcccacacgatgaagtggccctgggggagggtgtgggctgcggtcagcctgtggtgggccagattgcccagcggtgcaggccccacagccacccaggtacccagtgctctgcccaactcatgcacacaccgccacctcctggcagccccagatacaagcccccagcaccccaatacccacccacatcacatgcatctcccggccccggcccctggccctccccaacctggcggatgggctcgcccagggcctgcagggtgcctgggtagttctccatgagggacacgtgcagcttgttctcagcgcgctgtggcagggcagacaccacggcataggcctgctccagcagcgcgcagttctgtctgttccgcgccttgttgcggatcagctcctggggccggggcgaaggtcagggcttagaatgctccacaggctggaacccaagagacccagcctgggcagaggaggcggggcaggggaggtggtgcccaccttcagcaaggcctggtagcgctgcacccgctccactggctgctccaggtagtgctgcagaggtggtggcgggggctgagaggggtcccctgccaacagggcctcctccgcgtatttctgtgggaaccaggagggtgggttttagggcaggagtgcaaggcccactgatggctgtgtccctgagagctggagggtgggtccccagggtgcacacacagcctacaccccaggtgacagctgtcatcacctcctgacaggtgacaagcacaggacttgggctgctgaagtggccttcccagaagcacagggctgcaaaagcagctccacccgcatttctgaactgaggcccaaggggggtgcagggaggctgtgggcagtggcgaggtcggggaagatgagcgcaggctctgatgtgggcagaacaggatgaaccttggaggacgcctgggctcagtgagccttcaaagggagccaagggcaggcactgaggttcaggagcccatgagttcaggcatgggcaccttgtagaactcctggatggccgtgctgacgaccaccgactcagcctgcacacgccccaccaggaactccaggtactgctcaaaggccgcctggttcttgatgaagcacatggccacgtcgtcgtccgtgtcgcactgctgcaactcctgcaggaagctgctgtgaagggggatggcatcaggactcagcctgcgccccatagcctggccctgagccctcacctctgggaggaagctggcccctgcacaagggctggggccctgtggctcctggggtctgtgagagtgtgcgtgcagacatgtgtgggcatgcaaataagtgcttgtgtgccgtgtatgaaagctcacatgaatattacatatgtacatgtatgtgggcgtgcacatttgtggaggcatgtaaatgtgtatgagcacacatgtggttgcatacacaggcaggtggtggaggaaggaggtgttgtatgctatacgcatgcgtgcatgtattaaagtgtgcagataaaagggtgtgcatgtacatgctgggtgtgcacatgtgtgcagaagtgcatatgcatagatgtgcagagatagtgtgggggcatgtacatatgtgtgtccatgtgtataacatatatacatgtacacaggcatatatgcgtgtgcacgtctataggcatgcactgtgtgcacataggtgatgtgcacgtgtatgtgggtgtatgtactgtgtgcatgtgtgtgcatttacagatgtgcacatgtgccatgcacatgggtgtatgctgttaaaggctgcacctgtacacatgtatgtgttcatgtgtgcacacgtgtgagggtgtgcatgcacttgggcctgcgcacatgccagttagcagttggtgcaccgcaggccttcccatgagtaagccaggtacacatgtctgggtttctgaggggaggggtgctgagggataaatcaagtcagcacaggttctctccccccttggctccaacccacctgcaggaggcctggccctacagtgtgtccatgcatggacgtgtgtgtgtgtgtgtgtgtgtgtgtgtgtgtgtggccccacccacccacctgctgtggaagcggccgatgtcccgcacattgcggaagatgactgccttctggccggccacagctatgggcacgtgggggcagcgctccaggtgctgcaggtggtggctctgcaggaactgcagctcctccacgaaggcctgctcagaactcagcagctcctggatcacagagctgggcaggagggggctgccgtaagggaccacggagctcctgcttcccgtgcagggactgtgggccacgaggcccccactccctcagctgctagatgggagcgcctcctgctgcgcagcctgttgcctgctcgcaggaagtgggagagcaggtggagagaggctccctcttggacaaggccggccccaacatcaggaagccacccagatgggtcctgccagcacgaggctgggagggcagctgcgggaacccaggcagctctgggcctgctctgctgtcctcggcccccacccgtccctaacaggctcacacaggagcgctgtttcagaggcccccgcagaggaatcagcatggccatgaccccaagacctccagggttaggtcctggacccagagccagggcaagcggcctgcttctttgggagactgtccagctggtgggatgccagtgccaccacctccggcccggcagtcactcacctcagccttgccttgtattcgtcttcagacacagcctccccagggaactcaggggcctcagcggccccccactcaggtgacagctggtgagggacaggagttttctgttggggtactgagctctggccctgccccgcggggatcgggctctcgcccctcaaattgggacgaccctgctaggggcctccgggacccctgaggacccctcctgcctggccattcagataccttgagcctcctgtccaggtaggctggtgacacccagccctgccgtgaggggctggacttggtgggcttggtgcggacaagccagcgcagtgggtgggctgcatccaggacctccacatactggccttcccgcagcgtgatggcatcctgctcagcccctaggggcaggtagtcagcggtgaccacgtagatgtcaaagatctgagagagggatgggggtgctgaagtggtgagacccgggaggtgccagccgggcctgccgagatcctaagccacagggcagggatccccagagtcagcgtgcacacgcccagttccccctccacgcagaacagcgggaatgtgggagacctcccctgccccacccccaaccttagaggtcaccacagccccagggtctccaggcctggactgcctacactcagttacttgtttaccttctccccatctccacacccaccccaagccctaacagggtgcctggtacactgaggcctgagacacattctccattgaaggaacaaaggagtgaatgaatgaatcaaacaaatggctctcccagaaggcaagtctctgccgggccccgtgaggagaagaccctgttctcaccagttcctgcctcctatgcaccttggtgcggtcccacctccctagagtcccatgggggtcctgcctcctgagtccctctccaccctgcaccttctcttcaggaaggtcagggcctctccctgccctgctcccagagggttccagccgcccacctcgcctcgggcatcgccgtcctctgactctgaggaagactcctggatgctggaggatggccgtgatcggccatggcggggggatgcagatggtgtcttggagtcctcatcactgtcacctccgggcacctgcagcttggctgggggtgcaaggatcatgacaccctggcctgcctctggctctccagggctcaggggaagggcaaacaccccagacacaccccagggaccctggcacatgggctgctgcccctcaccctgcgtgatcttggccgataccatctcagtgatctgggaggtcagtttctgcaggaactcctctgtgcccacctcagcgagggacaggtggccgagggcctccttggcagccagaggctcttctgcggatacaaacgctctgctcaggtggctgcgtgcccctcggatgtataccaggcaccccatgccataggcccatgttgggccctgggagccgatggtgaacaaagagccaaggcctcccccgcatagtgctgatgtccagcagggagatgatgagactcagtggccggcagggcaggaggccagtgggaactggccaggatgaggagtcactctggctcatgagcgtcaagccgaggcgtgaccaatgggctgagaatgtccagagacagagggcacagcaggggccgccagtggacagtggacgaggggcactggggacagagtcagcagaggccagacctgcgcatcaggctgcaggaggagccgtgggtccaaagcggggctgtgctgcctctgttctcagtgcccagcacctaggagttctacccagacccaggtatctacacagcctgctggatgtgagctctgtgcccagggccggcccagggaccccacaggctcccggatccacggggatcagacatggttctgacactaaccaagcctcaagtccaggcctaagagaacatgggttggtcctggctgtgtgagcaggtgtcccaaggctgtgctgctcaggaggggcctctgaggccaggagccacccctgggcagcctcctccctgcccccaagcatcaggggatcagccaccctggcccctcacaagcatgcacccaccctgactgtacctttcctctgcccaccaaggtcagcaaaactcgcagtttccaacccctgtgctgagatggcttgtgtggtcctaaacaggtgaagggggtgtcctgagaggcctgggctggaccccaccaccctctgtccttatgcagaagctcctgacaaaaagagggtctgggggcaacaaaccaagataccagagaaagaggctccataccagagaggcccaacagaagccctcactttacaatggggaaactgagatgcagagaaggaagagagctggcccaaaccacatggcctgcatggggcagagccaggacacgctccgggacaggtgctctccccaggggcagcgctgtcctgtcccccactcctagagcgtcctccctggccctgaccggactggcctggaggggcaaccctcactcacccctgcaggaaagtggaaatcagcgcttccttcactttctcctgctcctccaccttaggcactgtcaggaggaccggcaagccatcagacggtgctcccaaccccagcacatctgattccagatctggactgggtccctccgaagccctgagcaggggctgtgcccgagctcacctccccatcccactcttggcccgtggtcaccctgacagtgatgggaggagaacaggggttcctgtcctcagaggggctaagcaaggcccaggatgcagggggcttcaggaaatgtctctggagccagcggtgcagaacccacggggcctgggcccagaggcgactctgaggctcaaaaccaccagcaccaccagggcctgacccattttggggtctccctggtgctgtcagagaatgaaaagaggaaggagggggtcccacagggtcccagccaagatggtggtgatgggcagtgtgccccaaggagaccccaaagccacccagtgcccaccccccatgccccagccccccatccccccatccccccacccccactcacggcccgagacgtgcaggctggcggagcagagggcctggccggcagcgttgctggcaatgcatgtgtaggtgccctggtgctgccggcccacgtccagcaggaccaggctgtgctgctgcgcagagctggccacggtgtagcccggtgtgtcagggccaatccacagcacgcctctctcagcctcctccctgagccagtgcacggtgggcaccgggcgtcctaggggcaggcaggaggtggtgggtgcaccccgccaggagcggggtctctggagataaagccctgccacaggccttccctcgggatgatgtgagtggggagggggcacctctgtcccatcccccaggggtgatctttccatagctgcgggcaggaaacgccttaccttctaccttcacagagaaggtgatgctggagcctttcttcactttcttgggggtgaacctctccagcattcggggcggcaccagctgctcatgcacatctaggggacacaggctggctggcagagacctcggcacagcccccaccgccc

SEQ ID NO: 38681 - DNA, 752943 bp, Homo sapiens
cgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggtaacgcgcgccccgggcgcccgccctctgcgccagccccaccgcttctcggcgtcccctgcagcccacctcctcgctccgcgccgcgccgtgcctccctccatccccgcctgccttcccctcgccgccttcccttccctcggctctcccggtgctctcggatcggggcagcgggcggcgcgccgggggtgaggagttgcccccagccagtgcgctccgggacgcggacgctcaatcctgtcctcttgtttattgtagggttgttggcggctgcggctggggccggggtcggggactcacaggctcgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataattttgcacaagggaatcccgggggaggagcatggcccgagataacagggggacttcgaggggcgagagaagttggggagatccatcccactattgggggtagcccacggggctgccacttttggaatgtgtcgaggtcgcatatctgatgtaacctcccactccgtcccttaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactggaaaaaagagagtgagccagctgccttctttctgagtaattcccatcctaggggacttcacgcgcgaaccgttttggagggaagggaaatccaggggaatagtgcagggtagatacacattgcagcctccacatgttcacatcttttctagtaaagttaaaccgaggacccctcaaacttctacagggcacagcaacttgtagcagcctccttggcggctgagagaagtagggaagcctggggctatgggtgaaggctggctatgaaaacaccaggggggaaggagcctgtctctcctgatcattaattatacatcctgttgggtgctggagctcagctgtgttttgtggcagcacatttgtgttttggaaaatactggtgtattggaacaaagggagaaatatgaaaaccatcattctcttcgtcattctctggcttctccggaggcctgcaggtgctggtcggagagttttctttggaattaccttctcagccgtagaggtttcttcttatttgttaaggaggcaaacctcccaccttccagagaagccctcaggttaagcaaagccctatacaccagatccctgactagccttcctgctgagaacagcttattcctggagccttcaaattcccacattccctctctccatccttctcctccacctcccccaacagtctcgggaattttgttccccggtttactgagattcagcgactgtctttaggggaaagatagctcatagttgtgtgcctctgaaatgttccctagatagagtgatctgggtgaactttttaacagcttgctttctttcaggcagggggcaatttttatcataatgaaaactttttccatgattgaaaataagttgtggtgtttttgtgaacctggggtcctaaacacagcttccaaagtctttttatgttagggggtacataaatgcaattgcagtgtctgtaatgaaatgctaatcccatcgcacacacaaaggatctcctaaatgatgagcaagcataacttctgtcagtttactcaagaaaataggtttttggcaacgattagaaaaaacaattcgtaaatatttggctatgttttgtagccccaagacctgctgagtggacataactggaagtgagttgctgtaagaaatctgccagggatgagaggtgatggtggtttgtttggaagatgtgaggccagtatagaatgagtgcaggttccttttgataccgtaagtccattttaaagcacacctagaatctcttgatacctgcccctagatttgctcacttaagccataggtagccagctcattatatgcagtaacggtaagttaggccttttaaaagcttttctttctatgcttgaggtctgtatttttattgcaattgtgtgtgtgtgtgtgtgtgtgtgtgtgtgtgtgtttgtctttttttcttttttctttccaagtatttggtagttttgtcaagactcgatacacaggcatgtatttggcttaagcttagaataataatttttgtgctagatttcccaagaaaacataggctgcctttccagaaaattctaccagccctcagatgggttcaccctcaccctccttcagccccaagatggtttgatcaagagctggagtccagaggaaagcaggtctgaaattctgtgggagataaaattcagcaaggagctccaatttcatgagcgtttggtctctgggatcgcaccaaacctttttgatcaaaggaacccaagactgtggacatgcatcgtgggacatctcttcattagtacctttggcctctgaatctcaaacagtgaatgactttagtcttttgaaaagagtggcatgtggactttttcagaaagtgaagaagaaaacattacaatttcctcctgttgggaacttggtcacagtcattccagtactgtgttctttgctgtactttttcacattattgtttttttccttgtgggatttcatcagagctctctattcacttgggtgtgacgttgtgaagttcaatcctgtcatagactatattgaatagggagctgctctggtagcctgaataaagccatgactttgaagaagttatttaacctctctggtgtctatctttccttgtgtataaaatgtggggattgaattctgtgagttctaatgtcccttcctgctctgtgattcgatataggagagagggaggagttgaggaatgagggttaaagtttctagctcagaatgtgttttgcagttccctagcaattcctttaggaattcagccttgggacagttacatatctttatttccatcttctgctcgtcttccagcatgtggtctacttctctttaaataactggggaaactgaggccaacttcctgttggagctgtggtttgttgaggggcctgagtgtggctgggcatagagttatttccattctcagtttgagctgttggccttgtagaagcttgggcttgatcaaggatggtctgcgtgtaatgaattatcgagatgttgtctccatggctgtgcctgagaaaacaacacgttttctctgtcaggctcgtgactaatataaatatcagatcccattacagcttggtaattacccagggtctggcctgacgcagtcaatcagggctggagcttcagtgccgtggagctcttgattccagattggcccttgtgcctcatctcatcctgtcctggggattggctgcaccagatgaccttgagatactcctttttgagcagatcacttggggtggccttggaggagttcttgggtcctagtcacgggggagctccagctgacctgcccttgtccagagagctcgtgctcctcattccttgctctctctctctctccttttattaatttttttttttgagatggagtctcgctctgtcacccaggctggagtgcagcggcacgatcttggctcactgcagcctgcgcctcctgggttcaagcaattctcctgcctcagcctcccaagtagctgggactacaggcgcacgctgccacacctggctaatttttgtattttaagtagagacggggtttcaccacattggccaggattgtcttgatctcctgaccttgtgattcgcccaccttggcctcccaaagtgctgggattacaggcgtgaggcacggcgtccagcccctggccctctttatggaaatgcacactttagtacaagactctgcaatcaggcaaacccaagttcaaatcatggatctcacatttattagcagggcatctttgactgccaaccatgttgagctttggttacatcacctataccaagagcatactgatgcttactttgtagggttcttatagggagcaggaataatgggcacatagcaccctgcaaatgccagacacttagcaggcctcttgtaagtggtaactatcatagcttcatgaagtgctgagtttattttccctttgattcattgaacttatagcccctgaagggcgcagactataacaaataaagtttttgagccaaaaggaggctttagatcctgaagtatactgtcatagatcaaaaaaccatttagagtcagactgagacatgggcttatggctcttggctgttgcaaggctggaaagttagggcagggcagcagaggtaggcttcacggatggggtcctggcaggatggttacagttttgatggtggggtatcagtggacgaacatcgacagtatgggggaccaggagctgctgggctggcagaagggaaacactgtggcatttggtgggcaggtatggttgtccagcattgtacccttgaggagggacaaattccatccctgttatcccaagtccagaactcatagacctgtctcccaagtgatgtcacggtctcttggccaggacactcactgtctacccagaccagcttttccaagacaccccctaggccaggtttccccaagtgtgttctgtggcacacctgccttttaaattaccttgtgaaaaaaaatcagcaggcatggcgtggctgagcttcccctttggagggccacatcacaggcttggcggcatcctgctggtagagaaagtggttaaaatgccctcaaatgtgctacctgtgagcagtcttgcttcagtgtcaggggtgctgtgcagtgcccaaggttcagcctgtgatcctgggcaaagacgtcatgcctttgtgcctcagtttcctcacctgcaaattgaggtctgtgatagagcacagcctcatggggtggtttttttcaccaaccccattttatagcatttcctaggaggacactgagaacctatggcctccctttgggagccttgggctagccctgcttctaggtgcccaggaaacttgaccaaacatacaacaggaggaaaagaagagctgcctgccccctgctgtttggcctgggggataaagcattccaatggtaagtccaaatggaccttctctttgcctcacagctattttgttccctggatggggacattcattggtggctgatagccaggagtaagtgcttgctttggggctgtctctctctttctctctctctcatcagggcatgagaggcctggtgcagaaacagttacattggcattcgattgcaatgccaggacctccttcccaaagtgggcgtcccggctcacactggcagtgaccatgctaatctgtgaatcacagcagccaataccaccttgccaagctgcagatcccctggaaggtcgcctttgtggttccagtgaaagggctgtttgtgctgtgatgccaggccctgggccgtgtggggaacactgggtcccttggagacatccctggggatcagacagggccatgcctttctgtgcacagtcagggagcagaccaaggatgtctcttttagaactgcttcttgggtgggtggaaccccacgcattaggcacctagaaaaggaaacccagggaccctcggaggcaagggtgtcctagcactttggacagaaaacctggggaatgttcagtgggaatatcacatctttatctccaaggactggagagtgtctctaggcctgggcttctcaaactttttttttttttttttttttttgggacagggtctcactctgttgcccaggctggagtacagtggcatgatcactgctcactgcagcttcaacctcccaggctcaagtgatcctcttgcctcagctccccaagtagccaagacttatgggtgtgtgccaccacacctggctaggttttaaattttttacagagatggggtctccctatgttgcccaggcttgtcttgaactcctgggttcaagtgatcttcccatcttggtctcccaaagtgctcccacagtggtgtgagccactgtgcctggcttagtcaaactttaatatgctcaggaatcaccgagagctgttaaaatgcaggctgtgattcagaagatccagtgtgggacctgagattatgctggtctggcgagacacaggctatactgatgctgtgcagaccacactttgagtatcaaggatctggtccatccctcagcctccgtgcagtccatccctgaagacaggcttatttttaaatgtggaaattcccagctcttgaagggggaagggatgagaagcagaaggtttgctctgccagatcgttgggtggagaaaactcctttcagaccagggtagctgtggttcgggctgggctcttatttgcgaaaactgatggtccaggtgcctgctcctaaggaacccatcagcgttgtggatttagggttgggttgtggtggccagagcagtgtttacagggtgtggtctgtgtgttacccaccaatgtgtgggctcttcctcgtgccagttggtcattctgcaaagggtgtgacttcccgaagtccaggagggcaacccagccaaactacctccttgcaaaattaaaggctggtggtgtcaccagggctgcactgcggtgatgccccaggctggctggggaccactccctctggagtgtttgaagtcagtgggcattaagactgccagcctgattttctgtaggggcctgggtgggccttcccaaatggagggttcaacctcaaagaattggctgaagagctgcccgtggagtgactgggggacacgcgtggcaccgtgctgtgtggccctccaatgcacttcttaagaattccagaagatgaaagtgaaagtagctccttttctcaccataccagggtttttcacagctcacactgtcagggactttttccatgagatgtgctttttatgttgtttcatcatcagaggggagcaccatgagtgtctgcagcaggcagaatgaagaaggacctagcatcgtggcggcctgcacacagtaggccctcaaagaagtcttctggttataattattgttgttgtttttgcttttgttgcatattaagtgtatacgatgtgccagaaaccaagctaggtgctgggggaaaaataattaagacccagttctgactccctgcttgttagggcttttattagtacttgacaggctgagcagaggaaaaaacagttatcttctcatggaatatgaacatctgatctctgaattgcctgcaaactccttgagggcaggaactgagtcatgcaaatgtaaacacacgtagatgttggaaggctctttccagtagttagctgggggctgaacgagaatgcattggttgggggtggcaaatatattttcctgcttttttgggtaatttgttagatgctatggagaaactcctggtgaaagagatgggcttggtttgttgacaacatggtgcttgaatcattcgtggattttaattattcatgccacctggtttctcttgatcagtagctaacaaggatttagttcataatgggcagttgtttgtgaggtggatgagtcaggcacgggagggaagggcagtttcaaaagaatggctgctttaagatggaacttgctttgtttttggcattatttggtgattgtcttgggacattgtgtctaattgccaatttggaaatgtaattggcactccaggcccagaatggatatacacttaacgttgtcaagccgagccttggaatcatctccctgtaagatcttgttacctgtatgactaatacttcttcacgtggccaaaatcaaaattatttaacacatctcctttattttctattctttatgctggttcactggcctctctaccagattttcttggggactcagatccagtggcctctaggcatttcaaagcgaattcacaggaaagcctgaattccagccttctccccctcctcctcttgctccatcctttcttttacatccttttttccttagtggctgtcattcctgagggtttctgtggaaagttggtgctgtttaattttggtttctagcacaatagggaggaatacttcaatttggggaagaagtaattaaggtaaacattatgtagatctccccattatcagagttgacttttacttggggaaggggtgtttttttaaaaaggaaaaataggattttagatttttttttttttttgagataccgtcttgctgtgttgcccaggctggcaggctggagtgcagtggcatgatctcggctcactgtaacctctccctccagggttctagtgcctcctgagtacctggcattccaggttctcatgccccatgcctggctaatttttgtatttttaatggagacgggatttcaccatgtcagtcaggctggtcttgaactcctgacctcaaatgatccacccgccttggcctcccaaagtgctgggattacaggcatgagccaccgcgcccggcgagattttaggtttttgacttgaagtgaagttaatttccatctgttaactgctgaagtctgggaccatgatgtcttttgcaaaagagtttttaaggcaagactgtcagtaatattctttccagggtcacttctaactgtacgaaactattcagccacgatgggtctgcatctttgcatatcattgtaaaccaaattatctacaggctgttgggctgcctgtatgtgcatttcaagttgggagtataagatgagtatttattttattttctggttccatgtcttgttcttgctccttcttcccttttagagactggacagtcctctctgtcttcatctttgggagtgaactggggctggggggtgggatcgagagtggcctctgctggctgggggcttcaggtttgtagattagtagacaacaaatagcgacctgatttaacaagtgcagaagcgcatggaactataaattcacagtggtggaaggaagctttggggcctcaggccctgtgcgattcctccccagtgctggaagcccaccctaccagtgtgtttatgatctcctgaggccactattccactggggacaaacccaccttacgatgaacttggaaagatctttctgtttgcactagtccttgtttgcttctagtctgtgtctgggacatgcagaacaagccttggtggatggtagatttcaaattctaaatccagttcaggaagggacagagctgggtggtgtttccatgtccgcagtgttgagacgtagaatgaccttaaccttaacttgtgtttcctccatgaaggccactttatttttctccctgatggcttccctgggttcttcgtcctcctgagacagtgtggtttccctttgcccctttgcccagagttcagaaaacgacccattctggttgtttcttgaagtttgccttctgaggtctcttcggtcttgtcagcagctgtgactggaggcttttgactgttgctgggccataaattcacctccttatcaatgtcacgtgccttgtatctccaaggtttagcccccttctcagtttcacgtgggggttgtaatttgggggccctgccaagaatttggatgtagggtacagagcctttgttaggaaactcgagttggattccattttctaggtgttgactctttttcacctagggagacagacagtgctcttgaacctctttttgcatcacttgaatacagccgcttcttagaataggaggctgtttctttcccacctgctcattgggtctcctttcctctggggctcctgtatgcctctgctgtcatctcccctattttgctgaacagaaagaaaccagaaaagaaaagagagcaaaacacacaaaggaagaaggtgagggagggcaggaggtagagggagaggttgacaccaaggaaaaaagaatttctcctctgagagttagaggttggataaatagctaattggatggattttggttttagttacctcacctttgtcttaatgaataaatcatgtcaaatgacttcacctccaaggagtaaagcattctaccagtgggtagaatgagttcacgtttggaaaattttagctcttcaaacgagacattctgtggaatgaactgatagcacgcggcctgtgtggctcagaggtgaagcgttggaagggtttgtgggagatgttctttgtgtgcttgttaaccaagagcagaattctgctcctctttgggagaagttgccacattgacgttgttttctctttatgtggttttggaaagtggaccctttgtggctctggaaggggaaaaatgggcctccagttattcaaatggagaactcagagataagtgttctaaggcttggaggaaagatttggaagatgaaaggccttacccaagtgctagggatttttatgaccaacattagctggcaacagcttaatatacattgttgttctccttcctgcatctgggaacactttcctcccagagcttagaggaattatttcagctgcccatgaattatggccgtttctcctgtggcttgtggcagccacagccgatcaggtggtagattcttgaagagtataggaatgatgtctctagctgagcccacaagagggctcaacagtttgcctcagtctaaaaaaaaaaaacccaatcatttcttaagttctttcacaaccctgttttctccataggatttactttttaacttcagtattttatattttgtccttaatcccaaatatactacatgttcattgtagaaaacgtaggccgtgcaggggcattaaacaaaaaggacacagtcacatctgttaggatggctactgtaaaaaaaaaaaaatagaaaatcaccagtgttggtgaggatgtggagaaattggaacccttgtgcagtgtttgtgggaatgcaaagtggtacagatgcggtggaaagcagtatggcagtttctcaaaacaaattaatcattcaattatcatataatccagcaattccacttctggttagatatccaaaaaacttaaaagcagggtcttaaggagatatttgtacacccatgttcacagcagcattatttacaatggccaaaggtggaagcaattcaagggttcattcacagatgaatagattagcgaattgtggtaggtacatacaacagagtattattcaactttaaaaaggaaggcaagtctgacacgtgctaccacatagatgaacatcgaggacatcagccaaatgaaataagccagtcacaaaaggataacttccacttacatgaggtacatagagttgccaaactcatagaaacagaaagtagaagggtagtttccagggccagagggagggaagtgtttaatgggtatagggtttcagttttgtaagatgaaaaagttctggagatgggatgcacaacaatgtgaaacatgcacatttttaagtgtgaagtactacacacttaaaaatggttgagatggtacttttttttttggcagagtctcgctctgtcgcccaggctggagtgcagtggcatgatctcggctcactgcaagctccgcctcccaggttcaagccattctcctgcctcagcctccggagtagctgggactacaggcgcccaccaccacgcccagctaactttttgtatttttagtagagacggggtttcaccatggtctggatctcctgatctcgtgatccgcccgcctcagcctcccaaagtgctgggattacaggcgtgagccactgtgcccagcctaagatggtacatttttgtcttctgtgtatttcaccacaattataaataaacatttgagaaaagggaaaaacattcctccaaattccccctccaggagatgaccagcattatctttgggcacatttccttccctgacatgttctttacggtggcgttcttgttttctcggtgggcagctgatattcttcctctaaagattgcagcccctctagaagcacccaggctgactttgatgtaggccctgcccacattgagagcagacaaatgaagagaacaaccctctttctgcctgtggggtctggtttaatggtgtctactcttagagtgaagttaagggagcgccggatttttgattttgacatatgacaagtgactagctacagtgtcttagacaagtcataggctccaggccttagttttctcatgcatataacaaattctctgatttcatgatttcaatataaagccatttcttaagtcagattttaaaactatcatttttacctgataaagaaccaaagattaagttattgagggcagtgaatccagggagaagttcttgttctactataaaacacaagagtgaaatttgattgacttgtccccagaacttcaatattgactttgatgacatatttaagaattacaatctagggacacaggccccattggaaataccatcaaacctgtcatttaaaaaaaaagtctcagaaataggtttttgtgactctactattacttctaatgatatagccacaccactattgaggttttaattttaatttttggtgtgggggaatggttcagaacatcttagattatagactataaatagtgtgctatgataggctggctttgttgaggttgaacataaaaagaaacatctgattaaagagaaggtcatgcaaatcaacttactttgatccttttccttaacttgccccaaaacgcagccttggagatagaacgttcatctcagccctgttccacggagcattccagctgccgaaagcagggataagataactgcagcttctgtggcaaaagagcaagtgtctgaagggatgattcctaaatactcagtaacctccgaaaaaaactccccctgaaccgtaagcagccagcacatcagaacttactggaatagttctcttaggttacataacatcgattcgattatgctaccggagccatgcattaaattttaacttgtcacagatacattacattaacacttcacaaatccacagagtaccaggtagctttggggtgttggtaattgtgtaggacttgctgcaatccaggcaaaaatacttacttgtacattttgtttcttctgtactatagtttaactcttttcaggggtgcaaacatcctgcaaatattctttctttctttttttttttttgagacggagtcttggtctgtcgtccaggctagggtgcagtgtcacgatctcggctcacctcaacctttgtctcctgggttcaagcaattctcctgcctcagcctcccacgtaactgggattacagacatgcaccatcatgaacagctaattttttttttttgtatttttagtagagatggggttttaccgtgttggccaggctggtcttgaactcctgatctcaagtactccacctgcctcggcctcccagagtgctgggattacaggtgtgagccactgcacccagctgttccaagtacttcttacaaaataaactaaaaatttagacaatagtgattgccaccgtagtactgaatacttgatttatgaccatggactagatatggcagaggtttttaaaactctgtgaaccttttcattttcccgtgacaggcaatgcaagtgctgtatttttaattggtccctttttaaagtcaggagatgaaatgttatcatgcaaatctctcctaagttgcatggaaactaataaaatcacgaaggtttctatttgtactctacgaacacagactgtaatgaaactaaaacagctatctccagggatgatgctatttaaattctaggcagggctttaaaatgattttcatggtgaaaacagaaactagcaactgagatgttcctgttctttcttcctcatctcaccagtgcctgttcacccatgttcctttttacttcctgacctcagaaaatgaatgtaaagcaagaacctccggtctctaagatagcctgtctatcactggttttagaaaacagcaatgattcctcctcaggtcttgcatttattttcagacttattggtacttttgttttgggaagtctttctgtgggaattggagttactattttcttaggggaaaaaaaatcagaacaaacttgtttgagtggcttctatgcattaagcattgttttaagctccttatgtttattctgttatttaatcctcaaaacaatcctgtgatgtagtccccttttaaattcccattttacaggttagaaaatggatgcatagagaatgagaatgtttttctttttttggataacaaactttgagtgattactgtgtgtctggttgtttttaaactatatgtattatataatcctcacaacaacccagtgaattcggtggtattattatcctcacttatggattagaaaactgaggcacagagaggttgagtaactgctcagggtcacacacaggtgaggagcagagccagtttaaatccaggcaggtgggctgtggatcccatgcacctaatcccacactgtacacctcatttatacctccttagctcttcctggccacagtgtgagggaaactctgatgacatagacaggactgaaaagaggagtggtgtgttgttcctggagagatgtgaggtcccttgacaagttcagagagttttgtactactgaattctcaggtatgtcaattcccaggatgagaaggaaccttaaatgttgtctagttctattacattccctgagtcttagtttttcttgctggaaaatgggataatcaccttttctctacctgacaggcagtgggctatatacagtcatgcaggttactcaatgtacaactccaggactgctatgagattcacatcagatgacatataaatgtattttatgaaccacagcacatgtgccacatctctgtgctggggggtatgtggaggcacagaatcaatattgggtcatttttctgagtgtcaacagtcttccatgaagttttggagaaaaacactatttttctctaaaacctccacctcctgggctcaagcaatctcccacctcagcctcctgagtagctgggacttgcaggcatgtgactacaggcatgcaccatcatgcctggctaattttttgtatttttggtggagatggagtttcgccatgttgcccaggctggtctctaactcttgagctcaagtggtccacctgcctcggcccccaaagtgctggaattacaggcgtgagccactgtgcccagcagaaaaacactatttttggtattaacacttacactgtacacagagtatattggaggtaggatgcagaatttaagtaggtttttaaaaacttgagagaggggtgtgtgtgtgtgtgtgtgtgtgtacatgtacgtatgtgtgagatgcacacagattcaagagagcatgggggaccagcaaagtttgcacccaccagcgaagtctcatcattaaaccatgggcctgtgcaacctggtgtggaatgatgccttattatcccacatgagatatgctcatatctcaaactctgaaactgtgttagtaaaagaatgggaattctgtgaaagagaaataaatatatccaaattccaggtctgttaaaatttagcgcacttggatgttggtgcgacagagaatttaatctgcacactcagaagaaggtagtggttaactcattcagtggttatgaatcttccttgccttagaaagatcaattccttgtgcctctccacctccgtggcctggaaatacattattatatttcaatatggctctctttctaggccattgcgcattgtggccgtgtgcctgccaaaccccgtgcatggaatatttggaagcaggagacaaattggttagttagcaaatctttattagcatggctggccttttcccggggatatggggtcatgtaagacatcatttcctctctggcaataccggtaaccacattgcatgattccagggcgccactcacatcctggtcatgaatgaagccctctggagttgtgcagtgcacagcctgcatgcccatatacattgtcttttctaggcatctagctgtgtttgtgtaaaacccttacacaacaaattaaaaacacagtgcaaagcccataattcttaatggcaatgtgaataacagaaacatcaagaatttgggtttccaaaaatggggagaaaacagaactggccgtagagggagtggccagagagaacccactggggatgtggggttatgacggcagccccagcatatcctccaaatccagcctctgcaacaggcgctctccctaacttctgatcactgtgcagctcctgacatgatacaagaggcctcccaggcctctgtgcctgttctaagcatgagccttggagaagagagaatgctcagtgccagctcatgtgtatcccatggacaaggactaataggaccctgaggacttagaaaagccttctctgttgccaactgtgctatttttacctccctcccacagctcctgctttccccaggtatttgtcagcagagcgtcttgcacctgcatggaaagtggcagttggggcccaggatggccttgtgctgtgcaggccacagcagtctccttaccaggcctggcggccaggcccggcggccaggcccagcctctgaggctggcaggctgtggtgaggatggttgcataactggcctttctgccgctggttctgggtgaggtcgagccagagaaaacagttctgcagtcgacagcccctcctgggcactggtgcaacagacaggcttgtgggcctggtgctgacccctcacggtcaggagccacccttgctcttgagctgctgatcatcactgcagagtgcccaggtctgatcaacatccctgctgggaaaagcggagatgacctggcgtggtccatagtgatccaaatgtgatagaaggctgggggtggccccagtgatggcctactccttcccttccaaccctccacctcctccatcctccaagtcttagctcatcttgctgggaatgccgccttcctgggaagccttctctacctaccctagtcagctttctctgcctctcccttccctgatgcgtcctctctgtttgtccttccatcctgggtggggagcagccgtctgatgctgcagccctattttctatacaggcatcctgtctcctctgcagacagctccttgtggacagggctggtcctggtttctttctggatctgtgcctggcaggtggtcctagagggcagtgaccaggggtcgctcaatgtggtggctggtcatcaaagcaggccctcagtgaaccacgactcctcacgttcatcctcttgggttgtaccctttggggcagagctagcccctgtaatccatgggttgcttgtaacccatggattgtggtggaaatgatgctatgtgacttctgaggctatgttggaagaaccctggcagttcatttgttatctgggaatgctacttcttagggaagttggccactacagggggaagagcgagagtgagaggaagcatgtgcgtgggcatacgagagagagagagagagagagagagagagagacagacagacagagagacactactggggcaccacgcatatgtgtgaagatgccatcatggaagtggatcctccaaccccagttgacatagattggagatgaacccaccagctgatccctctatgaattccttacttaaaagtcataaacaaaatgaaatgattgttttaagccactacattttggggtaatttgttacatagccatggatgactggaacaaataattactatttagtgaagtcctttcacaaggtccagctcctgccctctttctaggttcctcttaacatcttcccaagctctccacacccagccacttaggacttccttcatttcgttaaaccttttgatttttacctctgggccttcacacatgctgttcacactgccggacttctcttttcttgtcctccttctccccttccacttagctgactcctgtttatccagggatgtgctggtaagtgattaacaacgggatttctagagaagaaagtccctatgtacggtgttcgtcaattcctatggtataaatattcctgccctggctggtttgaagataccagtgtgatgtcacagaacatagggtattgttatccatgattggcagttgtggaaactgaagcccagagcagttcagtcacttttctgggtagatcccaggcagatatggcctctgatatgcttggcctttgagaccatgctctttcctgttctcctgaagaaccagtagctatgagcacaggtaatattgctgctgggccatcctgtttcttctagacgagtagtcttccctctgcatttcttgagttgctgcaggctttaccttatgcttaccatacctggccagttgccagttaccacaccacgctgctggtttctctcctggaccatatttatggtatctagactctggtgtgtgcagtggcgatggaatcattgaggcaacagggacctgtgagtccatcttgaggtttgataaactgtgtattagtcagctaggccacctctgtaacaagaggtcaacatgtcaatgacttaatacagcagaagtttacgtattgctcatacaaagtaccattgatggtgtgtgtggagggtgcagtgaagacacacttcagacagtcattaaagaccccggctcctttcacttgtggacctgaaatcttctaggggcccctgaaggtctctgctggaccctctgcatctgtccggatgataggggatgagaagtaaggatcatgaggggtagttttgtaggggtagttatggaagtcattcacatcacgtctacccacacagttcattggccagaacttgatcacatggtattttaactgcaagggatcctgggaaatgtagcactgcacccaggagattgaaatagatttggagaacacctggactgctgaaggggctcccgagtcccacactgagggcttctgctgtccatagctggctctgccagaaccattatcatgacccaatgagaaaactgaatgtttactgggtatttgctaggtgtcagacatggtgtcaagcactttatatgcattatctcaatcctctaaatcagcctatgatgtagatactatctgtatttttcccattttacagatgtacaaaaactggggcttgcaatggctatgtgatgtcacttgcccaagaggcatccttaataagtggcagtaccagcattagaacccagggttttctgtcttcagattgttaactcttaccctcttcctatgctgctctggagtgccttcagctctgcctcttcttatccctgtctgcagcttgaaagctactcagcttcttaaacaccttcaggataaagggactaaggggcataactgcctccctgcttcatgtttcaaagagattgtcactggtttacgttggccctaattcaggggtggtgaattgacagtagttacctgagcctgccctcatgatttgaatgcatcatctcccagtctgccctctcccactttgaatcttacctggcgtggctctttgcctggagcattgagagtggaaggctcatggatgacagaggctgcttcccgggtttcttgtctcactcctgtggtgatgtgcttcaccttggaaatgcacttcactgtagccccttctacccatgtccaattttatgtctcagcaaagtaagttcaacagttcactgctgagaaaacagggtctcaaacgtgagtagtaacataagtaatacggttgcctttctaaaatccaatggaccagaattgtaatgtctcaatgagcaacgtctctcattctagatagttcagtgtggtcatcagggacatgccctctggagccagcctactcaggcttaaatcatagttgtgttgcttgctgacctttggatcttgggcaagccacttcacctctgcatgcctcagttcactcacttggaaagtgggaataaaataatactgaaaacgccctcaaacagttcctagtatcaaattggcttttttttttttttgagatggagcttcactctcgtgcccagactggagtgcagtggtgcagtctcggctcactgcaacctccacctatcaggttcaagtgattctcttgcctcagcctcccgagtagctgggattacaggtgcgcaccaccatgtccggctaatttctgtatttttagtagagacggggtttcaccatgttggccaggctggtctcgaactcctgatctcaagtgatccacccgcctcagcctcccaaagtgctgggattacaggcatgtgccactgcacccggtcttcaaattgactttcaaatgctgggagatgtcaccccacattatcctcctgctgcctggggttgttgggaggatcatgtgttaaatgctgagggtagcacttgctacaaaccaagggctaggaaagtgttagttattactgttactttcatttggtcatctttgggagactgtgacattttcccctaatgtgggcattgacaataacctcctaggtcattggtcactctgtttctggtaagtctccactctagtccatccaggttggattgcacgtctgtggaatgtccaccccctgctggaatgtagcatctctgaagcctaggactctgtgccttccatctttgcatccacagtgcaacattttgaatgttcattttggtctcttaaattcagtcttgtgaggctcttagcctagtttggaattggtcaaaggcgggtttgagtcctggctctaccttgcattagcttggtggttgtggccaatttacttaaccttgcaaagctcactttcttcattggtaaactgtgaatactaaaaataccagccacgtaaaggttttgtgagtataatagcatttagcatcttgtaagtcctcaataaatggccctgttatgatgaagttggcctttattttagatccctctcctttgtcaatataaccaggattgtgctgaactgagggacaggagaccactggaaggggcagggtagccaggggccaacagtgagcaccaagacggacagtgaggtagtgctaaagatggaggcagaaagtagggttggaggaaaatggggtgagaaatgctcccttccctctgcctctcatcacccacggcacacccctataccactataggaaggacgagggagaggggaatggagagagaggaaaggaagaattttgcagtacgagatgtcaggcattgaaagggttaactcaggggcgaggcctcagtttgccacctgtaaaacggaggattggatgaggccattctgagggtccctggtggctccagcagtcccttgcatttttataagaattgtgattgtgctcctgcctgttctgcccctacaccacccaccttctgcagcctcaggcagttggagatgatgtcaaaaggaacagaaggggtggaaagtgctggagggcatggaatggtttctcccagaaggctgagggtctgaaaagaggcttagaagcctggtagccagagcaggacggacctggtggacccatctggtgatcctggggctgctctggggcctggtgaatggtgaatggaccagaggcaccttttgggctctgaacaaagaagaaaggccaggctccagacccagccctcctgcctggtgggctttttagttggcactttcccctatttaggaacctgtgctactctgataggctgaggcagcccaggcgcctgtgttaaggttgcttaacatctggtatttgtctccagactcttttctctatcagggattatgtgttctgaggcacccaaaacatctttctgtacaccaagttccttcatgaagacttccgggtcttctttccacttcacactcccttttatctcaagcttattctgccacaggcatttggttaagcaaatatgttgctcattggcaacttgtcccatacctgggccaggttatgaagaggattccaagagtgtcagtcatgtggtgcttgcttgggggagcccaagctgagctggggctgggtgagggatggacaagggggctccttcctctgctcatgcagtgaggtggaaagggcatggggttggggtgcaaggacctgggttcctctcttgcctcccctgtgtggtcttgggcaagttgtctaccctcctcatgcctcagtttccattacatgtagggtgaagaccacagagaaagttccacctagcacatgaaaaatactcagtaggtaatggctcccatttttgtgatgtatccaggtagaataatggcatttagcagaagtcagtttattcaagctcacctttgagtctatcttacacaaagcactggttaggtgagggatggcgatgagccccggagaattccgcatgcttcccttctttagctttccagctagattgtaagctcctaactggatccttcaggatttggcacactctggtctgtgggccactgagacaggacatacatcttcttcatttctttctgtattcccagcaccaaacacgtggcatgtctctggtgggcatttggtagatggtgggcgaatgaatgaacaaacgagcattcagtaacctcttgctgatgaattgactaatactccacactggttacatttatattttgggcactgaatctctttgttttctggctctctcagggtatttaattttttctggaagctgaggttgagcctttcaggccacctttaccaggtcccaggctccaagtagactagacacccacccaggcctgggcagtggtagggagggtgtgacccaggcattggcctgcaaatttgccccagctccttcttgccaatgacttgtcacagggctcctgaagcctctcatgcctgactgcctcagaagaaagggtattttgtgagctctgtgggtgttaagtgttgaggagcagttcccaccagcagacagccttcacctgtgtttgataaaatgacaaattcatttttttcttctctaccccatccatctcctctttccttccctgtctgaaggggcctctgtcaggccagccaccagctatcgtgagaggagccaagttcctcattgccctgtgctgaaccgaactgcagcaagttggatagaggaggcagttttggcttgaacgcaaacatcctgtcggagaacagagtgattatagttttagctgcacacggggaaataacagcacagaggtgaatcatggcatctgtttactgctaattaacccctccgtgtacaccagtgttgtatgtgagccggcctgcggtctgaaccgcctcctataaggagggctcccttggcagccaaaaccagttggcccaaatgccttgataggcttcctgcttcacttgttgcccatgtggtctgattttagataaaagcattgcttttgggccagataagctttgagttctttaatgaagcactgtgtgtattggagagaggcacagagcacccagagctgaagctggtcagtcctggtcggccacagtttatggggctcctgggaggttttaaactctgtgctgcaactggggaaggttgtgggggaaggttgggtccagggagctactatttattgagggcttacaatatatcacattctgagctggccactttacatcttagctggtaaaattctcacagtgatcctgaaggacaagtgtggttcaggagctgagactcatagaggttaagaaatcacctggtggtggggttttggggagggccacacaggcatcccaagaggtagaagacaagctcagacatccaggaacttacagacttattgtgtgtgagatagttccataccatttgtaatttattcccaaaataaacagttattgagcatctattgcatgcctgtgctcagtgggggtggggggagtagggagagagaatccagaaaggagtcagctccagctttgtcttccataagcaaatggcttagaggggattgttcattttcactgttttgttttggggcaaggaggtgtgtcagggaggtgaggaggtagagtagagaatcatcctccaccgtgaagtgaagagaggaaggtacccccacattggaaatatgccttgaggaccagaaggaattgaccagtcttttgactttcattttttaaaattgaagtctaacatacatgtagggcatgcacagacataaggtgtacaggttggtacaatgtatgcgcctgtgcagccgcctgttcttggaggcaagagccctatgagttgcatgtggtcttcaggcagaatgaggagatgccgaccacaagcgctcctaggaattcagaggaaatggagcgcaatgaacccctccaaatctagtttccaccagaagggagaggaagatgaatattcatggatcttgatctctttttgcatcatttacattttgctttctccagatttgaggctccccacctgcccctgagttctgaagaataattgtttcatgcatcacatttttactgcattgggagaaaaagagggaaaaagaaaataaattgggagaagaaaagatgataggacttcttgactagttcagccagtttcgtgaccatgacctagaatgtgcctgggtctttggccatgtccgtgaaatgtgcacattatctttgggatttgcaggagcaaggtctggtgctgggctctgatgtcctgtggcctccatatgttcttgggaggatgtttttggatctggttaggtccatgtgttgggagcattgggagccaggagaaaccagaatgccaccaggattcccatctctttcttctctggactcctttagcttgcactgttgcatttcttaaatcatgtcactagtcaaatatatactttactgttttgtggaccttgatcttgccttgctgattagattatgaactcctctttggacttatgatcagagtgccttgtccttccctgatgtgctgtcccctgcgtacctagtcttgtctgagcacacagtacctcgccccatgaatgcttgctgtgtgcactgattttgcacacagcaagggtttttggtaaagttgtctgtggcttgccattacagggacataggattggatctagataaaccagtagaacagtttctgtatctagacatctgggtgaacactggccttggggaacagcagagaagcttggaaaaaaaaatgataataagtcacacttaatggagaactcgctatgtgccgggctgggtatgagggactttacgtagctgaatcagtgataagcttttgattgcatgtagcagaaatgctcacttcaatgggcttaacattaaagggactccattgactcatatagttggaaaggtggatgacttcagatgagccttgatccggtggctcaacgatgtctccatggacccagtttctttctgtcactctaatctgctctccttacagttggccttgtcctgaggctggtttgcctctgggttcacacatggctgctgcagctctggagggcacatgctgatctgctcaaccttgtcaggaaataaatcacctttgcaccagcattcctagcacaggttctgagagttgctgtaactgaactggctgaagccagggattattgtcagtatcctcagaaccttatggatctcaaatggaaaacaaggtctgcaaggaatggggaaggtggaagtttggaaaggagttagccaaagtcccctacacatgggtggttgcatttaatcctcatagcatccctgtgaaattggcatgattatcacccccatttacagacaaggaagcagaggcacagagaggccaagtaatttggctcagttcacatagctcatggcttaagccaggaattgagcctggacagttggactccagagctttgctctgctaaccactccatggcatttttcaataagtgcttttttgtttttttaattgagataaaattccttcttttaaagtgtacatacagttcggtagttttttagcttattcgcaaagttgtgtaaccatcattattatctacattttcatcactccaaaaggaagtcctgtaccattaagcagtcactccctattccctctgctcccagtccctggctggtctactctgtgtgggctctctggatgtgcctgatctggacacttcatataagtggaatcacacaatatgtggccttttgtgtctggcttctctcacttagccaatgggagtttctgactaggatctactgtgtctgacctcaaggaatctccattcctatctttcccagcagaaaagagacagcaccgctggccgactctggaagaaagagattctgtgctagagagagagagagcctccacccttgtactccgcttaccttttggggcagcccgaggctgcggctcagtgagggcagctatggatatgcacagtgagggtcattctggattctccggcaccctctatgtgccaaggactgtctgaagccctgggaaactgcaacagaaagggctgggttgggtttcagtgtgtgtggtggggggtgcagataatcaacacttcagtaaatcaatgaatgagataatttacagtggcaccatgagaccactgaacaggggatgggattgtgtgtgttagaggggctgctttggtgggtagccagagaagcctcttttgaggaggagatggtcatatggcagaggcaggactgaggagaaagtgagggccacacaggatttgggccagaaagccgcaggcagaggagcagctggtgcagggtgggaacagggtgacctggcctttgggcgaattggggatggtgggtgactggccgccttgtttctgttttcatcgccttgttactgctttttctaaatggttcctcccacacagacatcttttacttgcagcttctgctatggaaggttttgtccactgctgacaggctgtggggagttccatccttgagtatgtttggggctttattttcagtctgtgtttttgaaacttgagccctgacttcctcttgttcctgacgcaggcctgagagtgccaattggctgtatttttttttttaaaatgaacacttattattaaaattttctctggataaataaaaattgtacttgtttattgtatacaacatgttgttttgaaatatgtatacattgtggaatggctgaattgagctaattatcgtatgcattatctcatatacctattttttgtggtgagaacactgaaaatctcttttcttagcagttttcaagaatacaatacattgttattaattgttatcaccatgatgtacagtaatagatgtcttgaatttattcctcctgtttaactgaaagtttgtactctttgaccagcattcctctcccatcccagcccctggtaaccactgttctgctttctgctcctatgagctcaactttttaagagtccacatataaattagatcacgtagtatttgtcttcctatccctggcttatttcacttaacatactgtcctctaggttcatccatgttgttggaaatggcaggatatccttcttttttaaaggctgaatagtgttccactgtgtacatgtaccacaatttctttatccatcatccgttggtgggcacttagataggttcgatttcttggctattgtgaataatgctgctgtgaacattggaatgcagacatctctttgacgtactgatttcatttcctttggatatataaccagtagtgagattgctggatcatatggtagttctatttttgatttttctgaggaacctccatactgttttccataatgactttatcaatttacagtcccaccaacagtgtaacagggttctcttttctttatacccacaccagcacttgctctctctctctctctttttttgcttatagccattttaacaggtgtgaggttataactcatcgtggctttgattgtgtagccctgatgattagtgatgttgagcacctttttatatacctgtgggccatttgtatgccttccttggaaaaatgtctatgcaacggttctttttgatagagatgttaaataaagcagttctgggcagagggagatcaatgcaagtgtctataacaggctgagagttgattcactggtgaacaggacaaccaaggtccctgccctcagaggtctgagcaattccatcatcagtgactagattgaacagataatcccctcttacacacgtatatgcacacttcagcctggagtgtgatgagagactatggactataatgcgtgtgtgtgtgggggtgcatcctctccttggccggggctcagggaaggcttccctgcagaaatgagacctacaggcccggcatggtgactcatgactgtaaccccagcactttcagaggtcaaggcgggtggatcgcttgagcccaggagtttgagaccagcctgggcaacatggcaaaactccatctctacgaaaaatacaaaaaattagccaggcgtggtggcacatccccgtagtcccagctactcttgaggctgagatgggatgattgcttgagcctgggaggtggaggttgcagtgaaccaagattgtatcattgcactcctacctgggcaacagagtgagaccctgtctccaaaaaaaagaaatgagatctacaggatgaagaggcattagccaggggtgggtgcagggggacgtgcagaggaatggtgtctttgaagactctgaggctggaacaaagcttcatggaaggaatgagagctggaaggacggggaggacttaggcagaaagcagcatagtccaggccacagggaccctaggaaagaggatggaggaaagaggatgacaatatgttacgggaaggcagggatgggtctcttttgtgaattacttaacccctaatggctagcagtgttgagcaggagaagggacctctcgagtggctgagtgtgggtgtcagttttcccttgctgctgtaacgaccacaaacatagtgccttaagataacacaaatatactcctacagttctgaaggcgagaagtcggaaatcagtttccctgggcttttaaagtcaaagcgtctgcagggctggttccttctggaggctctgaggggcaagtcgtttttcttgccttttgcagcttccagtagccacctgcatccccagtcttgtggctttctgctccgtatccaaagcacattgctccatctcagtttccatcatcacatctcttactttctcttctgtgtcaaatctccctctacctccctctttgaaggacctttgtgattgcatttagggcccacctggatgatccaggctaatctcttcatctcaaggtccttaattaaattatgtctgtagagtcccttgtgccagttaaggtcgcagtcacagattccagggatgaggacgtggacatcttctagggccatgattcagcccacctcagcatatagatgaatgccatttttatgggaatcagtgaggcatgctaagcaggaagcaatgccttttgcaagcagaggtaggaagatcggtctagtccgtcagctggcactggccaggctccactgtccattatcctcctcacctgccctaatctttcctttattgctcctaagtgataccacgtagcttcttcagtctcaaatcatcctactcagacccttttctgacattcagagccttccttatcccacagttctttctgtccttttcccttcctatctgataaatccttgtgagtagttgacaaaagagtgcctgaagatgtcagggcagaggctcacttctggtctgtctagttgggtgagtctgaacttgaggccccagggcttattggaggcaaactgagtcatggagagggagagtacagtaaggccactaccaagggctggctgcagagggtgcaagggttgcacgggttttggggttgttggcttccccagaggggttctttgtatggtgtcaaggtgcctgtgggcattaggtgactaaaaggactgaacacgataaactcttggtggctcttcctgctgcaggaagggaatactccaagttcccagaggagaccacccagtgatggagtgaagctgcatccttggctcccctcagctcaggaccctcagaaaggacttaggaagacgggcactgccagatacagacgtctttctggactctaggaaggggtgccttttttcttttctttaagagatagtctcactctgttgcccaggctagagtgcagtggcatggtcataacttactgcagccttgaactcctgagctcaagtgatcctcccacatcagcctcccaagtagctaggactacaggtgcgcactactgtgcccagctaattttttaattattttgtagagatggggtcttgaactcccagcctcaagcgatcgtcccctcttggcctcccaaagcactgggattacaggtgtgagccactgtgcctggccaaagatgcctttttgagggccatgaggggttgctgctctgggtctgggcatttctctggaggagctgcttgtacagcaatgattgtcccatccctccttttagtcccacaggtcagagtgggacttaggacagtgggacagtgggacccaaaacttaaagccagcctggtatttcagcagtattatctgttacctagagagaggctgatgcaggggtgtctgggaggctggagggctgcaccaagggtggatggcagagcctgagccatgggtctaggccgcagcactgccatgcggctgggaagatggtagtgtgtgggtatagtcatgggtgttgcggcttatctgcacctgcttgcgttcaggcagaagcagggtagcgtggcatggtgaggaccatggattcagttccagctcggctgctgatagctgcatgaccttggggaagttgcacatcctccataagtcctagttttctataacatgggcatccctgatgtagagcatttgtgcagttgtgtgtaaaggatgtggcagttaggaagcacctaccaagtgtgagccatttctgttgtcattgccatgtatcagccagcctgagggcctgcagggcctggcctgggatgtgggaaagctttccagaaagggagcaggagatggcgccctgtcacctccctcaactgggccagagtgtggggaggctgctcggggcttgctccttctgaaacacccctgacgactgtcccagcagaggagggaggctgccttggaagcctggctgcactgtgtagggagggtacccagcagagggctgggaggtctccaggcccctttgagcactgacagcccatcatctgacctctccaggaacccacgagaaagcatgagatgaacagacagacttggcttgaagctcacttcctagttgtgttactcctcagggcctcagttttgccgcctaaaagatgggaatcacgtcccacttgccgggtgctttgaagctcaggaaagatgaagcatctcttttagaggccctcagggctgcaggcaccatgccagctctttcctgtgttacctccttaaccctcttcaaggagggcatccgggacagtccctggcaactagcaagcacccaacacagggcccttcttaccaggtggcctctgaggacctttcagccatgtgcccctgggctgcggctgggcgcggtccttgggagggatgtccctctgtggttcctggaaagcccggcagctggctgctttgttctggccactgggtgtctgctgttaggactgcgggttttatggctgtttccttgtgctcaaccttttataggtgaccctgtgttttttggagccacacctgatgggggccaaggcctttgaaatgttccagagtctttatgggctgcagcggcatatggtgggtggcccaagctgcctgacaaggaaggggtgggggagggtggaggcagggaggccaggacctgcatttccaggtgagcctgagacctcagacggatgtgttgtttttctagttgcctacttaggtctactaatctttaggaaggaatgatagcctggtttatgggatatgacataagtttttctaaaagggacctgagatgaagaattaggcaactcttttttttggggggcgggggatggggttttgctctgttgtgcaggctggagtgcagtggtgcaatcatagctcactgtagcctccacctcctgagttcaagcgacataggtgcacaccaccatgcccagctaattttttttaattaagtaaattttttgggggtagaaatgaggtctcattctgttgcccaggctggtcttgaactgctggcctcaagtgatcctcctgcctcagcctcccaaagtactgggattatagaagtgagccactgtgcctggccaacaacttttaaaaactaaaataaatatcatgcctgctgattgttttttcttgagacttctttttttcttctctttcagtttctgttactatgtccctcactgtccttgacaaaagaggctttttatgcccactgtgggttttgcaggtgatagtttagtgtagaatggtagtgaaagccatgggcttagggtcagacaaagcttggtttgaatcctgtccctaccactgaactgacttgattgtcacctagactagaggagcaactcctagcattcacttcctcggggccaggacaagttggcatcctgctgcacacagggcaacctggagaatcaagagaaggctgccagcctcagatgccagtggctccctaggaaagatagtgttagttggtccccagtaatatctggcctttatcacacacctttatgtgtcaggcaccgttgtgagcaattcacattagtcctggaggcaggaaatgtcattaacctcatgttgcaggtaggggaactgaggttaagtaacttgtctaaggccacacatgtagcaagtggcagaggcaggatttgaatcaggcagcccaatgccagtgtctgcacttagaatcactgagagccatattgcctttctgagggctgttcttgatctgagagactagagtcctctgtcaagagctagtactgggcagccctgggggctgggttgtggggtgtgggctgtggaaggagtaagggaggtgctttctgctgtgtaatggggcaggtggttgggtgtgaactcgcctgacttacggccccagctgtttcctcttctaactcctcctcccagatgcctgccaggatgccagaggttagagggaggtgtgtccaatcatggactggatctgaggtccctctccttccctgcttatgacacaaatgctcagaccctgttctcctgaagggacacagaacctgtctccctgtttggattgcaagctccagactgcatccttgaagtgggacaacagagggaaatctatctcagcctcatgatccatggacgcatctcattcagtcctgggctccttgctggcccctggtgctgcagaaatccatggctgagggggtggagatgggtgggggggaccgaaggaagctgtgcaagcctgactctgcaggaagtcctgcgaacgctggcattaaaaacaccattgcctgttgctttatttttagtggtacaaggagccctgagggcaccaggggggatgtgggaatcctattttttgctctgtcttgctaatggaacctctagcagtttttatgcctgatttgtttccctctgaagtctgtcatgcctgcagccccagactgtactcttccttgcacacagctcagaggaacatagacgatggtgtcagctgttggacttgcagccccacttcctgccagccccggcttccctgagaaggaagagggccgcctctcttgtttcatacccttccccattcttggcttggttacattgtgcttgtcaaataagcactcagctcccctctgagatgaatgcatattcccggaggtgtcccctggacatgctctgagaatgttcccatgcttgctttggttactcagaaccccgaaatccacgggagggatgagggtggttggctggcaggaggggctgctggagggctgaacaaatgcccgtgtggggtgctggtctcctatggtaggattgcaagggctgctaggtaggactgatatgtgcccagtgcccaggtgacaaatgacagacagcttgtggggcagggaagcacctcctagtgtgctacctccatattcttctacaccatcaaattttaaaaaccgagctttattgaggtatcactcacatgctataaaatttactcatttgcagtggtttttagtatatacagagagttgtgcaatcattgctattatttaattccagaacattttcatcaacctaaaagaaacaaaccccatacccatgagcagtcactccccacacccctccttccccagcctcagacgctactgaactgctgtctgtctgtacggatttgccccttgtggccattccatctaaatgtgctcatacaataggtggcctttctgagcccgtgtcatgctacaatagtgaacccctatcctattctatgacagacatgagagtgctcagaacctgaagagttggcattatcacaagcgcatccccgtctcccccaaaccaggcttcagtgccagggcagacatgggagacctgggaagcctgcccccagattttgctgtcaggcattggtgagttttgtgtccctcacaagtgggaatacattcaaaagacccctcccaccaactgggatggtgaaaagtataaaggacagtctcattctcagtgccatttagaatagggcagttttgatgaggagcaaggtgagtttcttaggtggtgtggctcttctcgaaatcaagggagctggagctggactcctgctatatcccttgctcagaactctgtactgcctggatctgatcattagcagagtctgcgccacctgctttggctcttggtccaaaaaatttgctgtatccttggcttagctactctgtgtccttgagggccaggaggttgccttgaagtccatgtggttcctggttgagtcactgacaaataaagtggccttggtgcttaccagggcccggggagaggagacaccatggtaatgacctcagacaataaacagaccattgggattggactgtggcctccagtgtcttgctgactcctgtcttggaaccaaatgcagaagctactttgtcctgcagctgatgggaataagctgccagcagatattttggtgcctagattatgaaaggagagtcaatatgtaatccacgggtataaaggtcatcacatggtccgagtctaaggcgatggtgttatttgtgcttgattggcggaatcttatgctgactgcttcttcacttcaccatttagagagtggacatcacacattagtcaatggcacacatttgggtttgaagataggttcaattgtatctccgtgttttcatgacatcttagagatcgtccgtccttttcactcatgaggctttggggtggagatagtaaaggtggctgatgtccctggatgtgagtgtgctagttcagcatgggacctcaggcagaaccttccccacgtgagccccagtgaccttctctgccgagaccctgcctcttagaggtgtgaagctcaaaggagatcatgtttctgaatacattttgcaaaggtggcaagggctgaccgtaaaagccaggcagtcagaccttcctgcctgtgaagggccaagatgaagtctctcttttgcttcgcagatgagaaaattgactttgctcagtgggagggatgtctgaccatctgaatctggggagaatcattaagtgcccattatgtggctgtcactgtgttaggcagtttgacaagcataccctggagcctgggagggggagtggtggagtggagtgagcttaaggactggaacagaagcccttggtgcatgcctgggcgctgtcacctactgactatgtgaccttgaacaaggtgtgtctgtgtatgtgtgtgtgtgcatgtgcgcatatgtgtgtgtgcatgtgtgtgtgtgtgtgtgtttgagatggagtttcgctctgtcacccaggctgcagtgcaatggcgtgacctcagctcaccgcaacctctcctcctgggttcaagcgattctcctgcctcagcctcctgagtagctgggattacaggcatgtgccaccaagcccggctaattttgtatttttagtagagatggggtttctccatgttggtcaggctggtctcaaactgccgacctcaggtgatccacctgccttggcatcccaaagttctggaattataggcataagccactgtgcccggcctctgtgtgtgtgttttgtagcaacttctctgtgtcctgatagccacaggggctgctgtgaggactaagtgacgaggtgtatgtcaggtgcttggaatgtcagtccatcccacctcctgctctccccactaggctgccacctcctcctcctccattaccttttgataggtctgattaccttcattttacagatgactctgggtcactcttcatcttttgtagaaatacctctgtagcaaatgtcatggggacattctcatctttggtagcagggagctcactgcctcctaggtatgttgttccattttggaatagcttcatgtgaatcttagcatgtgccaaggtggatgtggagtctttgcatcagaatcctgaactgctcatcctgaaaaaatgatgcgatcagcctgcttcccacagcgtatgctcagggtgacttcttgtgacatggagatggttggcagtgagctttctcttgtgacttcacacagggacaagtctgtggcattttaaggactagtgagagttcaggatggaggtgaaggagattggcccagagagctacagagttgaggagaggaggggtggcacacaggaggacggaccatcaggggctcaggctggcggctgaggtgggagtggtgtcattatcttccgggtcccaggccttgttcctcctgaccctgaaaggcagtattgggtagaggcatccccttgttttgcagacctctattaaaacaaaggagaacaatcatgtaatgatctctctaattgctgaaatgacattcaatatgatccagtaggtgcttcatgatcacacatcgtcaactctgcgcagtgggaacttacttaatctgaagacagatagctactgaaatctctagcaaaccttattcctgatagatagacatgagatgcaatcccttcaggttaaaaagaagacaagaacgcccactatcacctctcttattcaaccttgcaccctaggtcagagccagcgcaataccacaagagaaaaccaatagagacataagtcttggaaaggaagagatgaaggcatcattattttctggtgcagccatcatctggctggaggaaatcgtagactccgaatgtataaattattagaagcaacagagttgagccaggtggccaaaggtcagatattaaaatgcatattaaatgcatttttgatagaccaacagcaaataattggaaaacacaatagaggaaaccaaggctccgtgtggggcggggttttgcattatccagtgaggcatccacgctgctgattctctttctaatgatatttgtacagcatgataaagcagtatcgtatacatccagcccactggggcaaggcagatacctttattttgacttttagggaggaagaaccagaggctcagaggttagagcacccttgcccaagctgactcagtgactaggaggctgagctggggcctggccccctggaccaaccctcattcctttttgctgctttctacccaccccaccttcttcagaccttactttctccaccatttgtcttgttctgccagcttttcgttgtctgcctctagtaccagctgagctgggtgggagggagagtctgggagtgttcggatttgggttagcatctactctgtagtgtctttcatgagccacagcctgaccttcccaggacgcttgctgcactggatgcggggcagggatgggttcttctgagggaggagagagccaggcggttgtttggcgtggcctgggtccctctctctttgcgttgtctcccctcccctccacactgctcctctgagtctgacttacatctttgcttttttgttttatttaatgtgtgttcaaaagttataaaaatagcatatgttcacagcaactggtggaatcataatatggagaaaaagaaagtctttcttatttactgtttgatggctctcggatgccatgcactcctctcctgcagctttcctggccaagtgcttagggcctagggtggacccttccacttatttccccaggcccgggtcaagataggcaaacaggttttccattcattcagcaaaaatttgctggatatttactgtgtgctaggtgctggggatgccacagggaacaagacagggaaaaacccttgccctcttggagctgacagtccaggggattaaaatattttacagtgggccgggtgcagtggctcatgcctgtaatcccagcactttgggaggccaaggtgggcggatcacttgaggtcatgaattcaagaccagcctggccaacatggtgaaaccctgtctctactaaaaatacaaaaattagccaggtgtggtggcacacacctgtaatccagctactggggaggctgaggcaggagaatcacttgaacctgggaggcggaggttgcagtgaaccgagatcgcgccactgcactccagcctgggtggcaaagtgagactcagtctcaataaaaatgaaaacaaaacaaaacaaaaatatcttacagagaagtgaatgcagccaatgataagtgctatggagaaaaataaaacaggataaagttcctccctgttttgtaattttaaaggagggatcagggtagaattcactgagaaggtcagttttgcacagagaccaaaaggaacttgggagaaagccatatggctttctggggaaggagcactgaggccaagggtaagtgcaaaggccctggggcaggatgtacctagaaatgtgtcctgtcaatgggacagagcagagcatgtgacaggaataaaggcaggaaatgaagtcacagaaggaggggaaggaattggaggagggcagattgggtagggccttgtgagccttgtatatggcttttcagttgtttaatgaaaatgggatcttattacattcttgtcccctgcctcttgcttttctttttaaatttcaatttattattatttattgatacataatattttacctatttatggggtatgtgtgatatttgttacatgtgtggaatgtataatgatcaagtcagggaatttggggtatccatcaccttgagtatttatcatttctatgtgttggggacatctgaaattctttctcttctagctactttgaaatatgcattagaaatatacaatacattgttgataactacgtttttcatcctgaacatctctcctgaggcaggagagatgagatctatatcttcctgtagatatagatctcattttaaaatataattacagaattttcacggtatagaggtaccataattttttcaatcattctcttttgatggactttcaggttgttgtcagggtatggtttctttctccactacatctcatatatgttgcctttcatgctggtgttgagagagcggaattcctaagtcaaaaggtgtatgtctatatagaatattaatagacactgttagatttcgctccagaaaggttgtcgccaatttctctgatataattctgttcctaagtctcagttgcctggctttgccctctagttgctaaatagctactctgcaaagaggggaagtcacacctataaaaagagatgtccctggaatccttcatcccgtgggaaggtgtgtggccttttggcatgtgctgctgggaacaatatcattcgctcttttttggagcttgtatttgatggctgtgacgtcaaaatagccaagaagatgaaaacacagctgttgctgtgttatttgcattatggctaattttccatatgtttaaaataagcacaacaccaaggaactgcatggaaacagattcacaccttgtcgaacattggattgtgctcccgtagcatcttaaggataatgcttccccatagcatcccttcttgtgcgcatgtaaatcctggtacaacctctgtgggtatgcgcttgattgccagttcccccaacccccaatctccggatgttatggagcaggatcgtgtaaactttggggtagacttttcatctgtttagtagccaaatgtatttgtgtgatttgtactgttggacatttaggccatgtcccatctgttgcacttcaaacaatgaataatcttgtgtatgagtctttttatgcatgtatgaggatttcttttggatagatttctagaagtggaattgctgaattgaaagggacttgccatttacaagttgatagatattatgaaattgatctctggagaggaaccagtgtccctgtccacagatagtacaagtgagtgccttttccctgcttcttcggcaattcgagatcttgccaccctttttgatttttgccagtctaatgggtgagacgtgatttattttgtatgagtaagggtgaacattacatgtttgggggccatttgttttatgtttgtgaattgtctttcatgtcctttgtcccccactttttttctagtggcttattagtctcttatgtggcccagcatggcctgtccacattaggagggcatttgatactgtgattggataaactaacctatctgggctgggggcagtggctcacgcctgtaatcccagcactttgggaggtcgaggcggatggatcacgaggtcaggagttcgagaccagcctggccaatatgggtcagaaacccagtctctactaaaaatataaaaattagccgggcatgatggcgcgcacctgtagtcccagctacttgggaggctgaggagaagaatcgcttgaacctgggaggcaaagattgcgccactgcactccagcctgggcaacagagtgagagtccatctcaaaaaacaaaacaaaacaaaaactagcctgtctggctagttagaggttgatccgcgcttctttattgtcaggagtgtaaatctattaataggtgtttgagaaaaggaagagcacctcagcaacaatctagatgggagctgcattttggtgtgtgctgtactgactgttccacaaacaggttgaacacagacgtcacagaactatggggccccgaagtccatgtgccggggtacatcttttatatggtctcatttttatcctattactgggtggaagaattatgaggaaacttgactgtttgctactaaaacctttttttttttttttttttttttttgagacagagtcttgctctgtaacccaggctggagtgcagtggcgtgatcttggctcactgcaacctccacttcccaggttcaagtgattctctggccgcagtctccccagtagctgggaatacaggcgcccaccaccatgcccggctaatttttggattttttagtagagatggggtttcactatattggccaggctagtctcgaactcctcacctcacgtgatctgcccgccttggcctcccaaagtgctgggattacgggcgtgagctactgcgcccgaccactaaaacctttttttccactcacttgaatttacaacctcattgtgagattttctaggcagctactccactgggacattttgctagtccaggtggcctagctgctgtagcaagcaaccctcaactccagccatgtaacacaatcaaagggtgtgtctgtggctctgccctttctaggtacccagaatcctcctctgggtcttcagctggcagaggagaaaaagagggagcaggatcgtgtgtgaaggctttatagagcagatactctgcccacattctgctggccagaacttgatcttccagtccatctaactggagggaggctgggaaaggccagccatacgccattgttatcagtcctgaccaggtgcttggtgaaccatggtctcttagtgccctgtgggacttgtaagtttttgaagtgtcttctcaagtgtgatctcactccatcctcatagcactgacaaccctatgaggaagtaagatgagtgcttctaactcccagttcagaaccgtggagactgaggtctagggagataagtgtcgtgggcaagggtaggcacttaggtagggacacaaatggtagggagacggggtttgaacaaagagctctcatgctgactggccccatccgacaggacacaagagcacccactctgggtgtgcctgggtcaccctctgcatgtagtgggcatgggagaaaagggctgcttagcgaggggaaattggtggctggctggagtgcttcttctatcctagagtgtggcaagaaaggaagttgtctcttgccttttgcaaattgcaaccgaatggtgaggggtgacagtattgctactggtaggaaagcttggatggcagggacagaacggctgtaaacctggcacctctgggggagctgccccctcaccttgactttgaccattgtccctttcttttcactttcatgggacactagcgttgaaaaattggggcctttttcttcacactcccatttctctttatttaattattttaaaacatctgatgctgcagtgagatcagctgtgatacatcatctgttctattttgagctgcagggagacaaatggagaatactgctacctcccctcctggcgaggactgtgctcccaggagcccaatggatggaccgagccaaggcagctctgggcacaatttggatgctttcccctccaggggaatgcctgggtttccttattgtgcagatgccttgaactaacctggtcaaaaactagagagacaaaatcacagatggttgcacaggttgttggagtagcaaagacagcaccaagcagcagaaagaagatgaggcattgagtcctacgctcagggctgagcaccgtcactcctaattgaatggccactgaactttgtttcctcatctatgccaaagaaataacatttttcctaccactttcactgggttcttatgaggatcacacaagataatgtgtataaaaatgctttgtaaatggaaaagcactctgcaatttaagacattattatattaatagtaacaattaccatttccaattctggtgattcacttggggtaggagcccatagatctcatcactgctaccattactaccccacattgtacttcaaagctgcaattaccttgcacaatttcatttgatacattactgattatgcagtgttagaactggaaagcatcttgaggattaactaatccaaatgtatcgctttatagatggtgacctggcgcctggaagggagagacttatttgaggtccctagaactcaggactgtgggctgtcattcctagggagtaggctgttttactttggattatggttccctgtcctttctgaagggctagacatgggaactttgggtgggacgttgatccttagtcattaggtggagtctcagcctgactcatgtctgcttactcacgtcaaccctgctctgagctccactgctcaaggttctgggcgcatgtggacagtgcttagaggagaagctcacatgctgagaagcttgggcacagggtcaaagagaggagaaagtaggaactaaagtggtttgctggcaagaaaaagagaccagggcaattccagaacaaagaaggtggaggtgctcctggtctcaaccttggtctttattggaccccactgcctttgtgcgctctctcttactgtccactccaggggctcaggctgccggggcacactcagtgggcacagctgcaggactgtgaggcctcctctaaagagaagactgagggtcctccagcattattgtaagtgttcaaagcgtggtcagaattcatctggatagaagaacaagcacaaacgggtaaacatcctggcaagactgagtttggcctcatgtcattcacagtgccactggttggcccctttcctgcctctgggtcttgcccaaatgtcatcttgcccacatgtcacttctctatttaaggatgccaactgcacctcacctcttatttggaccatctttcccaactggatttgccatcaaaatattatacagaaaatttgcaaattagtacagagaattcctgtctacctgttagccagtttcccgtaattgttcacatcttacatcactatagaaaagaacaagtttcatgttggtctaaaactgcatgtcaaactttaagccttcctcaaatatcatcacttttcccactgatgctgtttttcttttccaggatccagtccagggtcccacattgcatgtacccaccatgtctccttagtgtgcttttgtgactcgtctttccttacctttcatgactttgacattggtgaagagtgctggttagttattttcataggcggtctgtatattttggtgtgtctgatgttttctaatggttaaagcatatgggtttttttttgttttatttatttattgctattgattgggtctctcctgccactggaatatctgctccctccgagcaaggattctcattggtctcgttcacttgtgtgcaggaacatctgtgtgtgcctcgcacccatgctcagtcaatatttgctgggcgaacgaatgagactgaactcccaggcattagtggagcatctgacctgacctgagagaaacgtggagaagctgggtcctggcagagccttgatgggcagttgggctggatgggcactaaagcctctttcagcattcaggttctgtgattttgtaacctgatggtggtatctgaactcaagctaattaaattccacaggtgtttgctgaggaagtacttgctgtggcatcctgggctgggcaaggtgggggattgatgggcatgtgcgatccaggctctgaaatgcaaccacattcccagggaagccaggagcacagggattgcatgtaaaacacaggtgtccagttagtggtttagaatctagactttggattagtggctcccaaaccacagcctgctttagaatcactaggaggacattattaaaacaccaattgctgggtcccaccctcagagtttctaagttgcttggcctgggtggggcctgagaacttccaacagcagttccagcaacttcccaggtggtgcttattgatgatgctggtctcgcaaccctatgttgagaagtattactctagatgttaagagaacacacaatttactgctaattagcaagagccaggagggcttcctggaggaggtggtcaggcttgagtagggtaggattttcagaggtgggtctgaggcttgaatctatacacagctggcttgctgccaccacatgcgatctgtggtgccttttgcctgcctttgccctgctggcacctggcctcactcgtggccttgtccaatcctcttggtacatgagtgatcttggccaggggagtctgagcccccagaggaggaggctgactaagccttagaatggagttgaccttggctggctgagatgaagtccctctgaggcctggacgtggcctgcgctgcacagcctgccttaatgtgtttatctgcctgggccttgctcgctgtctgctggcaccatatgaggtgttgctgttgagctccgtggctctatttctgttttctcgcctggcaccagcacagcagggcagatgaggtgtgtggccacccttggtttcttcctggctccaggttcttcttgaggtgggcatttggtcaggaagaacatttgagtctcgctagagtgtctggtacagaagcagctggacctttttcaggagggagaggttctgggaaggagggagaaaacctttagaaatttaaataaatttagacttagcatctggcggtggtagtgagaggtgacagcgtgctggcagtcctcacagccctcgctcgctctgggcgcctcttctgcctgggctcccactttggcggcacttgaggagcccttcagaccgctgctgcactgtgggagcccctttctggggtggccaaggccggagccggctccctcagcttgcggggaggtgtggagggagaggcgcgggcgggaacaggggctgccagcggtgcttgcgggccagcgcgagttccgggtgggtgtgggctcagcgggcttagcacttgggccagcagctgctgtgctcaatttctcaccgggccttagctgccttcccgcagggcagggctcaggacctgcagcccgccatgcctgagcctccctgcccctccgtgggctcctgtgctgcccgagcctccccgaggagcgccgccccctgctccacggcgcccagtcccatcgaccacccaagggctgaggagtgcgggcgcacggcgcgggactggcaggcagctccacctgcggccccggtgcgggatccactgggtgaagccagctgggctcctgagtctggtggggacttggaaaacctttatgtctagctaagagattgtaaatacaccagtcggcactctgtatctagctcaaggtttgtaaacacaccaatcagcaccctgtgtctagctcagggtttgtgaatgcaccagtggacactctgtatctagctactctggtggggacttagagaacctttgtgtctagctcagggattgtgaacgcaccaatcagcaccctgtcaaaagagaccacttggctctctgtaaaatggaccaatcagcaagatgtgggtggggccagataagagaatgaaagcaggctgccgcagccagcagtggcaacccgggtccccttccacactgtggaagctttgttctttccctctttgcgataaatcctgctgctgctcactctttgggcccacgctgcctttatgagctgtaacaccgcgaaggtctgcagcttcactcctgcctgagccagcgagaccatgaacccaccagaaggaagaaactccgaacacatccgaacatcagaaggaacaaactccagacgcgccaccttaagagctgtaacactcaccgcgagggtctgcggcttcattcttgaagtcagaccaagaacccaccaattccggacacagtaggatgtacacacactttgtgcgtgtgtgtgtgtgtgttcagccttccaggatcatttaggaatttttattccttaattgacattcaaaacttgatggtagaggtgaggagaggcccagggagcttgggagaggccacgttgtttgtgcagttggaagactctgggcaggaaaggagcaccacatccaagtcagagaacacgggaacaagaagggccgtccatgtgcttctgattcagccccatcgttttaactgagacctagaaaactaagtacttgtcctactccagtgctgcctccccagtcatccatggccagactaaattactctatctttcctttgggctgcaaagtcgttttatttataacacacctctcttgttttataagtagccatgaaggggtttgttttacccactagattagggattggtacattacaggtcgaatccggcccactgcatgttttgtaaataaagttttattggaacacagatatgctcatttgttcgtgtattgtgcatggccacttttgtgctatgtcagaggtgagcatttgctacagagactaactggcctgcacagtctgaagtattcactatccggttcttcacagaaaatgtttgccagctcctcccctgggaggtgagctccctgagggcaggaacggcactccgtttatcttgctgcttcttgtttcttgctggtagtaggcactcaataaatgtatgttgaataggcttgaaatgcagtggattgatttgtcaaagatgagcgccagccacatggctgttctggcttccccaggtttcctcttgctgtttggccactttgtgctccagttttctctctacagaaagaagataatattatctatcttgctgagttcgttgatctgtggtgagggtagaacaggatattaaaatatcttactagaaccttgggcccagcttccggtcttcctgatggtttcaatccaggcctagcacgggacctctgtctaaaattctctgctctcatggccctgccattcctgaggcaccctttgcctccaggctaaagtaaacacctgtcattcatgatcctccttactttgatatgataaaatatcagggcccagactgcagtcccacggccctggactccagacctacctgtctgtcttgatctctcaatcctctagggcagccttctcctacatccagaattttctgcattctgtcccctacatgaatattgcacttgttcttgggaccctatccccctctccctcctaacttcctaccttgcccctttctgcctttctgctctcagcctcctgtctgcccttgcaggtctcttttatgtctgaccttgctggagtcctttgacctcggccaacaggagtgactgtctcatttgccacttaggcactgtcttaggttttaaatttttaatctttgtggctgcttgttaaaaatacagggacccaggcttcattcccatggaattagaatctccaaagatgtgatccaggcccctttgacttttaataagctcctaatgtggttgtgattatgatcaaagtttgaggaagactaacttaaaatagagtgctttgcagtattatttctctttctgtgggactctgcttatgtctccaaataaactataaacatcttgaaggcagatctgggccttattttcttttcagagtggcacatatatctgaagactggggccgtgagatgatctgtcggtgagataactccacctggggccctgcatctgataggcgctcagtaagtgtttgcttgttgatcaataaaagacatgaaagcacctgggaaagcaaaacagcctctgcaaagcagggcattattactgggagcagatctgatgtgtaccttccacagattccactgaaggtgtcctcagagcaccggacactcaggggcccgcagcccagacacagaaagtccactctgctgagaaatgctcaccaagcagaatccctcacactctctagctttgttttctttgatctctctgagcttaggaggaaaggctcctgttccctccctcttggcttatcccaataatgcaaagccatagaagtgcaggctgctggggaaaagtttgtttggacacttaagaatgtagaaaagggtttagcttgtataaagagttttgctttctcattataatgcttggagagaagtgcaaatgtttcatctccgcctactgagttatactgcctgtttacataagcctatattcagtggcctgagaaaaggcttcttgccttcttcagggcgtgatggtgcaatcttggtgtagagtttccaagcagagatgatgctacggcctcacgtggtgggaaggctgtgtggcaggaagaataagttcaaactgtgctttgtttagaactgttgtgcaaagttgtttcttccatccaagtattaactgggccagaccctgcttagctgccaagatcagacaagatcaggtgtgtccagggtggtatggccgcagataccaagctatttctaacacaaggatgctctccttttattgagcagggagaagacagcacgtacagaccaaccatcctggttgtaaacttgtgtcctagtcagagctctttctagctggagtagaaaattcttaggctgtatgtaatggaaagagagtggagtccagcaataaaaacagatcaggtaaaaatagagctaggagtcaatagtgagggctgagttaggagagttctctgtacttccctagagatttccagccatctaagcatacgtgtgagttcttgctttgacaaataagtactccactggtatgcacatagaaacttctttcacctgtgggatcattattaacatgttttatgtggagggaaaaataaagattttagaacttctttcttccctcatgttttcactccattaatattaggcttaattattcaaatttattatattagagtcttattgcttaatttaaaaaattgaatggattattagctttttaataaacagtgacatttactgtctactaatgagggctcaaatcatgtaatttattgctgcatctctattttgttcatgaaatgaaacagaaattactacctacttgaaactggacttgttttctgcgctcctatgaaactgaacagtggagggttgctcgtgaaggatctgggacatgtttcatatggagcacaagaaaaggacgtcgaacatgcaacggtctgcatccaggtgctagaaccattttgtttttcccttcatcatccctagaaccaagagtgtgggtgggaatagctcagtagagtgaccatgtgatcctgtgttacaactgaagacaaaatctggcacagagtctctccagtgatgactatgaaactgactggtgccccatcagattcagaagtggagagtgttacatactgatttcagaaaaatgttagataaacattgggaccctttattatataccgggaacagaaaatgcatgttgataaaagtttgggatgttccatttcactctgatataaagtgtgcgtggtcagattggtttctatttttgataaaaatgaggttctggaaagccattctggctcatgggcttatgagaaaaaggttttggaaaggagttttggagtgctcccctacagaaatagcactgctttttaattgttctgtcgctagagccttggccccaaataacaatgcatgaatctcagtatttgtcttcaaggagctgtggtctgataggagcatatagtatacctatatggatgggtataactgaaggtggtgaggacctgtttttagatgcctgagaaatccaaaaacaagacagggaagttgttcgtctgggaatcatgaagcatgtaaacctaattaggggaggtggcatctgatctcatccttgcagaatacataatttttatacaaacaatgttgaagaggtgatgagaacagaaaagctgggtaaagtgcagagcatgttcaaggaagggttacaaacatttcttgagggcctgccatgtgcacagggcaccaatctagtgaaagcaatctgataagagcttggtacaaaaccaagtaatatagcttgtgcattaccttcactcctcttactccagtaatttttgagtaaaataaatgttgtctttaattatattaattcatacaactgcgacaacggcctggtgaaatcagtaccatgcttgtcctcatatgagagaagaggaaacagacattttaagttaagcgacttgcttcaggtcacccggctagtgcgttgtggggctgagactcaccccagccagtctgactgtgcaggagttgcagccatttgttcctctgttcacctcccccgatagtctgagtggcctgagagcaggcatgtgttttcgtcctcttggtactcctgtcatccagcaaactgcccagcatgtggtcagagttcagtatgccaagtacaaaagatctgctatggagattcttaagtgatcaatgggttttgagggacagcttggagaagggtagggaggttgttctggggtcagagaagaacgtgagcaaagggctagagtggctgagaggactgtgcagggagtgcatgctccagtgtcccttggccaggtgtgtgggcttcccatagggagctggaggtgatgctggaacagcgtgctgtggaagccttaagtgcagccgagtgctgggttctctgtgagacttcttagggtctggaagactgggtcagacctcagcctcctaggtgatgtcagacagccaggccttctcccagctcactcttgagtgtctctgtcagagacagagtcagagactgaatggcgtatgggctggatttcagggagcatgttcttctttaaaaacatttatggaacaaggccaggcgtggtggcttatgcctgtaatcccagcactttgggaggctgaggcaggcagatcatgaagtcaagagatcgagaccaccctggctaacatggtgaaaccctccctgtctctactaaaaatacaaaaattagctgggcgtggtggcatgcacctgtagtcccagctactctggaggctgaggcaggagaattgcttgaacctgggaggcaggggttgcagtgagccgagattgcgccagtgcactccagcctggcaacagagcgagacttagtctcaaaacaaaaacaaaaacatttatggaacaacttaaatgtaccacattctgtggctataaagacaaataagggcttcccacaagtcttacgtatatgttggattgttggtgcttgttgctaggggaggacgagtgggtagtgaataccaaggccccgtctaaggtggttgggtggttataaagcactgtggactgacggtgtttctctgaccctaaggagctgactggcagggtacccaagtcctgctcactgcgtttttgtaactgagctaagaactgaagaaatcaacaaattgccaccaaatcagatccttagtaatgcgtgataaagcatgacatatgaaagaggacacagaatttaatcatcttaccccataaatccagccccctgcaatctgtctcttgtgtgaataagacttcaatttacagaaatggaaagttccttttttatctacatatggttatacctcctttcctacctggaaggcatttccttgtatttccttcctgagtagtgatcaggacttggggttgggcaccaaagcctttaggaagtggagttgggtgtgttggcctctcctgttgagtcaggactgaggctaggcctgaaaggtaggtgacaaggttgaagccccaaaccactaagaatcaacacccacttcctcttcatctgctctgccccaggccagggaggcaaccctgagacccaggagtaagctcaatcctgctttacttgcctggaaagtcaagtcactcatcagaggaggaagagtcagtttccctcaaggatgggctcttggtcatgaagctgactgctgttgtattactcagatttcagatcttagaaaattatagcagcatgggctttgaaggccaaatacatgatcatcacctccttttgagatgagactctcctggtatgacatccagtactcagagatgccatatgccttctggacttgtgtccctatgtgagaaatattcaaccatgctctatcaagtctctatttgtcaggacctggattccagcagccatttgtgcccccgtccatctttctgtgaaactgggccagtgatgcattgacctcatttctgatgggcttcatagtgggactagttgtggtcagacctgcataagactgaccaggaagaagcccaacctgggagtccaaggagcagaagcaaggttcaggaccagggaagagcaggcagagctacaagggccaggctctgagcagtaagagattggcaagagcagccctgctgatgagcctgtcacagaggtaccatgataatcctggaccagtgagttatctttgtagcacaaagaaggttggaggcacagattgctgtggactgaagtaggaggggagggagatgctctcgtaatctcatgttgcctgagtcagctttgccttgctattggcggatggggctggtggcctgtcatgtgtgcagatgagtcagaggaagtgggccctccctggctggtggcttgccccatgccttggggcatagctaagcagttgcatgtctactaaacagtcttatctggaagcaaatatggaaccaaacacctgagcgtctgccaaggcctccaccaccaaggtcaagaagtcccccgaggggcatggctctgtgagctgcccttgtaggtgtcctggagaagcaggcacttccttgcagttggtcaagaagaggcaatacttcttgcttgtgttagggattttagagcagcggatttagggcatggcaaggttggggctacttccgggggaatgaacattttttaaaaattttactttaagttctgggatacaggtgcagaacatgcaggtttgttacataggtatacacgtgccatggtggtttgctgcacccatcaacccgtcatctaggttttaagccccgcttgcattaggtagggaatgagcatttcttcaggtccctaagcagagcttgaaaatgatgatatcaactttaatcactagcaattattaagctcctcttccacatatattaagttgtttatgcctcataataaccctgatgcaggcatcattatttctgttttacagaggaagaaacaaagatatgaagaggttaaataacttgccaaggccaatcagctagcgagcatcagagctaggattcaagcccaggcagaccagctccagagcctgagctagactcaatgtcagtgatgatgtcgttgaccttcggggacagattctgcttttgccctggtgggtctgggttgagatgcattgcatttgatcttgctggagaaatttccagtcttctcagccctgggaaaatatgtatattggaacctcagagctacaccctgagggtatgtctcctggtttgctgaatttttaaaaagaggttttactctatggccagctttcttgccaggagatcagagaccgatgacagctggcagaatcggcctctgttccagctgtctcctacccttcctaaaactcagatgctctttgaagctgtcttcctccattgaggagcatgtgcttcttcagtgacagccggagagtgggactgggctggcccctgtccttctaaggccaccacctgcagcactcctagtcaccgttccaaggtcactgtggaggaaacagaagtggccgagagaggaaaggtgcttctcaaggaggctgagagtggagggagtaaggcaactgagcacggcagttgggtgggcccaggccaccaactgtttgtcctgcctgagttaagagtccagaattggggctgggtgtggtggctcacgcctgtaatcccagcactttgggaggctgaggtgggtggatcactaggtcaggagatcgagaccatcctggctaacacggtgaaaccccatctctactaaaaatacaaaaaattaaacaggcgtggtggcgggcacctgtagtcccagctactgaggctgaggcaggagaatgccgtgaacccgggaggcagaggttacagtgagccgagatcacgccactgcactctgcctgggtgacagagcgagactctgtctcaaaaaaaaaaaagtgttgagaattgggtatcaaacagagcctggtgtctgtcctggctttggcttttagcagcctggaatcaaatagccacttacatgaaatttctaacactgtcatggatggcaggcaggtgctggagtcctactgcctgcattacccctgatgtcaccaccagtgagccgtgagacctgagtgagattggctatgtaacttgcagggtcctgtgcagaatgcgaatgtagggttcctataaaatgtatgaagaattttatgatggtgatagcagagcattaagccaagcatggattcttcccaggtgtggggacctgtatgatggcacaggttgtactctaagcctcagtttcctcatctgcaaagtggagaaaatagtatatttcccataggcttgttgtgaagtttaggaaagataataatgcatataaagtattgggccacatggtaagggcttgatggacaccagcatttatgagtgcagggtcagaaattcacagcttctttttgggtcattggcaaaagatcacggagagcaaaggtacctgcaacagtggtttagcttcaggaacaggtctggactttggtctctgcccttggctgctatggcttgggactctgacctcttttgcaaagcacagatggctcttctgcaggagcaagaggcccctcatcacatgcacaggccacatggatccagagacacctacctcctagaagtgtgtgtgggatcctggggcaggctgaccctgccctgcatttcccaagtcatgggccaggaggaaggcagtagagattggagctgtttttgatgcgttcattttttatttgctgaaatatgttgaaagtcagttaccaatatcacaggatttcatccctagagattttagtttgcatttctgaaaataaagacatttctttttttttttttttttgagatggagtctccctctgttgtccaggctggagtgcagtggcgccatctcggctcactgcaagctccacctcctgggttcacaccattcttctgcctcagcctcccaagtagctgggactacaggcgcccgccaccacgcccggctaattttttgtatttttagtggagacggggtttcactatgttagccaagatggtctcgatctccagacctcgtgatctgcccgcctcggcctcccaaagtgctgggattacaggcatgagccacggtgctcggccagacatttcttatatatatactataatcttattgtagacattgaaggtttttgtttgttttctggatttattaaggatagcattttatggaaagttagctggatatgtgtggggagggaaagtgattagtattaatctggtttgctaggacgagaggctgttatccaaattcaaatttggcattcaattcaattgctgttcatggaagaaacatccggggacacctgcctcactgccccaatgggtcagatggaaatcactttctaggggagcttctgtgactcatttcctttgctgggatcccttctgtcttccacctaaaccatcacaagggcctcctgagggtctcccagcctctggaataacaccttcactggtccgttctttactggccaccagagaggcctcttgaagacgtaacccagatcttgtctttctttttcttaaaacctcccaaaacttccccattgcccacagcaggagtctaccggccacttctttttgtatagtccatgagctaaggatgggttctatctctttaaatggttgaaaaaaacaatagacacattatattttcgacatatgaacatgataagatattcagattcaaatatctataaataaagttttattgggaaagagccatctgcattcactgatgtatcttttatggctgctttcaagcttaccgtggcagagttgagtaattgtgacagattgacagcttgttacagagaagtttgcccacacctgagctgtaggataaaattcaggcttcttcgcacacacctgtggccatttgtcactgacacccctgcctccctgatccctcctgctttgataaccttccatgctcttagcaactcccagctgccggcagatgccctgcatgggccatttccacctctgtgctttgccccttctcttctctccatccttgctgcttccttggctagacatcactgactcatccttgaagaaatccccttctccaagaaggcttcctgacctcccctctttccctttcatcctgtttggtttagtggctccctccctgtttggacaggaaaaacagaagcccaacgactccgggaggttggcagctgggcgctcagcacagagaaaggaggcctggggccaaaatggctcactgagtcagcagacccagtgcctggtatatgccaggtgctctagatgtgaagagcacagatgcaggccctgcctctgtggggctcacatcccagtgggagatacagacagttaatgcacattttaacaaatatataggggatgagagtccatgtcttgggagtgccctggccagtggctaggaagtggtggcaggtggattttctagataaggaacccaggaaggcctctgaggaggtgacatctgagtcccgagagaggcagagcccttggcggctggatactctggagcgagagggaagatgagatctctttctttgtcctcttcaggctccaggaggtggtgagaggttgtcacttctcttcttccaggctcacagcaccagcagcctaagagtttacaccagactttcaagtcagagtcctcctccctcgttgggggctgcaggcttccctcagacccttctctagagggcatttgatccctaccacaggacttaactggaagcccctttttgagatctgtgagatgtctgggattttccggccaagaaggacttcagagataggcctgtcttcatctcaagaagcaaagctgaaacccagagcagttgagtcccttggccaccgggctgatcagcggcacagccgggaccagagttctggttttctgacccttagagcatgagatcactcatcttcttctgatttaattgggggatctcaggacagatcagccactagaattgggaggaggccattaaaggaaccccttgggtccacacaccactcaggagaaaggcccactggtgaggccaaactacttctttgaagaggcttctcttagtatcaccagtggtgtgttgctggaggtgtccagaggcactgtccgaagctgctggcctctaatcccaccagtttaatttagctccagtcctaggggagctttgctaattatagctagctggccatgctgggagctataaatagggcaggaggcacctgtttggtccttactggatgtttatcaaggtacctgcagaggatttggccactggactgggtgcaatgtgggcacagaaagcaccttgaactgtgctctttattcagtttaggcaccaaagccaatgtgaactgtggagggggcagggggatgtcaccagcacaacctggaaaccagactgtcagagttcaaattctggcttcaccaccaactagctgggagaccctagttacccaagctctttgtcctttagttttcccatctgcacaatggaaatctagatatttacaaagaaggctgttgtgaggatggaatgagtgtatgtttttatctatacataagttacgtatgtgtgtatatatgtgtatacacatgtagtttagagttgcctggtgtattaagtgcaattatattgcttgatgttatttattaccatatgaaatggcctgaggacgggaccatcttgcatagaaacctggatcttggaaggaggctgagtctcggtctctcccggtccttgatgaggcaagttaagtgcctcatctttaggcagttaaggcaagttaactgcttcaactacatggcagttaagagagtgtgagccgggcgtggtggctcacgcctgcaatcccagcactttgggaggccgaggcgagtggatcacaaggtcaggagttcaagaccagcctggccaagatggtgaaacccccgtctctactaaaaatacaaaaaaattagccgggcatggtggtgggcgcctgtaatcccagccactcgggaggctgaggcagagaattgcttgaacccgggaggcagaggttgcagtgagccgaggaaagaaaaaaaaagagagtgtgtaggctcgtcaacatggggtcagttactgctgttacctcctgtttggcatgctacttcacatctgtaattctccattcttctccattctttcctgttaaactgtggtgccatagcaatgagcatttcatgggatttcagtgagaattgaatgaaataatacttgcagagcatttcacacagtgcctaacacatggtgcatgggaaacagtgtaagccattgtcgtccttcctcctcccgttaaatgacttggacaggttaccagcatctcgaggcttgatatcctgtagctctctaggctagagaatgggaccagtggcttagagggcagaaggctagcagtcctgagacccctggcctgcagatgggaactggatcttcttcctttgcagtcttcttgttccagctgttagcgtcactccttttagaatcccatggtgagctttcttgcacggctgtgtgcttcctgtgtttctgtcattgtgccccagctgggtcccaagccctgaggaccatatgcagcatgtggtggacacttaggaagcacgtctccagtggaggggacttaaatgtcacgtagtactgccccatcaagtgctgggagaggccgagagtccgcctgcttccaagatccctgaggttttgtttgttgtgacatagcaagaggagttaaaggatgggggattgtttcgtagggagaaagagaggctaagaggtagaggtggggacaggatacctgggtgcctttctgggagaggaagtctttttctttgtcctgtggctcagagcaagtctctcagagtggaggtttcaaggaggcagatctctgttagggaagggcgagttgcctggccctagacctgcttgaagtgggaagaatgtagatttggcagtcaggcctgctagtctagggccttgttcctcagacggtggttagaggatcagcagcacaggttccacccaaacctcctgggcatgaatctagatgcgtccggatgtgcacacagaagactgaggagtgctattctagaacagagcttctcaagccaggagccattctccccaatccatggctgagaagcctaaggctagaaacatgggccttgagcactggatctcaaagctctagtttcctctctggaccagtagcatcagcctcacctgggagcttgttggaaatggaaattcagaggcccaacccccaagtcagggactcccctctgggggtggggcccagggctctattttaactggccttccagtggctctgaggcaccagtgagatcgataaccaagagccagagcacctgcacgttggaaactcctggggagataaagcaaatgcttggaacaaatccgaatagcctctgggtatggcagggactctgggaacttcagatgctccccgggtgatcctaatgtgcagccaatattgcgaaccagcattttaggcctgtgaactaaatctcagcgttctcagctatcagttgggtagactaacctctgtttgcctgccagtgatgggaaggtgccttggggagcattaagacttagctccctgggttctggaaggcacaccagaaagtgggcttccatctgtccagaaaggtgcagccaagattcccgttttggaggaggcaggattggatgcccgccatggcctcaggtggaattgcaatgtggtggctgtttggtccaagtactaagtgctgtaaagacgataacctgctctggaaaaggaaatcgctagtgccttgagagaacagttcatgcattctcctcctcttgtgcttcccagcctctgccaccactgcttaattctggggcttacctttagtgaggtcatttgccctgtattcagggagctgatgctgtcagcactgtcctagcattggaacggtggggctgttggggagctggccggctcgttctgggcactggtggaggcaagaatgaggtttagagaaatatttacccaaagtaatccctttgctatgccactgcccatctcccaggaggctgggcaacaaacacagggttctggtcatcatttattgaggggacaagctttgcctcccaagggctaggaggaggcaggaacaaagggtggtggtacgatctgtggtcccagcccctgcagtggtcaggccctggggcctcctgaaagccatcagctcccactccaagcaggctgcatgtgcaaaatgaatactggattcaaaagcatcatgaagcaccagacatggaaagcattcatagtcttgtcttagaggcaaaattatatggcacttacagtgtgttgggtgcaccattcaaagtatgacctcatgtgatcctcacgaccattctatgagctaggagtcgtcatttctccaattttatgtgagcagttgctcttcagaggtctgtgatggtcagcctctgcatttcagaaataaggaactaaaggctcagagattagataaatgccctagtggtcataatgagtgagtggcagagaccttagaagtcaggtcccagtggctaaagtacatcctgaaaaagagagaatttaacgagacttctttttgattttcagtctgggatgattttaatacagaatgcctggattcagtaacaccagaaaaaacaatccacaggatgtttgtgttaaaaagattcagaggcagtcatctagcacagtaaatcctaaattttttagaccacatcccacagttaaagcacacattgtgtgtgcaaagcatacattgtgtatatacatgtgtattatatctatgtgttatatatacatgtggatacattctgctagattttatatatatatatatatacacacgcatagatattaatatatatatcttatagaaagaaaagttcctgaaacaatggctgtccttaccacatgagatgcagcttgacataatcttttcattataaagaatgttacaaaggataggtctgggtacagtggctcatgcctgtaatcccagcacttttggaggccaagatgggtggatcgcttcaggccaggagttcgagaccagcctggccaacatggtgaaaccctgtctctactaaaaatacaaaaattagcctggcattggcacacgcatgtagtcctaactactcgggaggctgacgtgggagaatcacttgagcctgggaggcggaagttgcagtgagctgagattgtgtcactgcactccagcctgggtgacagagtgagaccctgtctcagaaaaaaaaaaaaaaaaagagtattataaaggatataaatgaacaggcaggtggacaggtatacagggtgagtctggaagggtcctgagtacagaagcttctgtccctgttgagcgaggtacagacctattctattctattctattctattctattctattctattctattctattctattctattctattctattctattctattctattccattccattccattccattccattccattccattttcttaaaaaataattgcttataacctgttacatagatttcctggtcaaccagggggttgaggcctgccatctgaaattgctgttgtagtccagctctcctgctgtagaggaggatgctgaggttttgcctcatattatgcttctcttagtcacaaatctgaggccaaatgcaactgtactgagggccacccctgcccagcctgcccctgctgttacacctgaggctttgttaagagtcttcctgggtcatgtctgacctatcctgtggttttatgcctacacatccccaccgcccatgcacacactacacatcatggctcccggggaggcccactgggctctctctggccatcaactgtttcatgctcctctcctcttctgatcactgttcttttctgccccttctgagaatcagagtgaagattttgagacttagtgggaaggacttttaagctgatggatttaaatataagatattttgagagatgacttatgtatccagttctacaccagctcattcccaacctgaagtcccccaaactctgaaaagtgagtgtttttacctaattcatggaggggctggtggtgagtggaagctgccctgaactgcgaggcagtttatggtcttcattcatccagcttagtctgaattgtcgtgtgtcattgaagaaatgttagtgtgtgtgactgtgatgtgcagcccaaacctcagagattcaccttaataatttcctaaaacccgaaacaattggaattctaaaacacatctggttttgaagattttgagtgaggaatcatagagctggagatatatttgcagtgtgtgcatgttattgatttttttttttttttgagacaagatctcactctgttgcccaggctggagcacagtggcatgatcatggctcactgcagccttgacctctcgagctcaagcgattatcctgcctcagcctcctgagtagctgggactataggcacatgccaccatgcccagctaatttatatatatatatatatatatatatatatatatatggattttttttttttttggagcgacagagttttgccatgttgcccaggctgcctcgaacttctgggctcaagtgatccagacatatcagcctcccaaacgtattattgattaatcaatgaatttttttttgataagaagtagtgacagatgtgagaaagtacagtagactggttatcagaaggttggccattactggttataaaatgcacttttgagggcttttgtgaggacgaactgagtgatggctatgaagccttctggaaactacctggataagttgttgtgtgtggtctggtttctttttaaaattctgaattgtagtttctaatcctacactcattttcaacttttggcccacatcatgtgtgtatagggtaaaatatacctcttatgttgacatcctgtgacgaagaatgacccagaaagatacggagacagagagaaatgtctctacagtctttgtagattctttccccatccactctgctctgttctaatatttcccactttgttctaccttcttacagcatttcagatgctcctcaattggaactgctgactacacaggcgtgtgcgttttttcctcccttccattagccttataggtcattaaaaccttgttgctgctgctttccttttcctataaatacatctacatttcaaagttttgaaagcttattccttagaaggccctgggaactctgggctccaaagaccaaagaaaggtgtatctagctttaaattaggtacgggaaaaagcacagatctaggctctaagaaagacttcgctgtgtttacaataaatcagattgagggcgtgtcaggctttaagccaggattgaaagcatggcctttagaatacccagggagccagacctgggacccttgccaggtggggagttggaaatgagatttctgtctgaagctttcccctacaggagaaatatatccctaggggacagacaggtggtccagcagacatctgcaggggggcaaagggagaagacaggggcccttatctgttttggctttggcttgccaaaggatggaacaatgtttgctgtgagaatttgtaatcataagtctgccttcatgcaagtttggggtttgaatttgtactgcctgggtgacccaggagactccacgctgcaaaattaactggaggtagtttggggttggtcacaccagagttcctgtcagaatcaaatgcacattctctctggagggacatacttgtagctcaagccttgatggattcctgtaggtaaaacccagccattcaagcatgagctttcactctcaaaatccaaaacagatgaggaaaccagtcaccacgagtgaaagtcagcagaaacaacagacagaagaatcagattcccgagggtttcagatatagttccaatggaataggtaatgtattttaaatgtttgaaacaaatgaggaagaaacaatagactaatttttaaaatccgtggagatttgaagaatacaaataggacttccagaaataaaaaatagaataactgaaactgaagatcttcagcaattggcacacatttgtgtaagttatttttatgagcaacattaagatagcaattctcataaagatatatcaaagaaagtatttttttttttttgagacagagtctggctctgttgcccaggttctagtgcagtggcgcaatcctgtctcactgcagcctccacctcccaggctcgagtgatcctcctgcctcagcttccagagtagctggtaccataggcatgtgccaccacacctggctaatttttttttttcccattcaaaagtaatttcttttttttattattattatactttaagttttagggtacatgtgcacaatgttcaggttagttacatatgtatacatgtgccatgctggtgcgctgcacccactaactcgtcatctagcattaggtatatctcccaatgctatccctcccccctccccctaccccacaacagtccccagagtgtgatgttccccttcctgtgtccatgtgttctcattgttcaattcccacctgtgagtgagaatatgcggtgtttggttttttgttcttgagatagtttactgagaatgatgatttccaatttcatccatgtccctacaaaggacatgaactcatgattttttatggctgcgtagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaactagtttacagtcccaccaacagtgtaaaagtgttcctatttctccacatcctctccagcacctgttgtttcctgactttttaatgattgccattcgaactggtgtgagatggtatctcattgtggttttgatttgcatttctctgatggccagtgatggtgagcattttttcgtgtgttttttggctgcataaatgtcttcttttgagaagtgtctgttcatgtcctttgcccactttttgatggggttgtttgtttttttcttgtaaatttgtttgagttcattgtagactctggatattagccctttgtcagatgagtaggttgtgaaaattttctcccattttgtaggttgcctgttcactctgatggtaatttcttttgctgtgcagaagctcttgagtttaattagatcccatctgtcaattttgacttttgttgctattgcttttggtgttttagacatgaagtccttgcccatgcctatgtcctgaatggtaatgcctaggttttcttctacagtttttatggttttaggtctaacatttaagtctttaatccatcttgaattgatttttgtataaggtgtaaggaagggatccagtttcagctttctacatatggctagccagttttcccagcaccatttattaaatagggaatcgtttccccattgcttgtttttgtcaggtttgtcaaagatcagatagttgtagatatgcagcgttatttctgagggctctgttctgttccattgatctatatctctgttttggtaacagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtatgagaatgcttgtgatttttgtacattgattttgtatcctgagactttgctgaacttgcttatcagcttaaggagattttgggctgagacaatggggttttctagatatacaatcatgtcatctgcaaacagggacaatttgacttcctctttttctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcagtacctaatttattgagagtttttagcatgaagggttgttgaattttgtcaaaggccttttctgcatctattgagataatcatgtggtttttgtctttggttctgtttatatgctggattacatttattgatttgcatatgtggaaccagccttgcatcccagggatgaagccgacttgatcatggtggataagctttttgatgtgctgctggattcggtttgccagtattttattgaggatttttgcatcaatgttcatcaaggatattggtctaaaattctctctttttgttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatgcatctggtcttggactctttttcattggtaagctattgattattgccacaatttcagctcctgttattggtctattcagagattcaacttcttcctggtttagtcttgggagagtgtatgtgtcgaggaatttatccatttcttctagattttctagtttatttgcgtagagcacacctggctaatttttgtactttttgtagagacagggtttcaccatgttggccaggctagtgttggactcctgagctcaagcagtccacttgccttggcctcccaaagtgctgggattataggtgtgagccatagcacctggcccaagacagtttttttaaaaaaaataatttacagttttacagattaaatgtgtcataatgcattggaaagggtgccctagctcagacctgagtgtttcacttaatggctgtgtcaccttgggttacactgcagccccttggatcctcttgtgtaatttgactgcatggttttgctcccaaggttcaattagatagtttttgaaaggatctggatttccctttagcctttactttccttggttctggatactaaatagtttctcccttaggaagggtccatagtttctcgtttaattaaatcagctcctgagatgaacaaagggactgtgttcataactgccggtagttcctccaggggctaggatttgctcaagagttacacacgcttatctggaagcccatggaggaggctggcggctaaaaggtaggctgccagccagaaggtcagtcttggactgcgaggctctggccgtgcctctccaccggggtggtgatggatggcggggttctgattttaagaggggcctgaatgtggttaacatggtgacagatatggatcttggttgggcacagcctgcaaattccaattaatctaatcccccgccttgggaaatctgaacattgcgttgagcttgaactctactgtagggctcagggcccaatctgttacatcgctctgcaggcatcccgtgctctgtctccttggtcagctcttctagaggacggtatctgccagggctcccccagggcctgagctccctgagcaagggagaggaggagagaggaactgggaaggtcttgagtagggaggttcaaggtaaaactagccacaggacaaaaacttcttccctccttttctccctccttccttcccttcccctctctctcttttcctcttttcatttccttcccaccttttccttcttttgctttttctccgtttctctctttcccttttttacttcccttattgtctctctgtagccgaagaatgcaagaccattttgttttcatgccacgaagtgagtacatgaacatttggaaagtaggtctcacctgggcttgcctccacccggaacaactctggacacatagtaagttttcagaagcagtcagatggaatcatcctggacattggtgcagcttctgaacctttcctggtgtgagtccaagttatggcaatggaattctacccaggaagggaagcagcaaacctgagtagtgcccacctttgcgggggaaatggcaggttcctccctctccagtgatgggggctcagcctgcagggaacctttcttcccagccagccttggaactcagtgctgtcaggcttgctgatgacatcactggccttccgtgggacagctgcagccagcatcaggacactccagaaatgccagcagtaattggaaacttcatgttcagatgctttccacagcattcacgcatggcgagaagtgcttctgccgagggacttttcaggtggtgccccgagcaggatccctgggagaccagggagatcagaagccaacttccatgtttcctggaccaaggatcctgggggatgggatggggggacattccccagagggctgcagctttctgtcaatgggatttcatttgggttggtctccagagagcccacagggtaaatttctaggcattaatttccaaagcctatttttgctattccacttaaagaatatttccatctttccttgcctatcactgctgcctgatcttgtttgtgcagtaggtgaatagaagagaaataagaggagagaaaaacatgaagattttaggggagagaatattccgtggaggcacagcaactgcctttgcatttctgatggtctgtaaagcgaggaggcactggcttgttctgtgtgtccctggtgagagcgttagggctgtggggaggtgcattcatgtggggatctcagggggatggggtgggaggctcacatttgacacctcctgtgggatagctgcagtgctagggtttgcgtctccagatgttagaggcagtaactgctagcctggtgcccatcacagataccagttactaaccacttatcttgtgccaagtactaagcactgcaccagatcaactcatttccttcttacaactaccctcttgggtgggaactatctctgacatcattttacaggtggaagagagtgactgggaagagcacagctgcttaaggtcacacagtgcgttggtggcagggcctgccctggaaccgaggctgcccatcaccaggctcctgtccccagctcttcagcaccaggatctgtttctcaatcatgtctgagctgtgtgttgaatgcactggtcctgtcttccacatttttttcctctaccttctttttatcatcatcttaactgtcatattaacatactaccttataaaagtgttgaaaagatagcaatttgggaaaatgtgctcagaagtaaaagctctctccctgtttccccgcccgctgctgcatcactgtgcttcctttaagggagtgcttaccatccgcgttgtcctctaaaacgggaatgggagggaatccctggaatccctggaatccctgagcctggagggattcacaaggggaaggtaaccacttgcaggaggccagtgctgggtgcaaggcaggaggactaggggacacttaaggtccagcctaaagaggacagtcactgagagtggcccttgatggggcttccactgggacagagatgggtgctcccagagggcgatttggccgagaggcagtggcttcccttctcaccgtctgcctgactcattgcccttgcctcctggccactctgccagctttccttcaccccctgctgcatatcctgcatgcagctgcccaattaagctccccaaatactgatttcatgatgtcactgactcctctgaactccttttacctccctttgtgatcagaagcctgaacttctgaactcctctactcctaagccaaagagtccgccctctgaccccagcttgtcttccctctgctatctgggagtctctcctcttttccacttagttgagttcctggttagttcaaggctccattcattctttctttcacctagatgccaggaggaagctgcgaaggctgagacataaagacatgtcacctgccctcaaagagcgcttggtcttgggaaggggcatgcatgaaatcaccttttttacatttaaatttaaatttatttttgagacagagtcttgctctgttgcccaggctggagtacagtggtgtgatcttggttcacttcaatctttgcctcccaggttcaagtgattcttctgtctcagcctccagagtagttgggattacaggcatgtgccacctgtaaaaaaaatacctggctaatttttgtatttttagtagagatggggtttcaccatattgcccaggctggtcttgaactcctgacctcaagtgatctgtccgcctcggcctcccaaagtgctcgtgttacaggcatgagccaccatgcctggccatgaaatcacctttgatcagcgtggtgagagccacttcaggctgcatacaaagccttcctcttgcaggaagcctttattgattgcactgtcactgtgaattcactcttctctggaggctggtgaatcctcatctctgttcttctctttttgttccttgttttctgcccggtataattcactttcttttattgccaatatctcttggactttagccccaaggaacataccacactgcctggcactgtgccatgtgcctaataataaggaggtacatttatattgagctctgattctgaagcctgttcacatctgtgattccccttactttgcataacagctctctgggacaggtgggacaaatgtgataagccccagtctgcagagcaagagacgacttgcttatgggcacacagttcataagtggcagagccgggaccagggactggagtcttgccgtgggtgtgctacgcggccccacagaaggatggatgcatggagtcccattttgtggactcccccctgggcctgcaatgtgtagggatgtgttaggggaggatgagagggcaagagggggatctgtggctagaattccggaggttcgttggaaccagggaggtacatggggtgacttgaaccccaaatcttttcatctaggcatgacactccctttttcctctatggagactgggaatagcaggatggagggagggtagaaggagtagaggagtcagtgttggggctagggctgggagggacggggtagaagagagcaagttctggggacagagggcagtcaggagacctgtcagttctctctgggtagcctggactctcgagaggactgaaatgcatcaaaggatgggtaatgaaaaaatggtgatgaggacgggttgccttatcacccagaagggaggaaaagcttcaggcccaaccatcctgcttaaacatttgagaattctatgcggttcttttaagtatttagaggtactggggacaatgtgtccagaaagtggaatcccagctccttctcaccccggctattgatttttggccttgcaattactgcagaggtgctgcctctgtgaacactattagtgctagttggaaagcttgagcttttgaagcttagctgtttgagctacctacgggtttggaaaaaaaaagaatcttaccatgtgtttctttagcctgggcatgaatcaaaaatagttgaacttttttttttttgctcaagtctcaagtttaaaaataaaaaagtcacctttgggctgagatcaagaatggaaaatttcagggcatagcgtaattttttccccatctgttctgggcaagggatgataaagcattctgttggaagattgtgtgtaagcatcaaccatgagtctcactactttattgcgttgcaatgtctactttgttaagatgtcttgaaagaaagacttcttccatcctcctggcacaactgaatgtgcttggtatggggagacgtgtctaactgaatctaagcaactaattggaataggcaaaggaggaagtgatgaaagtgaagctgcagtttctgcaaaggtggctttattgtataaggtgcaggttattaccccaaatgatcaattactaaagttctggattgggcagtgacaagtgtctagagggaatgctgggcctagggaattgcattgtcatgtgagaataaggctggggccacctttacattttcattaaaaaaagatctggacagtacttgactgtggtagtagactttgtaaaggttattatggttacagctttgtttgcttgagatcctctatttttatagttcaatattattaaggtatgaagaaactgttttatggatgtcagttttactgtttctgacaacagcttgcgaggaagtatacatttgtgcaacagaccgctttggatgttaattctaaatttagaagccgccttcaatgggtgtggaaatcagttacacaaaattcaggtgcttactaaaaaaaatctgaatatccatgaagcttgtatggtccctggtggaactttgagcagctgagcctctctgaagatcctgaggttgtcagggtgtggcacagcagctgggggctgggccccgtgcatgcacatcagcatctgtgtattgaatataatcagcacagatagggaagaaacaaaccaccaccaccaaacaccctaagtaccaatctgggcatctgggcaccctggattttcattttgactctgtcatttactagttctctgaccttgggcaccatgctttgcatagcagccttggtttcctcattggtaaaatgaggctgttgaattctatatggctcaagagttctttccagccccgaaacatgcaaaaattcagtttcgactaagagctttagcactgtcttatcttggctgtttgcagtggccaaaattgataacatattggaaaacttccctgctgattaaaatagacattgccctaagtgctgtgagtgtccctgttaccttatcccttctctgaaaccctctgggtttccccttgaagcagcccctaaaatggctcagtttccagcatagcaggaggtctccagcctagccaatggtgccccttgtgaaggtcatggacctgccttacccattgttaaatgttttccatccctctggtgtacgtggagagcttctgggtggagtggacacaaatgatttaactttcccgagtctctgcttctgcgccagaaagtggaaggaatcataaccagtgtagtggaggtaattaggagggtccaaagcttggaccatctgggttcaaaccctggccccaccacttagtatctatgtgagtgtgggcatgtcaggtagcctttcttacctcaattcataatccgcaaagtggggatgagaatagcaccaactgtatcaagctgatgatgagatcaaataacacacaaaattcttagaatagaataagcactgtagaagtgatagctctgtgtatgtcattaatacattcactggtatcactgaactttattttatatcaagtgagataactactataccatccagggagataatgtgtgtgaagcccatagcacaatgcttgacaaatagttttcagggaatgttagcttctatctaagcaggtcccattggaaaaaaaaaaagttgtatttttatatagttctagttagtttctcatctgtgatctatgctatttttaattgaaaaaaaaaagtgtttccatacattgtcaggaggagccgttcccctgtcccagcctctcacaaagcacaccctcactccctcatttttccagtagtcccagggctagaccacctgtagagacaggaagcctgcctaaagagcagaagcatctgctcagaaagatctagttgtttgctggagcctcagcttgaagaaggctccaagtttattataaagtcccagccacacagtttgcttgagactttataaagagagaatgagatgtagaggctgggcccaaacccactaccaggctgtgggaatgggggatggggtgcttggctggcatctcttctcagggcctcctggtcagcctcaggagatctagtgctaagggttactctgctggggaaaatctcaatggcactagagaccacttgagcacagctcttaggaactgaggagccagctacttagcatcccagaatcccaatgcccatggccagagccagagctgcttagaagaaaagcaaagtccgcaggctgcatggactgagaaccacctcacctggctgcacattctctgagtggccttgaccatgctgttctctgagcctcagtttcctcatcaatgatagagtggagttagctagatcaggggctttcaaaagctttttcccctgaaacccagaataagaaataccttttctttctcaacccaatacttatgttcatgtatgtaattaaacaaaagttccatgcagcaacccttttaatatgcagtactctgttttctgtgctgttgtttcagttgaaaaatgctgattgtgaatgattcagttgattctgtgacctgctgatgggtcataacctgcagggtttttgttttattttgttttgtttttgttgacagagtctcgcactgtcacccaggctggagtgcagtagcgcgatcttggctcactgcagcctccacctccagggttcaagtaattctcctgcctcagcctcctgagtagctgagattacaggcacccgccaccacgcctggctgattttttttttttgtatttttagtagagacagggtttcaccatgttggtcaggctgatcttaaactcctgacctcgtgatccacctgcttcagcctcccaaagtgctgggattataggtgtgagccaccatgcctggccataacctgcagttttaaacatatcgggctgaatatagttgagggtgcttaaatgctatgatgctgtgattcagctgggccaggaatatagagaacagtggcaccctactctgtgttgggccagagattgctgaaatgtctagcatattagatcaaccagatttttagttctaaaggtgaaaccagaagcatttttttttcctctcaaaaacacacatagactcagaggtatggatacaatacctgaagggctatagttctttttccaggattgtccctctcagcaggaatggaggatccctagctagagaggagagctgggggtgacaccttcttgcccagtggaggacagctggtggtgtggcctcaacaggttcttaggaaggtgagttccttagcctttctactagtgaggtgtttgggttaaggtgcagcaccattgactgggcccgtgtggggaggatattcaaagcatttcacaattacacagctgcctgggcaccgacagagtcctagagaagtgtcgactgtgccaggtccaacccttcagtcgctggatcatggggaggcatggagtcccattgtagaggctgggtggtggtagtaggcatgcaggaattcagggaagctgctacttaccaccatgtaaaaaggatttcaatattttcaccctggtagggatgcaccagtgtgtgcttctcagcctcagtcctggacgtatgccccattgccctaaggttgtcccaaagaggccaccattagacctcaccttttatggacaggtgggagatgtctgaacacaaccacatgttgcccagtgacaggggctgggctgaccaggacacggagagtgacttgccttctggggctgagccagtcactcatactcccagcgtagccctggagcttcactgcaactgctatgttacaggaagttgtaccagcagctctacactaaggtgtatagtcggtgaccactttaaagaaagactcattagaaagaggcattgtttggggaggccaacaggccagctgttggggaccatgccagaggtactgtgtcaaggtacctggcttgatgcttacttcccattgtctgtttcttgagtttattttgcgccatctgccttcttccacctgatttggaattccaggactgctgtgtaggcttctcttcagatgagatgcagcagtgttctcaactggcaggggcagctttcttgggggcagggactgggcatctgtgttatctatcctgggcccatctgtttctttccccttgacacccaccacaggggtctgtgtacaagagggttggttgataccagttttaatgagggaacctatcttcttggaaccatccagaagctgtggtctttttccctggaacaccccacccccgacatcccagtgctggattcaagctggtgaaccacaggtcaaaattttcagttgctgtcttccagggccttggttgttccattgtcccctctccctgtaccaggatcatcgtgatccaatggatttgatggagttgctacacccagcttggcgtgcagaggtgtttggcacatccctgcctgtggaattctacgctctaagggagatgctgccagggtattacctgattcacgaggcatgtcctaccatctgtgttatattttttttaagatcagaattatgaatatttcaggagtcatctgggatctgaagaagcaagaacccactttctgagtcttttccttaaccattcatagggggtaagaaatgtcacaggtttgttgtgaaggtcaaatgaaagagaacttgagaaaatttgcaaatccttcagttcaaggtgaaagaaggtaatttattattaattcatattgttattatgtagcatttcttagaatatgtataccaaatgccttttttgactggtgcaatctttctataattccattctgggatgttagcttatttgcttagagaatggtgtaaagaggggagcccgaggccggcagatcacctgaggtcaggagttcaagactagcctggctaacatggtgaaaccctgtctctactaaaaatacaaaaattagccaggtatggtggcgggcacctgtaatcctggctactagggaggctgaggcagaattgcttgaacccaggaggcggaggttgcattgagctgagatcatgccattgcattccactctagcctgggtgacaagaacgaaattccatgcaaaaaaaaaaaaaaaaaaaatcacttcctgggcagtctgaatttcttaacctgccccagagagcttaaaaactttagaaaatgtggaggatccactttttaaaaaaatatatatatcctctgttcatttctggaagccctaaggaggatgagagttacattctctgtcactgcccaagattctctcatgaactgtataaacagtgttgaactacatgcttgtctcataaacccagttgggcaaatattataggcctatttctgtcacctctggctggtggagtgtttgtatttgtccacacatcctttatgcccagggcacgccctggataggagaagcttgtgccctcccagatggaaaatgcccataactcatcagcccaacattggactgctaattgtaggcctggattcatagtgttcttgaaagcttcagggtgagattaaactgccttttgacagtgattgacagctttcaagattgaaataatgagcctggagcccccattccctgcaaaccactctggagttaatttccttgcattcttcctaccttccagaaacctgactcctgtgcagctctgtgttcaatggatgtcacatctatcttttgctcttttgccaaaattaattgccagcattatccaagggagtctcaaaccaatcaggtcttgcagctagaggatcatcaatataatacatgctctattgcctcagtgactttcagtctctgccctggcaggggtcctaggagattggtttgaggcattgcagtttgattgtgcttgtgattgatgggccggaggctggagctgaggaaatgccccaaggattacattttcttagggtgtttttgactcacaggtgtgcaccaccatggaatgactattgtgtgcggagggaagatggttccctggagttgggcatcaggcacttggttgggatgctcatgacccagggatccacgctcatcttgatcctcagttctgggtgtgtctgggccatatttccagagtcctggcttccaccagatgcagcataatcacggttttgaaagcataaagagtccttattgtactgtatcctggtcttcatcatcatcacttccatagactgcactttacagggcatagaattcccttttttttttttttttttttttttgagatagtcccactctgttgtccaggctggagtgcagtggtgtgatctcggcttaccacaacctctgcctaccaggctcaagcaattctcctgcctcagcctcccgagtaactaggattacaggcacatgctactatgcctggctagtttttgtattttcagcagagatggggtttcaccatgttggccaggctggtctcgaactcctaaactcaaatgatccacctgcctcggcctcccaaagtgctgggattacagcatgagccaccgcgcctgaccctgaattgacttttaattcctcgcaattactttgagaactataataccatttttaaaggtgaagacacaggctcagagagattgggtaatttgcccatggttcctctgatggtaactggcagaaaggggaactgaccggaaatccaagcccaagctatttctctctgtccacaccatatgtcagctgtgtcgattcttatgccatcctctttgaaaagaactcagagtgcttttgaaaacccacattttgcaattgctgctttatagagtgtcaatgtttgtctaagttaattctcaggtagtgacgatcaaagatgtaacagttcatccagggtttacctagttaattccagcacagaaccagaaacaagatttctggcctctctagcactaacctctccagatgccttccatgaggcatatgtgtgtgctagaggcatggaggagctaagtttgggtctctgtactgttcccttctcatctgtttaacctccaaagtattgtaccatgttctctgtgtccagtggaaaatgatgtttttacattgcatcatctgtcattcttaaccccagagtggggctggagtgttggaacacttcagcacaggactctgtttaaagctgtgagaagctctttttgtttttctaagtcggctgaactagtaaaacagttttacaactgtgttttcaagttctgttcagaaagacaagcttgaaaaaataggtgatgctgaagtgtcattttagtaaattttttttccctgttagaagagaggttggctcttccttgattctaatctttaggttatttctccaagagctacctttctgttttttttctttctgccccatgaggtcttcagtcctggatactctcatcctataatagccagaaatgacccttgatccatggagtttgacttgggctgaaatcaagtttcaagaaataccacagggccttgtgactttgtcacatgtcaccctggcctgtgagggggccgtctgactcccgccctgaagtgtatcagtcacatgcccttgtttgtctgccccctccccagctccccagcccacctccctatgtcagtgtcctctttcttaaatctgcactggactggggaagttcttcatctgatgcgttttcctgtggtgtgcgtgcgtgtgtgtatgtggtaagagtgaagagatgatcaaggaagattgaggcagctcgaatttcattatgaacggttcttctgagaagagaagtcactttcatattatgagaaaagttaggaagaggtcaatgccaacctgcacccctctgtgattggctatccccttcacctgccttgtgtaatgttgccccctttccctaagacccccaggagggcctagtttgagaaaatgggccgtaatggttgactgtgcccgagagatcaggctcttccatgtgcggaggagtctttggagatggcaccgtttccaggaacaggaaggccttggaaagtttgtgggctccttgggcagaggcaaagtttcttttggactcttccttagtcttcctcatttccaaatttcaaaagtgttttctctttctctttctttcttttcttttctttctttctttttttttttttttttttttgagatggagtattactcttgtcacccagactggagtgcagtggtgcaatctcggctcactgcaacctctgcgtcccaggttcaagtgattctcctgccttagcctcctgagtagctgggattataggtgcacactagcacgctcagctaatttttgtattttagtagagaggaggttttaccatgttggccaggctggtcttaaaactcctgacctcaagtgagctgcctgccttgttctcccaaagtgctgggattataggtgtgagccaccacacccagcccaaaagtaatttctttggactcttccttacctcatcagagaggagctgctactttgttgccacagactgtcctcagagagcctttgatcctgtctctgctgttccctgtgctgcaacctgggctttcagcaggcgaaagacacagcagacctgcccatagctgtgggcagtccggcttggcttgttaccaagagatttactcagcttgctttgaagagcttgtgtcgcccagtgaggaaccctgtgggcttctccttccactctgtgttgccagtggcctacatctgagctgcccatcgtagccacagtatcatctgttggaaccttaaaaaaaaaaaaagtcgatccctgctcaagacctacaaaactggaatatccaggagtggaatatcaaatctgtgttattgaacccagatccacagggagttctgatgctcttctaggttttagaaccatgtctgtttactcatttactagccaatggggaagctgggaggaggggcaagatgacacttgggtggggccttctgtccttttggttaccttgagcatagctcctggccttcctggtgaaacagcctgctgctgaccttgaacctggggtgggttcagcaggaccctctagtccctgatggggcatcccctgggagtaggcttgaagtagaagcagctttctgggtgtgggatgcccctgagacatagcaggtgggctcactgctgagtaactagaggtgcccaggccctgactgggtgtgcattatggaggaacagcttggtgcactgcctgcagggttgcctggtgactgcccagcaggagggaggcgagggcacttcttgggctggtgctcactgctgacccagtggagggaacattcatctcactagaggagtgtcaacggcgcctggttcctgccttctcagctcccaagtgcccctttccttgctgcagcaggagaggagacttggccaatgggggaagagtcatttatccatgagctccaattcaggaacatttgaaatattgacaggctgccttttaaaacatttacaacaaaaatagttttatggagtcccacgggggaaaaaaaagaagaaaaagttatatttctgatttcactcaataaaggaatgatactgagaatatcagctttgttatttcatcactaaaatgttaatgtctgtgctgtttgggaagttgcaatgcagaggcagctttctccccgcctccccaccccgccacccggcgtttttttgttttgttttgttttttgtttttttgagacagggtcttgctctggggtacagtggtgcaatctcagctcactgcaacctccacctcctgggttcaagcgattctcatgccccagcctccccagtagctgggactacaggtgtgcaccaccatgcctggctaatttttgtatttttagtggagacagggtttcaccatgttggccaggctggtcttcaactcctggcctcaagtgatcggcctgcctcagcctcccaaagtgctgagattacaggcgtgagccactgcgcctggctaacctttttggattcttaaatgtgttcatgggctgcatcaggaagccaggccaccgctggtccctaggtctggggtgttcacaagaaaagaagatcataaacatcatgtcaaaggcaggaaaaacaaaactctgccctctgtggtattaagtcccagtacttgaaattccaaatgtccaaaggggagcagagagcagcacacacatgtatcagttgcttgtccacctggtagttgagtgccttcactgggtatgtgtggtagctacagcctagacagtactgctctatgctgggcactgtgctaagtgcttgccctatattaacccttttagtcttccctacatccctgaaatgtgtttatgcacttcttgttcctgttttcatatgaggaagcagacccagaggatgaagtaatcttatcgaggtcacacagctgggaaatggagaaattaagattcaaaccagacaggcatcctccagagctaatggtttaatccaggcactgagttgccttttcccaaagtagaggataagtcagtcaggcagccacggccctcagggtacctccagcacacctcatgctgggcccctttgtagtggctgggctctccccttgaagagttttctccatctcttggtctacaatctagcttcccagccttctgcaaccaaatcctttccttactggtcagaaatgcctggaaattgcagattagttcagggagatttttcccaccatgggtcagagagatttttcccaccatggctcagagaggtctgagcctctctgtcactgacatttgacctcatcctcgtcacttctggccttccagtggggctggtctgttctaaccatctgtaagcttagaactgtacggtcccctttgtggaaatctgcttccaagagtggtccctggaaggagaaggtgacttctacatctgtcctctggttgatggcttgaatagatgtgctggccaggttggattggaaggtctcagtcttcccagcaagctccacacacaccatgcttaggggaaagaggctcttccttgatggctccaggctgcagcatcagtcgaatcctagctagaattttgaagcatcattgtgctcatcagaaatatttaattaaggctgcatattaacagtgtgtttttccaggccctaggcaggaccagtttagttggaaacggttcctggccacatggagagcagtgcctcagattggaggtggaaagagcatcaactgtggggcacagggatttgggatccagtctgtttctgctcttctttctataggtctgagttttctcatcagtaaaatgaagccattagaaagttggagcttttgagatttttgctgggtatacatttgtccagaagtatcttcccaccatggctcagggggtctgtgcctctgtctgtgacatatgatgaatttttaaaattggatacacagaattctctagggagagagaagaatgaaggtaaatgagcccttcctctgtccttcccctgtacatataagagcataatttaaagtcacccactttaagtacaatatttacttaaacttgcataggtttttcctgtcactccatgatacatgttttatttaatataaaaatagtggtagctgggtgtggtggcgtgttcctgtagttccagctactcgggaggatgaggtgggaggatcacttgagcctaggagtttgagagcaacctgggcaacatagcaagaccctgtttctacaaaaaaataaataggaatagcgttcttcccacatctctgaatcagttgaatactctatgagtgtgtcccctgagtgggctttgtatgcccctgactccaaaatcttggttggagtcttacatctgggaggtgaagcttgagggctagggcccatgtactgcttgggttgtggggggaaatgtataaaaatagccccccacctggacaacctcagagtcttattttcacactgcttctagcatctgccttcatggacctaacaattatgtcaacatcctaccttgaaaatgctccacttctgaagatgtgcttcgagggagtacacacaatccttgccactcccccaagccttgcttctgcccagacgcggcctggttccctggggagaggcatgcctgagtctgccgagacgcctgctccagaatgttttcagggcccgttccagctcttaggttctgtggatctacgtgagatcacaaagctgagacaggcacactgacaactgggtagatggcacaacagtaagttaatccaggagataaaagagaaagcgagacaggaaagaatagggtgaaatcccagagggagcgccagggcccctgggacttccagttgcttccagcggcagaaagaggacagctccagctgctacagcacctcccaggaccaaacatggggaagtctacccagcaggtgctgggagagaggcagccccaaccagagccaatatcagatgggagttcctaggggaagatgatcccactgggcttgggagtaggctgggatccctctcttctccaacccttcactctcccatccagtgcgctcctgtctcttccttctcttcttttctcctttgctctgacttggtcctggtggtgaaggaccagatgtgagcatcactgcctggcttgggagaatctcttgggtggctgggctgggggtgcgtgcacaatgctgaatcttactccatttgttttcaacttattcttgctcccttcttagcatcctgctcttctaaaaaggaaactgtgatttccctgaataaactagtgctttcattgtccagcattggcaaggaggaaaatgctctgagagggcaaaaagtagttggatgaccctgactctctccagcttcaccttcctttgggagaatttctcacgtatttagtacgaacacctacatactagttttaaggtggtgccattttcctctaactgtggtgggccaagcttgggtgcatgactttctaacctttcgctaattgtctatgttgcgttgagagtctggtgggatgtttagacaggacgttactgaaaatgtggagacagaaaaaaggaaatgaatggaggctgacagagctagataactgccctgtagggcatagctcatcttagctcacagaccctgccagagtcctcatttttttggccttcttcatgggctgggttcgctcttctcactgcagcccacaactggttatccacccttctaaaaatcccctgctaggagagttcagcccaaagaggcagataggaggatcacctcttccaaggagtttaaggcctctcttctgggtgctactttcctgttagatgctttccttttctgtgatgattgaactagggaaggagaacttcccttccccatctagggagagagacttcctctccatctgaagggtcctggccttactcctcaagataatggagaagaatttaatatagtaaattcaacatctccagccagtatgggagatatcataagggacaggacacatatttcctttttagctccagtgctccaggcctcagcttccttgtttgtggagtatgcatatttagagttcctacttcagtgttgaggactctctgtgatggtgaggttaatacatacaaggcatttagaatagttcccaatgaatgacttttatcagtgatgtgttcccagcaggtctgctcagtgtgtgagtctagtccatgaatggcccagagtgggaagatagcatcaccatccacgactcaagtgaagcacatcatgatttttcaaagtattcatctatgcatcccttattagtttccataccaaccccagagtgtaagctccacaaggcagggaatttgtccatcttgattgccactatatcccaagtgcttagcataatgtctgactcatagtagatgcccaataattacttgttgcatgactgagctctgtgagttagatggagtgggtagtattaatccatttgacagaagaagaaagtgagtcccagagacatgatatgactcttctaaggttgcatcaggagttagccacagagctggggcaagaccctgagtctcctcagtcctgatgcagtgctccatccccagtgtgctgttagatctatcaagagttgtgcctgctggtaggttggaagcagggaataaaccctgagctgccaccaggtcagcttcatggattccattgaccctgcttctctgggcctctgtgcacacctacatgtgtacatgctgggagtcagaggctgtagagactgtagactagtggcatctgctacatgaaatcctgccaagggacagctttggagaagccttctgtctgcccctgagctaagtgggggtggaacatctgaccacatgccctcttgcaccaggcgttgtccacgttaggcttccaagtgttgggcgtggttgcagggtaaggctgcatgattgcaccaggcatgttggtttggcctccctgaggtggtgcacagattgcctttctgtaaataggatgtctgtcacctgaggcatttgtaccaggcacctcattccttttttggcttcctgtggatttggaaggaaactcaggggccattttttttcatccttttccctccatataagactataccaaatatattccagagatattatttgctcttaaaaaggctcaagaaataggcctaactacatctgaaagtttttctaaatcaagggttggcaattttttttttttaatttgtaaaaggccagataatagagattttaggcttttctgggccatgctgttgcagccactcaactatgcctttgtagcatgaaatcagccacagacaccccagaacagatgagcatggctgtgtgccaataaaactttatttataaaaataggcatcgggctggattgggcccttaggctgttggtttgctgactcctgttgtaaatggttatctttgggtcagcccatctttggtcttgctagtcttgggtgctgcttgagtcagataatccaagagaaataaaattccatgttgactcctctccttagcctctgcttcaaaacctttttaagagaatatttactcaagaaagagcttggaaggtcctggaaacatgtgcctttcatgcagatgccttactgcatggagaaaagcaggctttcaccccaaatttctgttgatctggagaagccacacagaggtgggcccggttgggcagcctgtcttgggtgagtttgggttactgtaaaagctcagacacttgggttcttggctctgtatgccctccctccctgtcttcctaaagccaagaaaaatgaaaggcgagggctgtctgaactagggtgtgatatttaagtcttagtgggtaggttgaaatataacggagccgttctgttcattgagccaagcctgtggactccttaataatccatggtcgggattgcagccctgtggggaggcagtgggagccttcagcagcttgaaagtagatgtctggattccaggaggtacaagcttccaagaaggaaattttcgtagctcatctttgcacaggaaggttttaatggaaatttgaacactcctagtaaacacccttgctattagcatctttcattttgacagaggagttttcttcctctgttctgatgggttatccaggctgggctgggttcctgtgtggagttatgggctctctttagggaaacatttggtgtggtagaaagatcttggtttctggaatgagatttgtgtcttgaccatgtgccattaattgtaggtaagatcctcaggcaaagtctttgacttctctgagctttgggtctcactgttgctgggtgatggaatgagagtgggtttacaaagcaccaagcacagagcccgacacatagtaggtagcctagaagggaaaacagaactccagttgctaatgcccaggtctgccccgccatctttggggctgggttatctgtgtgctcccctgacagggagccacccaggattcactttcaaagatgggaaaggaggcctgaaggggacatgctaccacggagtgagcaggcattcctaagagtcggtctgtcctttcctctcccactggagatactcagccagtgtgggggccatgcagcaccggggaagggacacatgtctgggaatattggggataaccttgtgtgaaatttttcagaacaggccggcagtggcctgggacatggatagctcaggctgcctgctttgctcctgtgcttgtcctcgtgacttagattcttcaagatggaggggctccctggctggtcccctacacaaggcccctatatctgtgctgggtggtggttctgatccctttttccctgtgggggtggatcagagcttcctgtggcttctcggtggggctggagggccctagcacactgtgaactagtgggaggcagtgagctgggaattcagtggaggagggagagggaataggaggaggatgaggaggaagaggaggaggcagttgagacagttctctcacttatgcagaaagtgtgtgatgaaagtgtgtgatcacagccagccccacacagactttcctccaaatgagaagggagtgagaaaatgtaattttagtgtctggcttttgactgactccctgtggaggttccttctgggctgtggtgttgggtgtctctccttccctccaagggacagccaggcctgggcctggaataagtgagttcagatggtaactggggaatggccatagggagggagtgaagagccgtgcctgtgccccagggggctggggggcttggatttcaggacatcagggaggtgacatcaaggacactgcaggggggatttagggacagggtagtggggtcagtgcctgactcagtccgagctgagctatattgggtctctgttcctacgctgaggcatgctttcccaggcgtgaggccatgttttccaggccacagtccacagcctcgctgccaacacaggtgtgcattttggtggaggcttgctaccctctgtgtgaaaccaagggagcagaatatttccctgaaatcggggctcctggaacatgaccctgccaggaagctcaaagtcctgggagaatatgttccaggcagggcccggggggcacctccatgccccactgccttgtggctcctggcacaggagatgctggacagtatatactctgctggctggacaggctctcatgtctgcatgtgaaaatcaggttctggggagtttataaaccaaagaaaacccctccacccagcccacagagtgccagcgattccctcagtgattcgtgtgtggaggattcacacttggtggaaaatctacttaacatttttatcctattttccctccactcactgtcagtcctcatgtgttaggggagtggaaactcatttaaatatgagtctatgaaaaaatttaattaggaagataaattgaaaaatgcatataatacatttccgtgtcagacataaattactttatccacaccactgcacccctccagttaacccagggagttgggagttgtctgtgggatgaaaccctcttaggagattttccggaggaacccaactattaggaactccttcaaagcagaacttaaatgatagcatatagttaagtacatattagaaacttcatgattccatttaaactaatcattcagtgacttcatcgtgggtcagaaaaaatatgctctcttctcggtacattttgcacctgcagaaggatcacttggggaggaagaagatggggtagatgagggtcacatgatttttgtcttcctatgttggaagacaatgcttatggaaggggattagactttttgctgtgtccccagggagcagagtcagtgccattggttagaagttatagaaaagtggatttggggtcaatatgatgcaatactttctagcaaagaattttggttaaaaacacaggctttgtattcaaccacaatgaaaagctgaagcccagctctgcaaactactagctgggggacctcaggaaaatttacttctctgggcttcagtctcttcaacaggaagacgggcaaaactatagtgaaacctcataccttcatagagttgctctgaagatttaaagaatacgcttagctcacagttagggaaattcagtgaaaggtggatattattactagaagatagggtagcagtagaaagaaaatttgtggtcctgtaaaattgaagttgccctgcagtgggatggggcatatgaggatagtgagtgcttcatcatcactggagattttgacagcagcttggtgtgtggcttcttctcaggagtgatttttggagattcaggaatcagattcctgggctagatgccgtgctcttcaagtttagctgtgaccctctcaaccacttgggaattttttcctttaaacaattataacaattgtttttgaaaatatcaaagttcagagaagaaatttaaaaattactcaaaaatctcacttcctagacataaccatcatgaacattaagaaaactcacgtaatctctctatcatcacacacacacacacacacacacacacacacacacacacagctggaaagatatgtagatcacagattgacaggaataattttagaataatgggatcacactctacatcccaattttaacaaagagtattaacgtacatggcttaaatttctaagaggaaacaagtacatctaaaggaagttctgagttctggaaaaatatgtcttcattgaaatggatatcttttagaagagctcatcaaggttatgaaaaattttaagaagatggagtcattgctttctgttaatacctagtttcaattttagacttttgagcccatgttataaatgatgaaaaaattagcaatcacctgcttcttcctacctcctaccccctttcttattttaattatagcttatttttacattgttaaggctgataatatctaacaagtccctgagttgtttagtctcaagcatgtcccctacgtaggaattcaatttccagttgtattctttctgttctagtttactcgacaatctaaaatgggattattttggtctttgatttgttttctttgacctgctaacttttctgaattcattgaatatatgtttttgttaatttcttctatagcattaaacatttgcaggaattttctttgtttctttggttatgttttcttctagagaggttcttcatcatcataatagcacaatatgctattatgttccttattttcctcctgtagtgtgtgttcacaagtgccatattttttttatcttgcatatgtttaacttgggtagctctgtccacttcttctaatcactctgatattgagggcaaattctttaggactccttttgtgacttacctgaaacctctgccatggtgtcagctccagtttgagatgctttctgatgcctgggagcattataggggaacatgggagatgagggtggtcagactcagagctgtgtgctcctttgggtaggaccacatttaactcttgcatgactttgttaaatgtgctgttccagggctcattccactaatgaggggatataggaggggatgtccttgccatttagatgatcccctcaattaagcgttgagccctggaacctgtgtttctgtgagagaaagagagagagaatgagagagagagaaagagagagagaatgagagagagagaaagagagagagtcttgattgttcatgctgctgttttatagctctttttctaatagttctcaatctgtttccccaactctctccgtattaagtcagaaaagaggaagaaatgatgtcacactcacagtctgcttctctgcaaatatatagtaattagtgagaagtctaaagattttggcctcagcaataatacttctgaagcatggggtggggttaggaacctgacaacttctgccaaatcctgttcctgcccccaccctcaccccaggtcttttagatgttgatagtatgagtgtgtgccagttccttgtttgattgctgcttgcttttctccttcacttattggtttttgtttttttgttttgctttgtctgattatgtattgggacactctgccatctttctccaaaagcctccctgcgtatcttttaaaaaaatacaatttcctaggctcaacacagagctatagaattagattcccttaggggagggccacagaaatttatatttttataaaacttccaaggcgttctaacaatcagccaagtctgggatccattttaagtttcccctaagattctttccagtgctgagattctgtggttcattgtgttctctttaagaaacagggagggggtgttagcacagggattctgtcatattctcaggcatggcatcctctcactatgcagaagaagggcttatgtctctctttatgccaattcttccttttgtcttggtccatttgggttgatataataaaaatgccttgcactgggtgatttgcaaacagtagaaatttatttctcacaattctggaggatgggaagtccaagatcaaggtgcttgtggtttttggtaagagcccacttcctgcttcatacatggagccttctgtgtcctcacatgatggaagggaccaggcagctctctgggacctcttttatagagcagtaatcccacttataagggttaaaattgctacatataaatttttggggagggacacaaatattcaaaccattgcaaagggataaggttggaggatcttctcatttctctttgtcacaatgacctaaagataccctccatgttttagcaaacttgcccttgagttagtgaatggataagttgttctcaactctggctgcacattaaaatcactttggaagcttttaaaatattgatgcctgggcctcacccctaggcatgtggagttaattggtctagggtagggccaaatcactggccttttctttgagttccctaggtgttctatctagcgtgcttccaagactgagaaccagtagattgttctttcttatttttttagtgactcatgatccattctccattttccttactcctatctcaagccttgattttggaacatgtactttctacacactgaatagtttctaaggtaatgttacttagaacaatagagtcacgtagtttcaagaatgggctttggagtaatagaaatccaagtgtgggtcctttttctgcccctgctgcttgtgtgagcttgaacaagtaacctaacttctctatttcacagtctcatgcaaaatagggattttaattctaccttgcattgttttgaggaacaaaattagtttcatatcatattaattacatgttacactagttttcttgtgggtagagtttttctgacatattattttttgtctttttattgtcaatcttttaataaggcttttctatatgtttcttacaatcatcaaataattgaattttgtttaatgttttcatctggtttgataatctctgtcttttaataggtacgtttaattcgtttatacttaatatactcactgatacaatatgtgagttttttctgctgttttattttgggtttctttgctcctctttccccctttcctgtcttatattaaaggaattgttccatatttcttctttttttaaattttgttggttcataagctgtagatcatattctgttctcctagtgattactctttttttttttgagaggaagtcttgctctattgcccaagctggagtgcagtggtgcgatcttggctcactgcgatctctgcctcctgggttcaagcgattctcctgcctcagcctcctgagtagttgggattacaggcgtgcaccaccacactcagctattttttttgtgtatttttagtagagttggggtttcgccctgttgaccaggctggtctccaactcctgacctcaggggatcagcccacctcggcctcccgaagtgctgggattacaggcatgagccaccatgcccagccttctcctagtgattactcttaaatttttgagatacattttcataattctgggaacattgaaagtgataacagtatttttactcaaataatgtattcaaaatattcagcacaatgcctgacagtcattaaaatgcataataaattccaattgctagtgctagtcttactactgccagcactacaattaatattaccatttttacccaaagagccactaagtattatttttatccataagtatggtatcaagaagatgaacattgtgaaagttatatgaacaaattatagtctgaacagtgccagtttttcccaaaggagtttgctcatttgtaaaatgttatactgattattcaatgaggtaagttctgcagagtgcttagcccacagtaggtgctcaatcactgttagcctttatatggataccaacctggacttcccttttaaaacaccccagctttgccttattgctctgcaagccagttctaggcatgtgtctctttggctgtgaccctggatccaaagcttttggggactgagtgtggatgtgactgctctgctccacctggctgggacatagcaggacaggcagcaacccaggtctgtgaaatcaatcatgatgattctgggaggaattattggtgaattagggggatgctccaagggatggtccagatggaggtaggtgtaaagtggagttttgctggaaggagttgtttttgcacaacatattgatttccttggggtgggagaaaaaagaaacagcagctcttcgctgctctcccagagtggtgggtaggagaggacaggtgggagtctgtgggcccctttagctggttatttttttagatgtaccatcaggtagctgcaactgtattcccactgcttccccagcaatgcaaagggcagattacgaagcagagctgggctggcagcaagttttgctttgctttctcccagcggccaacagcatttgcattggtgggtggtgcacacactctgcagagagagggcgatacccaagcccagggcccacagactgagcacagaacagaaaattagggctgggaattcacccgtggctcctcagtgtctgtgttgcccatctctgatagacttccaaaatagcaggggccaggaatttggtggggacacctggggatgaggggccctgccagagctgggttcattcttgagggaatgtctcccaaatctgccatttaagaggatagagtttcggtccccaagctcaattctgcctcacctccatgctccattatctgggtatccccaggccactcacttatcccacccatgtctattctcttacctgtaaaactagaattgcaggtattttagtggatacgttgttgggagatgactcataggttttgatcccatctccatctctgcattatcttggacaagcaacctgacttaggtgcttgcttgtctttaaaatgcagaacgttagtacctatcatgctagctcattgggaagttgggaatggcaaataagagaatggccttgcaggctcttgagggaacagaaaagagaaaagtgggttcctcagagacatatgctcttacctagggtgggggagctggtttatgaatggtgtaagtctcagagtctccagcttcttccctagggtcctcccggaccaaccagcctgtattggagtgtgttcagcctcttgggtagatgtaggaccgtgggtggtgacatgaaggagacaggttactgctcagcaggaggggggacctatgtacggagcctcctagcctcagaggcagctgttactatgcagagccttcatgctgagccctgtgctaaccactccacacacactgtcccctgaatcagtcttgacaaccagcccttcacaggcagggagcaatgggattagatgccttttgtggcacgagaacaggttcatagaggccctctgttgggtcagattttaactccatatccttaggttttaaggagatccatggagtctgtggcagagggaccaaggtgggggagggggtgccattgatggatcatagatgggactcaccatctagctgggctgttgaggactccatattagcctgggagtttagtactggcattctccaagacacacgtgaagaaattgaggttcagagaggtgaccttgccaaggccacacagctagtaagctgtggagctgggattctaactcagatctggttgactcagaagtccagctgggggtaatgatggcaatgaaagctctagagttggaagagacccagacaaagcgggtttggggctgcttcagcgaccaaggatcttggggagaatcctggcccacgagaccacagtggattcacctgggtgctgctggccaagagtttgagtgtgagtgtgtatgggtatgtgtagggtgtagggtatagcacatgtatgcagtgtgagtgtagagtatgtgagtgtgacagtatatgtgtgtttgtgagtgtgtagagtatgtgaatatgagagtatgtgtgagtatgagtgtgtctagtgtatgtgtgtgtgtttagagtatgtgtagagtgtgtatgtgaatgtagagtatgtgggtgtgtgtgagtgtgtgtagagtatgtgaatgtgagagtatgtggatgtgtgtgagtgtgtgtgtagagtatgtgaatatgagagtgtgtgtgagagtacgtgtagagtatacgaatgtgagagtatgtgagtgtgtgtgtatgtgcgtgtgtatacagtgcctccccaaaggccccactccaccagcagcctgcccatccatcatcataacgggcgtggaagcccattccattcctgctgagccctgccaaaaaatcagtgagggagagccaggaagaatgtgcgccgggaggagcaggcagcgtgttgcagtccgaacggcccactgtgatgatttgggtgacgatggggccagcggtgccaccgagactctgatggctccttaggagttgttatagtcacaataatagattgttctctgtttctcaatgctaggtccattctttaaaatttttttttcttcctttagaggcagaggaggagatggagagttggtgagattaggattttaggtgtcttcaagtcaattctgaaactctaagaagaaatagagaattctgagtgattttaatttttctgcagtcatggggggaatttccatagggaagatgctttccaaggaagctcatgtgtcttggactctgaaagagcccttctcaggcctggttctggcatttgtccatggtttggggaaggtgggccctgggtgggggcaaggatgtgacttttggagcaaggtgtgggcactgtaggctcaatgtggttctgctggggtggtgttcttgtggctgaagaatgtgtcccctgagttggcacagtgatgcatgacataggatggaccaaacggaaggcatttcctgtcactgaaattaaaggagcaggggggtggaggggaagcaatggagcagaagaggagtttggttctaggagcattcagaagtcttgggagtgttgggttaggtgacacagttcctgtctgtcctggggctctatgtactccccctggagatttcactggaactggtgatgtcccgtgtttagggctatctctggaaaataaatatgaacataaaataataagaggctgaacctacgaaggaaatgaactaaagtcaatacacatttttcccagacaccatacaaggtcctgcaaatcactgggaaatgaatgggacacaagacatcacactccatgcggtgagctttgtgtttggtttttcccagtcattggctgtggtgaatcatgtgttctccctgtgttcaaatggctgttgagagaaaggtgtggatgttggcagctctggggaggagaccagtgatgacaccaattgagggtgcactatggtgtttagatcattggcttttaaaatttagtcaatgacttctgaagtgggcctttttgcttccagctgacagacatatcagagtgcgggagacagagtacccaattccaaccccaacatcctgcccacaagctgtgggaacctgagtaagttactcacctctttgtgcctctacttcctcatctctacctgggggaggcagtcaacgtacctaatgttattttcatagtaaggctgttgcacagaatagatgagttcgtaggtatgaagcccttagctttgtatctagcacattctaaatgataaaaatattggcattactgtcactaatgaggatattgaagatcagtgaagtgagggaattctcccaacactgggaagaaagaccacagcaggaagtaagctctgggaaagcccatgctgtctgattctaacaagaaggatgctggcgtcctcctgctccgagatgccaggaactgtggcctcaaacctgagggacaattctaaactccatctctagacaaagagtagttgccaaaccaaataattccgcaaaatacacatgccagtgcattttcctttctttgtcttaatttttatggatacataatagttttatgtatttatgaggcccctgtgatagtttgctgtgagcacacaatgtgtaatgatcaactctgggcacctgggataccatcacctcaaacatttatcatttctttgtattgggagcatcccacatattctcttctagctattttgaaatgtagaataaattcttgttaactacagttgccctgttgtgctactgaacactagatcgtattccttctatctacctgtatgtttgcacctatcaaccaatccctcttaatatcccctccccactacccttcccagcttctggtaactaccattctactctcttgctccatgagatagttttttagcttccacatgagtaaggacatgtcatatttgtctttctgtgcctggcttatttcacttaacataatgtcctcctgttccatccatgttactgcaaaggacagaattccattcttttgtatggctgaataacatttcattgtgtatatgtaccacattttctttatccatttgttcattgatggacactcaggttgattccgtatcttggctattgtgaagagtgctgcaataaatacaggagtgaagagatctcttctgtgtgattgcttttcttttgggtatatacccagcagtggaattgctggatcatatggtaattctatttttagttttttgaggaaccttcatactgttttccatagtggctgtaccaatttacattcccaccaacagtgtatgaatgttccctgttctccacttccttgccagcatttgttattttcagactttttgataatagctgtcttttaaaaaactgaattataactacttccatccgtatttttcggaaggaggggaataaacttcttggaccaaatctgatgagtcctgagatatgtggggtagatgaacaggagtcaatggtgggaccttttgacttttgagccctggttggagtattttgggatgttagagcgtccttctggaattaagatgtgcttagtaactgatgtgtggttgctactggagtgtgtgcatgtgtgtagaatttaagaaattataattcatgcgccaccttcatataacatattcatgtaaagattggcacttggtgaatctccacgacccttatagcatccctgtagtttgtaggtgtggttgtagatataggttgtagattatgggttataggttgtaggtatatatggtatagattgcagttgtaggttgcagggtataagttggaggtacagggtgtaggttttagtttgtagttatatgctgtaggttatagctgtaaatggtaggtatgggttgtaggctgtgggttgtaggtatagattgtaggctggaaacagaaagaacattgatcaaacgtttgtcacttctttgttttgggaacatctcaaatattttcttttagctattttgaaatgtagagtaaattattattaactgtagtcgttctgttgtgctactgaacactagatcttattccttccatctacctgtatttttgtgcctattgtatagatagacctggaccttgaacccagaacttttgatgcccaaatccctgatcttcctgagtatattaggttccttcaggaaaaatgagatgcttttcagtggtaatgtttatgcttcgctataataaatacacataaacgtggatagagaaaggacctcgtatctagtttcttcctaggacaccagttggttatcgtttgatgcattttctttaagcctgcttgtaccaattttttaaattatttcaacttctttagctctgactgtaccctctgccaattttgtatgctgccttctgcctcccagttactataacaaacatctcctatgtaaaccctttttatgactacattctacttggtatggctgcaccataatttctctagtgtaggatatttaggctgtttctgctgtttggctattataaataacatagcaataatcatctctgagctagaagttttcctaatgattttatctttaggtttctgggatgagcatagggctggatgtttgccaggctagggagaagctggggaggagcctggtaacgccctgagggggaagcctggcctggagttacctggctgcctggctcaagtgtgcccttggcaggggctgctggcctagaggccagcaccaagcagcatagtgggccagctttggcatagatggagcaagagagggaagggttctccctctgtaatcaggagtagaacattcaggcatggagctaagacaaatgagtaccttttagagctttggctctatagagacagtacaggtggccatgaggtggtaaggaacagtcacacatttatagcctccccacagttcatccttctgatatttctgccctgagttaccaatgagcaacaggcagttctctcccacaaagcctaagcagggggagttcatcctcctttgttaggatttgattttatcagagggatatttggaggtcagtggctggaagaataatgctgtcagagtttggtgactcttgccgggcagtgatggaggtgggggaggggcagagcctggcacacaaatctggggaagagtggtgggatgcgggaagaaagactggtccctgtactcaaggagattaggatccttagggcttttacttccaacatttactgttcctcctcccgggatgcctgccttcctcttgtttggcttgtgtttgcaaatgaagcagacaagttctagagaagttaaatgatttgtcctaagtcatgtaatcattgactagggaagggaaactagacccggagctccagcttcacgggtgccctttctcctgtgtcatgcagccgcttctgtgtgttggctagtctgcccagtagactctgctccttggggctctggttgtgtctgaccttgttgaatcccctgcatgtgtagtatgaccttgttggggtgtctcaacactgggcatgttagcaacactgagggatgaaagcactgtcatgccctggatggtcagccctggtttgttgaatgcacgagtgttcatatgtcagaaatacatatgcattcactctacaaatattttcaaacatttattatgttcccagcataatagtagagcttctactattgcaggggagaaagtcttcaataaaagttatagaataattaattacagatggtagaggagctaaggaagagagtgatttcaggttgccaagagaacatactcagagaggcatgatagcttttggggaccctgtcagtatcatcaggatagcccggactcagaagttagtctctcatagagccaataggaaggttttggcaaatctggattttttcacttgcattctggttttggttctgctattgactatcagggttactttgaaaaaaccatttgcttctttatgtcttgcttgctttatctgtaaaatgaagaggttgtaaaattcttctgtaaatcatttaattaccaccctcttcccccatggaaacaaacctagaaaatcctaactttgctttaaaaatattcagtacatggaatattttagtgttcatgttttctcttttgagtggggtttggccattggctggttcttggataaaatttggagggaggtattctccaggcttaaatgagtgaaaaagtctgggaaaaaataaaccaaccctacctccttcccacccaaggagtgtcctttgcatctggcatcgctgtgttttcattcgctggtcagtccctcatctgctgccaacctcttcccttcctggcttggtcagaaggtccagagagcccactgtactggcggggagaatctgtcccttttgcgcacatcattgggaactcaaagtcatctcgtgttggagtcaaatgacgtgttagcacacgcctgcttgggggatcctcctgcagttggcatattgcgtgacacacggggggattctcatcgtgctggaatgcatggccagccccttctttctccaagcacagttcagtgcattttccccccagttgctgcttctcgtaggagattatttctgattcgtattgagttgttactggaaaacacttcagagagataatgagctgggtagttttcctcttcatttttctttgttgttgttgaattcatatgggtaactgggctctccacttacactttattgattcctgaatttagggcatagctctgtaattggcaatttcctcagtgccacgtgggcagagagaagtactgtgcctggggctgctgactctgcaggaagctgtaggggcacttccttttagccctggactgacacagctgagtgcccgtgggcaagtcccttgttgcctctttcttggctctggtttttccttgctgtcttgtgaggggtcagaccagatgactttgagcaccagcccttccagttcttgaattttccaggctaggttggaagcccttttctttggtgggtttatgcatgaagggccgggtgtttctgtgttcacggatgacactgctgatcccatgtgctcttgtcattgttttccttggagggctgagggatgtgtgctgagtcacgcacatgcacagccggagtcccttgtgactaagctgtgcatttgcaggagcgctggcagggtcggtggtacagcctctgaactgggacagcttgaacccagcgttgcctggagtgggaataaaccttgaccttgctggcgtgggtgaggggcacctgcccagggagctaactggtctggactcatacagtgctctccttctgtccatttcagtatgctggctgtcagctttgtttatgcatagatgaattactctcatttcagattatcgtggaaaatcttgctgtcaagttcttaggacaggattaagtagaataggtgataaaggtcattggcattatttacaatctcttgactttcattcacccccatctgctgtagacaagctggatgcttacaagagcggcaaagacttgggacttagaatcaggcacacccaagtttgaagccccgcgtggtgctttctggctgcgtcaccttgaacgcttgcttccccaagtctcggtttttctaaaatggtaggaaacagctttgtttggcctaagaggtttgctggtggagactaagtgagctactgctgtgttttgccacacctcaatgctggtgggatgcaagatgctttgaggagggacacagacgaatttcttattatagttgtgtatttgaatacacttgtggaaaaatagaactagtacatcagagctcgtgatttcacagatattattgcccaggacaatgctaatttgaaaaaatcgagacaatttcaagttgatttcaaggataatatgcactgaatattagtgcaggcaggcaggcggggcagaaatcaggaagatgggagagaatgacagaatttggagtactactgagacctacactacaggtctcctatagaacatgtggtgggagcagaataaatgcatctttctctttgtgtctgtcctggtacaaggaatgtttggggcattggtataagaagctcccagagaaaaggtgatggtgacttagctttgtgcactgcatcaccctcacaggcaacgctgtctgctctaggcgtgacttgcactaagtgaatgtggacaagatggccactttttctagatccttctggggaagctgttagttgtaatagtgttagaacctaagagctagaagagactttggagatgatttactgcattttatgttagacttagacaatttttttacaaaagggaaaaattaaaaagccccagagagacctggacttactcaaagccacacaagtagttgagcacagtggctgagatgaatcattttgtgtctttccccaaggatctctctttccttgtccctctgtctatcctggtcaatagcatcattgtttgaagtgagtttttggaacaggacccagctgcattcggtgggttagtccagcaccacaaggatctgtcctttagcattgcctgtgtctctggccttctcgtgttagttagaagattgaggaggcaaccatgtagacactgctggaggaagaggaaacgaatttaaaagtcacaagttttggcctcagatgcctgtggtgttgaacattattagctttgttgtcggggcatgcgcctgacctcccggagtctcaatttcctcctctataaggtggcttttacctctgcaggtttgaatgaggtaagaggtggggagagcctagtacttggctcccttgaagaaagtagcggagactgaatccaaggccaggctgtccactccaaactgggattaggatgtcatggttcttcagcccctgactttcctgacaaaggcccacgtgggggctcttggttggcctggtcactctctgcttggggtgtcctcattcttttccctggagaggttctgggatcaggggtgagaatggggttaagttatctaggaattgagagtcccttcttcataactaatttttctttcctatctcatgacttctagataatagtctgtagttttaactcatttgttatttatataatttctctgtgctcggctctaagggtataagagtaaattagatctggcccttgcatggaagaagcttacagctgaggtggggagctctgtctagcatgcacagaacatggtgctttgacaaagggtaggtgccggggagtgaggtgggagccctgaggaggagatcttaacaagggaaagccttctacagcaggcaggggctgagctgggtttgaagggctgagaggagctaggctggctgaggtgggagggtgctggggtggcaggggctgcactcctggcagagggaatagcacaggaaaggcccagaggtgagctgggaaaccacaggcagagtggtgcagggggaaaaagaggggagggcaggaacacagtgggggaacttagtgcataacaacaatgccctcaacccttttgcctggctcttcaccacgtgagaggactcaggggagaagagtctgagtgctgtgccctttctgaattctttttttttattattatggtaaaatatacacactataaaattgaccattgtgagattttaagtatacaaccagaattctgttcaaccatctgtgctacttacttccagaaccgtccagcactgcagatggaaaccctggaccaatggggagtcactgccgttctctcctccatccagcctgagaacctgtgatctgcttgctgcttcttgaggcctatttggatatttcctatgagtagaatgataggatatgtggccttttgtgtccggcttcttccacttagcataatgttcttgaggttcacctgtgttgtggcatgcagcagtactccgttcctttagttctgtgcatggccacaccacatttttcttattcatacatcagttgatggacatctgtgttgtttccgcctttggctattgtgaatagtgctgctatgaacacttgtgtacgagcttttgttggtatcttttcttttctttttttttttttttgagatgggctctcactctgtcacccaggctggagtgcagtgacacaatctcagctcactgcaacctctgcctcctggttcaagcgattctcctgcctcagcctcccgagttgctgggattacaggtatccgccatcacacccggctaattttttgtatttttagtagagacagggtttcaccatgttggccaggctggtctcaaactcctgacctcaggtgatctgcctgcctcggcctcccaaagtactgggattacaggcatgaaccactgtgccaggcctgtgtttgatttggggtatatgcctaggaatgggattgctagatcctatggtaatgctgtgtttaacttattgaggaaattgctggattcttgaggatgtgtttcaggtccaccctctgttgttgccttgaccttgttacttgctctgttgggtgcaagctctgaggcatgggctagacaccttgtgccaggtcctgttttccatcctcacaagcaaccccaggtggtgggcactcttcttggtcctggttttcagatgaggagatgcaggcacagagtggttaagcatcatacccaaggtcacacagcttgtgagtagagggtctgggaattgaacccagacaggctgtccagagtgcagtctctccccaacacaccccatggtgcctcagagacaggagtcccatagacaacatcctggatggagcctgtagcctcctgatggtggttggaggctgtgcgcacagcatggagcccgagccagcccctggggatgagggctgcaccagggcccactcagccaccctccaccctgtgttctttccttgccttgcctcccctctgcactccttccttgtgcctcctcctcactccccaccagcctcacctctctctcgctctctctctttctttctcttttaataaatggaaatggtttatgggctcttctagaaattgcacctgccttctggttataactggggagagagagaggaagagacacagagaagagacagagaggcctccttcagcagatctgggtatgcccatgggacctcctggcctggacatcctggtggtgctttcaggcctgccacagaagtgaccctgagttggctctggctctaatgtctgagagtgccttcttcccctctccccctgtgactgcctgcaggacagcgcaattcctctgccattgtgtaagcagcccccacagatgatactccatgctagggaattaactacttgttgaaaagcacttgtgtgttcccctggctgaggctgaaagtgggggatccctggggaagggggtggcctggctatggatggggagaaggccctctggggaaatgaagaggggagccccaagccagttcgtcctgtgggagctggcccagattatggttcataatgtaaatttgggagtatgccagggccatattaatactgcatgaggcagtaaggggaccttgggcttgaaacccgagctgtggcctagaatggaactgaacagtgggccttgtcttaaagggacatgacgagctcccagaagtatgtgtcggcattatttccctctaatgctgtttactatatttgtacacaatgcccccaaaggatttgaaaaggaaatggcaatgtaataagagaggtattttttgttgcacatgcgagcatgctcattgacttaattattgtttcttttgttaccttggtgaattagagagggggagatatggagagggaggatgggaagttggagagggggaagagagagagagagagaggagaaggaaacccatgtctactgttattttgctgaaatctatctcagcgagtaggcagattgagaaatcaaggattcattcacaggtagaaaaaaatgaataacactttgaaagctcagaaaatcaacacaacagagaattcagtttcaaggtgccacttttgactcttctgctgctctttgaattgagttcatggctgtgctcatcgtctccatggagaagggcaagtcagtgccatttcttgtaggaatgatcgggccactaacatttgtctagaaaccaagcaaccgaaaagtgcaaatatctggatgctattggcttttgagaaagaaaggatgtcaggcatttatttgaaagggtaacctccatccagatagtgttgtagagcattttctcagacattagaaagattcaactgtgtacagtagttttagtgttgagtgtttcagaatattttcattctttccaaattgggggtccactacattagttagatgcttttgattactaatgatcaagaacactgactcaaattggcttagacagtaaggaaatgtatctcccataagagaacagagttgggggaggaaaggctccactatggatggatcagtggttcagtgatgtggatgaggccctgggccctttcttttcttcaccctactgtccttagtgacagctttataccaagtctgatttctctcatggccgcaagatagctgcagtggttctggacatcacatctggacatggcaatgtccagagtcaaggcagggaccatctcttctggtgaggactttatatatagagaaaatctttctccaaagcccccgatacttctcccatttttctcattgaccaaaaccaggccacttgcctggctccaaatcagtcagtgtcaatagaatgggaatgccctgatgtaaactagacaggacccaccagctggtgagggaatggggtcagtttatctgaggtgcaagacactgtggagaaggagtgggaacctggacaagatggggccatgttagtaacgaggaggagggtgacatcttttgcctccatgaatagcaaagggcagttctcacttaactggggtgcacatggcatcacagaatgctagaacttggaagggaaattagagacaatcttcttcaatcctttcattttacacatgaagaaactgagctccaggaatgaggaggagttgcccaaactcatggatccaccctgggccccaggcaccagctgtgtggggccagtgggccgttgaagcactctagtcaatgccacacagcctgggagcagtaccagaacccagggtgggaaaatgttggcagggcttccagaaactacttgtagggcctgtcattttcattcaataaatgtattgatcaaccattgagtctccaaccctgcactttctgggtggttatgagaaagagtaaagttaaagaagcctcaaggcatctggaagagaacgggttccaacctgtaaggacatattccaggctggatgtgctttctcttctggagataattctcattttggtctcttttttcatattcttactgcctgattccaaggacttacaacagtgtctagaacacaactggtatccataaatccatatggaattatattaattagaactgcatgaggtccagaaagtattgttttcatcttattttaatgtgtatacattggctacaaaattaagtcatggtagatatcgtccagataaaattgtccaaagaaaaatcgaacacggtaccttactgaaagtgagctcatttgaggactgtgatcttgatggttgggtattgactgggttagggggtcaggcagtgacagcggcttagcctgctggtgctgagggaggccggggatcatatccgtgcaggtgatccatgacagccctcgaccccagtgtttagaggaagtggatgggctcatattatttcctcctcttccctcccgcataaccctctgagtagtctttagagccttctcttaccagctaggtggctctcattgtgcatgatgtcaattgcagaaaatgtgagtggggaggtagctgatagataatgagacccaggtccctcagtcccgagctgccaccctaaataaagcaataaagcaacccacaagctgcatcagtgtgcctggtattttcatttctcctctagaaacaggtttctagggctgtcgagaatttggaactcataccacacataccaccatgctgaggtttctaaattcaggctgcggtttctgcatgtttttgagagtgtcagaaacttcaaaacatttgaagagtcccagaggagaagggaatattcttcttcttattattctgagagagcatagtttgcacattcttggcttcttcagcatttggatgctggagctctgttggtctgaggctgaagagcaaactctgccaaagcttctcttaccgtggggatggaaagttttctgtgtctgttttattacttaggcattccacgttctccttcgacatctcacatactcctgctgctttcctttgtgagtggagacctcgctttctttataggtggtaacagctgtgttctctagagagtgaatttttgcaccacaacccctattctcacaataacttcacttggacatcgaggataagtttccatgtgagaaatattgtttagtcatttattttaaaaaagcttttaaattatttaaaacaatttgtgggttacatagtaggtgtgtagatttatggagcccatgagatgttttgatacaggcatgcaatgtgaaataagcacatcatggagagtgaatattcatctcctcaagcatttatcctttgagttacaaacaatccagttacattctttaagttattttaaaatatacaattaagttattattgactatagtcaccctattatgttatcagatagtaggtgttattcattctttctatttttttgtatccattaaccatcctgcctcccctccaatccgccactccccttcccagcctctggtaactctctttctactctaatttgattttttagatcccacaaatatttttacttttcaagttgaactatataatatgatactaaaacttgaacacaccacaaagtatatgcatattcaaaactgaacacacccatggaactaacatccaaatcaagaaacatagctgctttacactttcttgaaataagcacttacctggagatgcaaaggcacttgcgtgctctttcagtagcatttctcttctccagcatcttcccttgacatcagccttgcctgcacattgcccagttgggcaaatttctctcccaggtagaggttaccaggcttgcattccctatgttttagcttctgtcttggtctttctgtgtgtttttatacctccatttgaagcaaacccaacacatgaaaagctatatttaccaatgggaccaactattggggcagtgtctacttactatacatatttttaaaaaactgtttctttaaattggagagctccaaggtgactgatgttaataatttataactatttattaagcacctactatgcggttctgtggtgtgattgcaaggggggggggcacgtccaaggttgagtaagacatagcttctgttcttaaggatgtcccagtctagaagtggagataagctatgcatgagcttgaccaagatcttgctacaatgaaagatagctgggaagagcatgagagagttcaggggaggaaaagaccactcccacctgtggcatggagggtcattcaggaggactacatagaggagggggcactttacattggcacttagaggaatctgccccttgatgggacccaaacttacatttatgatgtgaaaaatggaaaggagacttgttatgctttaacagtaggtgttgctatttaatgtatgaagcttactcaaatggaagagtttgggtttattaaaggaaattagaggtctctgtgttagcagttctgtatgttcaaaatgtgatacaatgggtttacttaaaccattggttgccccaagacccctttcttgaggaattggcagcttggcagagtttgcacctttgaaggctgccctgcaaggataaagacctccatccaaggggaaaggccagaagcaggctcagagctaggtcccacaactctgcttccctgtatccggcccccctgccagctcactcaagcaagccctgtttctgggcagcagcagctgtgaggtgtgggtgaggggctgttgctaggagcagggatccagcttgccttttctgacacgtgtgtttaaattagcatctttaaatgctgttcccgacagttattcaattttgaaactactggggattttggggcaggtggagagtgttaaggaggaggcgaggcaaatgaaaaggcaaaacatttgggggagtttttgaaaaagttaaataaggaaaagagtgtcagctgggggaaagcacatctcaggccccattgcaggaccccttccccagtggagtcatagagtcccctactctgccccaaggtgttggagatggctcatggctcatgggaatgtgcaggaagtcccctgagtcttatttatttatttatttatttatttattttgagatggagtcttgctctgtcacccaggctggagtagtgcagtgacatgatcttggctcactgcaacctccgcctcctgggttcaagtgattctcctgcctcagcctcctgagcagctgggattacagggacctgccaccacgcctggctaatttttgtatttttagtagagataggttttgccatgttggccaggctggtctgaaactcctgacctcaggtgatctacctgcctcgacctcccaaagtgctgggattacaggcatgagccaccgtgcctggtccctgagtcctcttagggtctccagaaatcactatatcaagtgaggtttggggatgggcacatctaagtgataaccacccactaggcaaaaggatcctggtgttgggagatggggtgagaaactggggtgggtgtcattcattcaaccgagtcatcactctcaagggaccagatggagaaagggaatataataagaaaaatgatgatgcttaaaataaatattgataatgcccacattttcagggaacttctatgtgccttagatatttatttatccaagagcctcacttctttttacttgtccgatccttacagcagatctccaaagaggttctctgttatccatggtttacagatgaggaaactgaggcacagagaggcagttaaatcacttgccccaaaccactgaagccataattggcggatctgggattgaagcccaagcttccgggcactagtgtgtgggcctctaatcttgcactttgctgccaccagaaattaggcaccaggatggtaactgaggaaaccagacaagagtgagaatgtaggggtggaggatggaagatgggtatcagggaggttttctgagttgaagacagtctgtcctgtggcttcttaaaggttgctttcagatgagggtgacacaaaggtgtccccctgtcctggacatgatttagaaccctatccacagagaacatgccaaattttatgcacctcagggcctttgcacatgctgttttctttggctggaatcactgttctccctgctttgtgtgttatggttctttctcatctgtcacacttagtttaaagctgcctcctgcagaggctgacacgtcgtagcagttgctccatgaaagtgttgagtaaatggatgaagaataaagctcttggcctttcagggaataactataatgagaaatttggaagatctttctgcagctgagcctttggaattttgatgtcttccaaaagctggggttgttaggagaagaggtaccaaagtggggcttcatctgtaaagacccagctggagctcttgttcacgcctttccctgaggctggaaggtctcttggatgtcacaggctgcctctttaaaatggagacagtggtggactttcctctctgttgaggatgggaatgaggatgagggagcaggcttggggtgagcctaccatccaggggcagtgaactttatatggcgtgggatgaccagtggcctcccctggggtggctgctggatattggctgatggatggtagaggaaacactattctcatctcaattcctggattggtgtgggggccaaatgagatcccatcattcctaattaagatgtagttacattaatgataaagacaacaatggcagctaatacttagagagtgctgctacctgctggtcactgtgccaagccctttagtgtgccttatccttgagtcctcaccagcccctatgtgcaggaacctgctgagatgaagtgacttgcccgggccacacacctggtaaagttggaaaccaactggagccagccccagacctcacattgcataccccagacctcacactggataccctcacactgcacaccctcacactgcataccctcacaccacatatcccagacctcacactgcacaccccagacctcacactgcataccctcacactgcataccccagacctcacactgcacaccctcacactgcataccccagccctcacactgcatatgccagacctcacactgcacaccctcacactgcataccccggacctcacactgcacaccctcacactgcatactccagacctcacactgcacaccctcacactgcacaccctcacactgcacaccctcacactgcataccccagccctcacactgcatatgccagacctcacactgcacaccctcacactgcataccccagacctcacactgcataccctcacgctgcatactgcacacctcacactgcataccctcacactgcactgcatactgcagacctcatgtataccctcacactgcatactctcacactgcataccctcaaacaaggcccttttctgactgtcacttgcaccaaacagaatgcagaagttttctaacttgaacctttgaaaattttttctgttctgtgtttcacgaagggatgtgttaattgttgaggtaattgcagagttccctggctttataatcactcatgttatttattgttcttgttattattagtaaaagccatagtaattcagcctttgggttggaatggcagcaggagccagctgagtgaccttggccgtgatattaatactctttacagtcttccctcgattatccaggctaatggaaagagaaccagtgcccgcaaataatcataaaacaaaaaaaaaatcaattatcttctcagtggagtgttgactgacacgtgggtcctacgccttttatgaggctggccttcaaacacagctgcatctttggtgatatttcagaaagcgtgaggtgggaaataatccctgttttgcaagtcaaggatggagaaggagcctttcatctctggatagagatggtgtgtggatatcaccagctgccaatggaggggtcagtgctgttattctctttcctaaagcaactcgggggtgatggagaaggttgccttaatcccctctgagcatttcactggctgatgtggactcatggaaaatgtcagcgtgctggcccaggccaggcgggctgaagccagtgtgtcttacagctctgtggagcagacgtggtgtgtggcttgaatggaaaggtcataaaggcctgggacaagtgagtggacggagccaatggcactgtctggtaacactatatggaagatgaaattgtagtgtggagctgagaggtgcagggctggggaaagagacctcagcattttccatgattaactttctaatagtaaccatgcgtggacagtgggtgctgggcagcagggagacagtcttctccaagcgtgcattcatacagtgcaggcggcttcccactatctttgggttttctccattttgtctgaggcagggatcagaacatagacctattgtctttgatggcaaagtgaggaggcagccaacttcatgtcctcctaattgactcatttcctccccgctggagtccccaaagcataggtgaccaagagctccctctcagctctaagtcatgaagaaacggatgcttagagaggttacccagaagctggggacagagctggcaccacacccaggcctcctcccttccagtcctgtgcttgggcaggcagcctgtgggcttcttccttcggccctgtccccttccctcagtactaacacgtgctcctagatttctgagcagcccctagagagaagtgacggattcatactagagtgttcatgacttcatgtatcacttgcctgagagtatttttaaatggatgctgggggagggcattgcttaacccaaaggaacaagaagtggactatgaaatttcagtcccagggcctgccatgtgttggcctgttctgggtgctgaagatatagtggtcagcaagacacacatcctctctcctttgagacctcatatttcactgggggaggcagaaacatagtaaataaataataaactaacttcagataatgagaactggttttagaatatgaaacaggctaaggggatagtgatgtgagtgcaatggggaacctgttttatgtagttggccagggagggtctttctaaggaagtggccaatgagtggaacaagatcaacttgcctggaaaaggaaactatgggggatctttgagggaacagtacttcaggtgtgtggaacagcagctgtgaagcctctggggagggaacgaggctggctgctggagagtttccttggctaccctgattaacggcccctcttcctgcctcccttccctattttattattttctctggggcatttgtcaccatcttatatttgtcttaacacaccttatatttctcttatcagtttggcttatcgcctgtttcctcaactacaatgtctgttgcatggaggcagtactttacctgtgtttttcagttctacaccctaggaatgtgcctgggaaatagtggtgcttgatacctccttgttgaatggggaaatgaacaaatgcatggactcagcaagcaaggcagacggtgggaggagatgtgaccaggaagatgggcaggagtcggagggggagaggctgagaacacgggcccttcagtgtctgtgtccttgtctcactgctgctgggaggggctggcagaaactggccttcttgccccatgagccccaactcagcagaaccacccagcaggtcttagcatccccagcctggctgctcccagtggatgcaatgctcattaaccatggagctggtaataacacgcccatgtcctgcactgcactggtgcctcaaatctatgtgttcagccttggtgtaaaatcactaggagccagggacagagggattccagggaccccacgcccagggggcctgagaggctcatccttcgtgtcagcttgtgttttccaggggtggttttgcctgcccggttactgctgtggaattgcctctggcccatttatggtggaggcctgggttccggtgacactgctttctttctgtacaccttgaatgaggtcaggcagctcttcatagagggaggaactcttcctggagtgccaagggtagggtctgcctagtcccagtctctccagcctgagtttgcatcagggagaaaaagcaccagcacctttttcaccaatgcgcccttccccacattcacacacgcatgttcacatgcatgcacatgtatgcaggccggcttcccctcaccttttgttttttttttttttgtaaaaaacacacatccctatgtccacaaacaccctcaccctcacttcctccctcatccacagacacctgttccccagtgatgcacatttgctcacacacctgcagctgctcacacatgcctgcatgagaggccctctccacccttcagtctcccgtacaccggcaggtgcccaccccacaccagccgctcacacaggcacccccgttttagcctcttacacttgcacagggggcccttcacctgctttgcagcaccggagccggagcccagacacatgatgaggcatgagaagtggaaagttctgcaggtgctctgcccaccgtgcaaaggaggaggcagaggtccagctgcctctcagcatatagaggctcagaggcctttgcagcatgcagagcttttggaacgtatcttactttctcattcttaaattcattcgggtaaccactgtttactgtgcacctaccatgggtcaggcgctgtcctctgcaccgggcatactgcagaaaacgaagcagatgcaggccctgccctcattgggttaggtctagtagtggagacagaccacagacaggacaaatagggaaacaggagaagccaggtggccataagtgcacaagcacaaatgaaacagggaatgggaaaaaatagtgctatggagggtgcatggagagaaagctctttgttaaggggagtttggagcagatttcaggaaagggccatgttgcaggcagaaggaagagcaagtgtggccaagacccaggaaggatgggaggagggtggctgtggcggggcggagtaggggggtgggctgtgggtactctacatgatggggatttcttaaacatctgtcagacccaagagactgtgatcctctgaagcccctggatatgtcaaattcatctcagtggccttatgcacccttcgcatgcacctggtataggccagtgctcagaaaacatttgctcctggagaagttgctggttcagttctgtgtggagctgctctgtgttccaagatctgcgctggctgcagggataacagggatggaagagaaccagcccttctcttgaggagctccctgctagtgagggtcaatcaagtgcctggaagttgtgtgtgggcatgcagagtgcatgatatgccaggtgccgggaagcctcccagcccaggggctggagggaggggcactgcttagtgggcagctctttggaggagctgatgcttgaacagagtcttcaggaaggagaggagttagccctgggtggggaggcagagaaggaaagagacactgaaagccgaggggtgaaccacaaatatttgggaaatggcaccagcaaggtgtacagcaggggtttccaaagagttcctgattccctcctcaaagtgatgggagccacacttcctggcttatcagttggtccttgccctctggctggtgctgtgtgtctgagaggcagcctaggaagacctctctggggagaagcagagaaagatagcgacctctgaacgtgctccccagaattcagtcaccccatcctacctatgagaggggacaaactggcagtctacaggtgtgtttggtttagcccatgtggcttcattgttttttaattttttttttcatcaattgcctatatttacaaaggagattttggataaaaatctggattgctagctgtttttgaaaaaataaaagattgaaaatgtacctttgtgtgcctgtgtcccctcatggtgatgattggtttgggcagagccattgcacgctctcctttcccccccatcccccggtgctgaatgcagcacccctcactcaccgtaacaggctggctcctgtagacacatgaccttggatccttttttggattaaggaagcaaacatgtaggattgtgcttctgcaaattctcagagatggcttttgagcccttaagctcttctggggcattctcatttctcaactagagctagcgggtgagagccctctctctgttttcatctgctgcaggacagctggacttcactgtatctcataaagaaaaggaggtggggtgggcagggccctaggctgtattactggaaaaaaaacaaaaaaaaacaaaacaggcagtagctcctggtttctgtaaaaatggtgtctagacgtgagtgaagaggcagaaggtcagaggggatttggaaatctcaaaggctgagcacagagcgcccacaggtgcaaggagaaagtacagggccagggccagagatttcctttctcttgttcctcagcttattcttaccctattccacccaccctgccactgccaggtgctcagcgagtctttattgaaagagagattattaatatggtgaaatgtctgagatggttctctctccgcatacccagtaatacagggtccctttggcttgtgggagtcacatgtggccattttcagtagttgggaagcctgggggccagctgggagttgtcactgcgttgggaatctgcctcctgggcctttttattaaggcgtggagttgtgtgctgttctcttacctctggtccctgcttggaggaagaggctgaacttgtaccacctgggcaagccagtttgctgtgaccacacatggattaggtgccagatgaccacctggggaatgtgccagtcaggcagccaggatgcaaagtgattcgcttcccccttgccagtattttctagggcgtggtgtttgcccgcatcttctggtgaggcctggctatctctgaggggcagaccagcacacctgtgggtgcagcagctcacaggagtctgttgggcggcactgccaggccctcgggaccctgagtaaggtctgacgcatcagggcaggcagaggggaggccacatttcgcctgccactgatgttagcggggaggccccagacccaggtgccaggcgggcaaattgatttttcagcctgcgaaacttctaaagataggcacgggtggtgctctgtgctggcactgggagtgacaggccatctgtgagtcacagtcccgcccgctggaggagtgcaggtcctgggcaggcagcactgcggtgagaggggcccagatgcaggaggggagggctaatgcaatgagcttgagtcagccctgcttgccaggccaggatcctcctcccaggccggcaccaaggagagtgttctactgcctggctccaggaaaactgctgctgcctgtaatttatgcagtttctatggctgagtggagcagacatggcctgaatggatcattggagtggtttgtgcttccctcgccctgtggcctcacatatttaacaaaattggttgcttggtttatttcttgaatcatcacttgaaatctctcagcttcattctgaattcctcatccctcttctccccttgtttcctattttctttgaattatttggctggctctttttgatatttgtgacattatcttacatttatgcagcactttacagtttgcaaagctctttcacatacattatccaggcaacacatatttactaagctccaaggccttggaataagtgctaggctcccgggaggcagcagtgcattcgatagctacggtggctgctctcagggagacagtgataagctactgctaacttgtaggaagacaatagcgtgagatgatgctgagggtttctttgtgatggatgggaaaagcctctccgaggagaagacatttgaactcagaggaagccagccaggaggaaatttgggggaagagcgttccacgtagtagcaccagctagtgcaaaggcctggtggcaaggattagcttgcttgtttctgaaacagcaaaaacgccactctgagtggagtttagggcatgaggtggtgatggtgggggtgggggaaatgctgggtagggggaggctggcaggggccgtttttcagggctttgttggccatggtgaggagcttggatttccttctcagtattaggtgacatattggaggaatttaggcagccacgcgtgtgatctggttaacactggtgaagttcactcttgtaacagtaaggccagggagtaagggcaggagtggaagcagaagggcccctcaggccactgcacttgtcctggtgggagttaatagtggaacggtggcttggacttaaggctcaagtcggatataccgtctcagtccttactatctggaagtccaagatcatggtgttgacagggttggtttcatcacaggcctctctgcctagcttgtaggtggctgtcttctccccatgtcttcacactgtcttctcagtgtaagtctgtgccctaatctccttttcttataagggctccagttatattggatgagggcccaccctaatgacctcattttaacttaattacttctttaaagaccctgtctccaaatacagtagatgcccttatctttaggggttacattccaagaccccagtggatgcctggaactgcagatggatagtaccgatacctgtatatactgtgttttctcctacacaggcatatctgcaataaagtttaatttataaattaggtacagtgacagatgagcaacagtaatgaataataaaattgtgcaattataacaatatactgtaataaaagtcatgtgactgtgctctgtctcattacagagcacaaaaattcctcattgtactgtactgtgggtaactgaaaaaatgaaaagtgaaactatggataaggggggactgtggagtcctaattagggaaaaggagtcaggctggtgggaccaggggaaagcaagagataaagcagataagctataaatctgcctttcttcacgtccagagaatttaaacaaaagagaaaccagataagttacaggtctgcctttctttgtggcccagggcatatggcccaggatatatgacccaagacatttggccttcatgcccggataacatacataactcccgggcttcctgctcaccatcaaacacctcaatttatcaaacatccaggctgacagaggaatgcaagttaagctccctgctgccttggcattatcaatcagcccaagttccattctctaaaatctgcagcaagcttttgtcttctggaagttagcttctctcaggctaacttgcccattgtctctcaggcaacatatttccccactttctctaataaatctgcctttcttgacctatgattttcttggtaaattcttttacccctgtgccatcagcctgcattcgcccatgacagggacgactgtatagtcacatcctgaggtcagctgacagtacgcagatgagctatttaccagataagatgattaaataacagtcattaaaaagaataaccaatctttattgagcacttactagatgccaggcattccccaagcatcctgcttgctttatttctgcatcacagaaattctatgaactaggcattgccatgattttctctcccttagagataaagaggctgtggcttgggaagttttaataacttgctgtgttcacacagccaggcactgggagatctgggacttgcaaacgtgctcttttctgactccagagtccattttcttaactactatgaaatgcttcctttaagaacttgtcccagaagagaatggatgtttcaagttctgaattatacttgatttctttggcattgcagaaagtagacagatttcctgtatggtcctgtattaaacttgtatgtgaggggtttttgactgtctgcatcagtggttctcaaaatggggtccctgggtcaacagcatcagcatcacctgggaatttgttagaaatgcacattcttgggtcccagcccagagctgctgaatcagaaactgaggctggggcccaggacgctggtttaacaagccttcctggtgattctcatgctctatgaattttgagactgctgatctgcagcagccccaacatactcacaggtgtttgcatgtggaaattcaaggctcgatgtccttgaggaaccagacttccaggtttcaggtcggatgaggagtggagcagcactgctcactccatgtgttgttaatcggcgttatctccatgtgttggagatatgttatttccatgtgtttccacatggaaagtcatctccatgtgttgttaattggcgttatgccaaaaaggtgttcagtggtcaatatgtttcagaaacataggtttctccttttttatttttctaaagaagcagggcctttcttgttgctcaggctggagtgcagtggcgctgtcatagctcgctgcagccttgaattcctgggctcaagtgatcctcctgcctcaggctcccaagtagctgggactacaggcgtgtgcccccatgcccagctaattttttcttttttttttttgtagagacagggtcttgccagagaaacataggtttcttggttacagacctttcatatgttaattattattcttttgctgtttttgaagataacaatctttgtgcttcccaggcttatttgatcctgagatcctttgtttgaggagaagagaacaggactatgtttgagaaacctgcactccatagaggcttccaggagaggacataaataattgaattgggatcctcacagtgacgggtttctttcaatcagtcaattaagtggtatttactagtaggtatgctgtatttcttcctgtggcagaagctatgcacaattccagaaatgaatagggatccttatttgtcaaacactgactctatggcaagtggagtgcaagaccctacaaacttatgaacctgataccatcacccaattagcagatgagcaatctgaggtccaggaaggtgacattgcttatcttatcactgagcaactgtggagctgcgattgtaccccaggactgtgtgaatccccaaatctcttttctttcctttctatactcctgtcatcgcttggagcttgaagtggggggtaggagtggggagaaaggagcaacactcatggaaggagaaccaggcctccaagcagcagcagtgggattgtgctaattgggttatgatatcagccccataaggttgtagggtcttgcactccacttgccatagagttggtgtttgacaactaatgatccccagaatttagctgtgccttgctgagggtgggaggaggactgttagcccagcagcattgaggagtaaagtggataacatccagtgagccattccctagcacagttttaaaacataacgttaatttttgtttttcttattataaacataccacatgcttcccgaaggagattctgaaaatacataaaagcataaaaatgcatatccattaggatggctattatcaaaaaagttggaaaacaacaagtgttgacaggatgtggagaaattggaacccttgtccattgctggcgggaatgtaaaatgatgcattcactgtggaaaacagtatggcagttcctcaaaatatgacacatagaattaccatgatccagcagttccactttggggtatataaccaaaagatatgaatgcaggaaatcaaaacgatatttgcaaacccatcttcataacagcattattcacaataaccaagaggtagggccgggcatggtggctcacgcctataatccgagaactttgagaggctgagtcaggcagatcactgaggtcacgagttcgagactagcctggtcaacatggtcaaaccccgtctctactaaaaagacaaaaattagccaggcatggtggtgtgcacctgtaatcccagctactggaggctgaggcaggagaatcactggaagctgggaggcggaggttgcagtgagccgagattgcatcactgcactccagcctgggtgacagagtgatactctgtcaaacaacaacaacaacaacaacaacaacaacaacaacaaaacccaacaaaatgacaacaacaaaaaacagtaaccaagaggtagaatcaactgaaatgtccgttcaatgtggcatagacatacagtgattattctaccttgaaaaggaaggtaatcctgccacatgctacaacatgggtgaacacaccttgaggacattatgctaagtggaataagccagtcgcaaaaagacaaaacacaatactgtgtgattccacttatatgagatacctggagtaggcaaattcacagagacaaaaagcgaatggtggtggccagaggctggaggtggagggaatagggagatgtttttggttacagggtttcaccatgggttgatgaaaaaattctggacgtggatggtgatgatagttgcaccacaatgtgaatgtacttcgtgctatagaactagacacttagttcaataccagcctaggcaacgtagtgagatcatgcctttacaaaaagaaaaaaagagagagagagggagagagcacctctacaaaaaaaaaaaaaaaaagaaaagaaaaaaaaaagaaaaaggaaaagtggttccaatggtaaattttatgtgatatttattttgccacaataaaaagagcataaaagtcaaagcaggctgagtggggggactcgcgcctctaatcctggaactttgggaggccgaggcaggcagactgcttgagcctaggagtttgaaaccaccctgggtaacatgatgaaaccccatctctacaaaaattacaaaaaaaaaaaaaaaatagccaggcatggtgatgcgtatctgtagtcccagctacttaggaggttgaggtgggaggattgcttgagcccagggggttgcggttcagtgagctgagatcgtgccactgcattgccggctgggtgatacagtgataccctgtctcaaaataaaatcaaataaaaatgaaagcagcagttaaatcctagagatgattgctgttcatatttgaatgttttatgtcactcttttctctatgcatttagatgcatacataaatatcttcctgttttatcaataattctttgaagctatgcttttaaatgatgcatattagtttcccaagtagatacactgcagtttacttaaccatctccctattgttggtcctctgagttattttcagtttttcagtgtttcaggttgcactgcagtcaagaactgaatatgtccatttttatttacatcacagacttgtttctttaggacagattcctagaagcagaattgctgggccaaaggatgcacatgttttttaagattctctatacattgccaagttgctttccagaaaggtcatgcagctttcatgaaatctcaccaaaagtgtgtgagaaagtggcttttctgttagctttccttcccttttcaagagggagctcaggggatgcagagaaaaacaggaaggcagtctggtcccttcagatcttggagctgggtcatagcttgggcatgttgtctcttgggcagtgaatgggcacctcgttagagcactgggacagggctgattggcactctggccacccaggagcgtggagcctgcctgcaggaaagaacagtcagttcatggataatcccttgatattggtgctctggttctagtccagagatttttatcagggctgactgcaagttcagctctgggatggggcagtgggggtagtctgctgagctggtcagactgagcttcctgattcggtcctcaggtcatttcaagggaacacattggaaagtcatctccacgttgctcttctccattgtacgcaatacaacattttaaggaacaaacagtaccttcttcctcatgaacattattctgtttaacagggagccaaacgaagttgcaagagtcctcattttcccatggtgttccatagagctgtttgtatttttaataaaaaactaataattcagaggctgcaaagcatttgtttttaaatttaaaaatgttttatagactatggaaacaaaagtttgcttcccctgcccatttgggaaacagagcactgctctcattcttaggggacagcatacacatgggtctgggatgcatggcctgctcctctggaaggaagttttgccatgggcggctggaggggcttcaaacactgagccagagagagggttaggagctgagggcttcataggaacatctgtcttttactctctctcttcatatttcaaagctctctctctctccctctctaacacacacacacacacacacacacacacacactctctctctctctctctttctctctctctcggaacatctttctctctctttcttcatatttcaaagctctctctctctctctctctccctctctaacaaacacacacacacacactctctctctctctctctcggaacatctctctttccctctctctcttcatatttcaaagctctctctctctctctctctctccctctctgtctctctccctctctaacacacacacacacacacacacactctctctctctctctctctctctctaggaacatctctctttccctctctccatgtttcaaaactctgtctctctctaactctctctctctctttctctctctgtctctctgatagatgcatacagatttggtatttaaaaacatcaactctgactgtgttcttggtttctctctaagtataagaagccaacaaggctccttgaagattccctcttttgatattagaatgatcttgaaaggagctctaaccatacccagagtaggggggctcccttaggttgaacccctagatgtgctgcagccagtggggagatgctggaagaaacagattgaatcatggacctgcccatcagggtcatctgaggagtctcactgttggtggtttcagatcttccagaagaaactctaattagctctacacaagagccagaggggttagtcaccaaagagtgattcaccccatcactctttggtgaatttaaccaaatttaaatggtgatagggaattccttttacaattccctaagaggaaatgagagaaagagttggtctttcccaagcagcatggttttcagggacttgcttctcctggtgccttctctagtcagttgccaaatcctcgtggctcaactcttctccactgctgctgtctcttttctagttcaggcttccattgctgcttgcttggactcttgcagtactcttccagctggtctcgtgactctgtcatttctgattagtcatacatcttactacccacttaaactttctaaatgttagctaattacttcactttcctccacaaatactctttcatggctcctcattaaccaaaggaaaacaaaaagtccaaacttctcttcttggtgctcaaagatctccatcattcctccctgtgttcctgggctgcaacccacataactagtcacccctatctcctgccttatgtgggagttcattttatcttttctgctttcttgtctgtgtatcctgaaattccactcattcttcatggcctggggctaaagccaggaagcttctgtttttgatgttctaagttagaagtaacatctctctcctctaactaatgagcttccccccaaccaaagcttctaccccatttcctctctaatggcactaatcttttgtatcttctgttagggtttttggaatactagtgacatctcctagagccttgtaaagctcttatttgccttcaagtgccccccattgccagggcatggagccttgcacagggcaaatattcagcaatgttggatgaataaatgaagagtgaccaagggttgccagtggtagtcagtctttattttcaccccgcactgctatttgccctgtactcacttggactggttcctgctggtgagaaacttgctacccaggtaccacttattttaagcacatttatgcatttccaggcacgtagcaagggggcagcaggttagtgattcatgagtaggtggaaaaggtgattgccttgagagctgctgactcagccgccagccgttaaccctggtgctcctctgggccctgaatcagtgagtggatggcatgaatgaacagatggccaaggaatctcaggagacccgagtctcctggatttggactttccagcattagaggtgcacagcccagagcctcacagggaatgctagaagctgcagtataatcatggcacattttcctggagaaccagttcttcttgaaggtttgggaatgaatattattttgtattcaatcacatttgtcatgaggaggaataaaatatgcatacatattttaaaagataaaatgcaacaatttaaagaagcttcctggctggacatggtgactcatgcctgtaatacctagtgatttgggaggctgaggcaggagaattgcttgagcccaggagttcattgcatcatagtgcaatgagctatgattgcactactgcagtccagcatgggcaacagagtgagaccctgtctctaaaaatataacaaaaataaaaagataaaatttaaaatatatataaagaaactgtctgcttgtggaaggcttgcttcaaattctaatccagactccctgaggtaggaggtaaaagtttcttcttttctgccttcagggctgtcatgggaaagtttgcaaggatctgggctagtctggcacccctctcggttgctcggttccccatcactgccttcccactccatggcttctcctctgcagggtgtagactatgatgaaggttacacttgaagagcagtgaaacagaactgggttccaatcctgccagctgcacagacaccatatctggagggtgatggggcaagggacatgctcactctccctttccagaagagataaagccatatgggcaacctgctatcactgtgaaaagtgagtggaataaattgtatagtgagtgaagtgtaagctcatggcggcagtgtaagaaacacattcttgccaggcaggcagataaccaagaaaggacaattgggaacacgtcagctgatggagatgctacccaattgtatccctatgtggagagaccctccagcaccatatcccagccacctgcgccctgccccccattggaccccctcttcactgtttgccaagctgaacattggacatgtcacatgttccctccctcagtgcctgacttactaaacagaaaatgcccagtgaaaacttaggtaagatgtcgcacagtgtttggcacttgataccttgttgctaatatggtggggaccccttccagcactgaaaaatcccgcagcacttgtggcagctcaaacagagaatgtaccagtcactggctcccctgagtttcttcagaaattgtttaaggagtgctggatccatgagggcagaggcttgtcccagtcactacactgtctctacctgctggaacaggtgcttagtatgtacgcctgctctgtgctgggcccatgactgcacaaggacagctgacttcagaggattgctcaggatcactgagaaattcatttggcaaaatattgtgaatttaatggcctcttcaatttgaaataaagccacccggctttttgaaatagagcttcctttgggagcttagaactaaattcttggcttcatagaatgccctagctgggtggacggagaatcccaacatatagatgtatctagaatgtcagaagtgaagtgatctgtctctccaaatcattggtgctagggagaaagaggtgagcatgctgtctttttaaaggattcaactaactctcagagctttggaagaaagaaaaaaaatccaaaatgtgtactaggtcagtttttatttggaagatggattttattgttatatttttaaactaggaagtctcttaccactcccattctccttccctggcctagaggggtgggagttcagatccctgcaacattttaacccaaaaagctcttacctgtttacctttctttgatagagttgccaagtggtcttggttttgttttgtttttcttttagaagagaggatctagctatgttgcctaggcttgtctcaaactcctgggctcaagcggtcctccagcttcagcctctcaagcagctaggattacaggcatgtgccgccacactcagctcaccgagcggtcttgaacaaaaaacccaaattggtccaagtatggattatacactaatgatatttatcaccatcactatcgttgtcattatcagttttattatagtgacttccagttcggtatctattgtgggtgcttggagcttttgcacatgtaatcttatttaatcctcacaccaacctaggaggaaggtattattattattgcccttttccaggtgggaaaattgaggctcggagagttgtaagtggcttgcctgatgacaaagggtgggtgagtggtagaggcaaatttgaactcagtgaagaaagagttcaggctttgctgtcagatggactgaagttcttctcttggtgtccatgggggtgccagagatgtgggggttcttctttctccttccaaatcagacgcaactgaaagtctgaggactcagcttcaatctgagctctgatttctctagagtatccaggatggaaaaggggatggtaagatgaagtttgcagggagggcttcctggaggagagggctctgaaacatgagagcattcgggcaaataggaagggcaggtattttggtggatccagaggcaggtggattcagaggtgggtggctcaagagtacgggcctccgtctcctcgtcttcctaagcatatttaactgtgaatgaagcaagacaagaggtgtatttctccatgtaagggaaatgctatgaagaaaaggcatttctggtgtcagaatcacgattgtcagtgggagtgtcaggaagaaacttcgtgactttttctctcttcccaggcgcccccagctgttaggtttcatggcaacccaatgtggtagaaggcagtttcttttccattcttgctgttagatttttatgttgtgtgaccttggggctgccttagggcctctctgtccttcatgggtctcacctggcagaggagggggatacacagggtgatttccatagggacttacagctctaaaatgctcgagtgtatgatctaatcatgatgacacacagtcagccacagtgaaatccctgacacatctcaaatttgaactgcatctttatgagtggaaaaactgtttcctgccccacaggacattttgatttaactaggacacacctgaccctggtctgctcacagacagagagaatttgttctgtggcccaaggcctctgcctgcccctgctcccaccccaccatgggtagcagtggccacgtggtacttgaggacagcatcctggaacttgcccaggagtccgctgcatgctggctttctctcttctgcagagacgaggggcccagatcgggtcagcctctgctcagctctgcagtcttgccagggggaggaggaatcaggctggggggcagggatagagggccgtgtgcatcagggaaggaggccctgagatgacaagctccatgagtcactcaactggccgctccagccagagagcatcaaggaggggtttatgacactgcctcatgcagcagtgatcagccatgaggtggcatccatccattgtcaggggacagtccatcctcctcaggcacatgcacagaggattgggtgcagaggagttcaccctcaacacctctgggtgttgggaggcaggagagcagtggggctggaggcacagctctgccaagcattcctgaaccaaagcaagccatcaatgagtgctcacaccgtgcaggcactgtgagcctgtgtccacatgatctcatcttgtcctcagggccatgccaagaggaggcactattcttcttcttctcagtttatggatgatgataatggaggcatagagaggttaagcaacttgtttgatgtcacccaacaatgctgaaatggggcaggatttggccctggccctccagagcctatgggcttaattgttgccttggtgggtcttagccttgagcctgcattagaacaacctggagggcttggccccactccagagtttctgatttcggtcaggtctgcgataggtctgagaatgtgtgtttttaataagtttccatttgaggtaaagcccagggaccacactagtctgtgctgtactgactcatcatcccgtctcagtttccaacctccaaaaccagagggttgagctttctaccagttctctccagttgaccagttaacgcagaaattccagccttctaatcacccataattatgtttagttttggacaacttaatatatgagagagcaatagtacttcagtaaactcctctactgctactgggtttctgtcacttgtctcctcttatttttgacaatttgatgttttgtgttgtgaggcttcctttgtgcctaaaagtcattgacttttagatactcactttggattatctccatcaatgtgaaacctcctgtgttgccttatttaatgtcttttgccttgaatttcacttgcttggataccattgcctttaacttggcatcactccttagcttgctttttacagtttggtagagatggtgtctcactatattgccctggctggtttcaaactcctggcctcaagtgatcctgccacctcggcctcccaaagcagtgggattacaggtgtgagcctcacttgatttttgcctggcatattctggtttattcttttacttttaaccttattttgtcacttggtttagggtatatttcttataaacagtgtataattttatatatttatttattatatattattgcatatagttaatactatatataatgtgtaccacacattttgattgtaataactaatatgttttggcctttctgttttttaaaaaatgctttttgcagtcttttttgtctatctgtaatagatatttaaattttttattttatacttttctttattaaattggaatgtctacccatgctgcctctcaagtatttaaaactattgttcaaccatattttgccaatggttaatgtatagagtgaaatagcctcttactccttgccacgtaagataaataatttttcttcttttcattcccccattccataatattacactcatgcttttatggtataatctgatatttaaaacttctacttattattattatatttttcacattttatcttctcttccaataaattttagttttcattttcattttgatttgtaatcacagttgtaacaattatttaaacctaatagatcttagggttcattgccagatctttattaccatggacatctcctgttgttgaattccttgttttgattaatgtcttaattacaaatatgaaaaatttaacacctgtttaatcttcttgaacaacgtattctgctttatcgcactttgcactttgtttcttttaatatgaatgacaacttggccctgctgttgggttttgcagaggagacatcagatatcagcttgatttttctctttttttttcatagataatctgatatcttctgtttggatgctgataattcttcaccatgaaattaaaatatatgtatgtatgtgtatatatatatgtgtgtgtgtgtgtgtgtgtatgtgtgtgtgtgtatatatatatatatatatacatgcctactgagcattttgactttcagacttgggtctgtcttctgtgttaagaaacttttttttgttttcgtcttttcagttaggtttattctgaattggctgcctgtcctctatatctgtcatctttttgtataatctgtcttagacctcacagtatttctgcttctgtatttttttcctcttcattttgagagtgctttctaaatgtgcccttcataacacatcttgtttcagaaataagttctcttgacttttactgcagacatagaatagatggtttctccaagttcaattatcacaatatcacacgagttgtttactgagcacagactgtcctctgtgcactgtgctaagcactttgtgtgcattacctcagaacaactccaaggggcatgtgctttgtttgtcctcattatatagattggggaaacgcatgtccagagggttgagccctactcagcctcatctgggtactgactgggggccaggactcaggtccagccagtttcacagcagagcctgtgctcttggccatgatgataatggcactttcccacccagtccttttttttttcaaatttatttattttgagtgctgcattctctaccttttatagttaagaatgttttcaaggtctggtgggaggttttcgtgttttgcatccatgaatgcagtcagtgtttgcctgtaaatagggagggtcaattctcttgggctcctctgctgtgcacctcattgcccatagaatgctactctcggatcttgcactagagcactggatgatgaagtgaagccttgcagagacctgtgagtctgggtgagtgagctggaaccatgaatagttccagaaggggaacttaatcctgtgatatttcttctctgtgtttggtaaagccactgcaccttgtgccaactgtttgcatctggcttgctgtttaacctggccaacatgccaggtacaaactgtgcttggacttgtcctccttcctggagctgccacctgctgtgtcagggacaagcccctgccctggccagttttcttctggatgtatctgccatgtgattcccagggcttctcagagctgctgctgctgctgaacactgctgtgatccatagtgaccagggagtcccggtgcctgatacttggctcacctccctgttcagccctactgatgtaggcagctctgatgtgaggttcttcaagggcctcactccttgtttcacaaccatcctgccgcttctcagggagcaaagctgcccaaggggcctccctgccttctctttttctgcataactgatttttttttttcagattcctttaggtttttggcacattgatggcacctgttcctagtttgctgagctgtggcaggttttccaggcatactggatttgttttgattttgaagcaggaatctgggcaggagggcattgcatgcctgagctcttgttgccatggtatttgtaaatggacaaatgtaaatgaagccagtggcagcatccttctccctccactgcccatgctcctgagtgtgggaattgggggacaagtcactacttcttcctgacttctcctttactcacctgcaagttagccacatcttccactttctcccttattccccacctcaaatacaaagtcctaggagaagaggactgggagcactggatttgatattgaattggagaagaccattacaacctcagattctaagattctgtgatagcatctgtcctggtgatctaagtcgggttaaactcagctctcttttaggagatcaagaggttttataatataggttgggtcccctgccagttcttcttacatatcacacagtcttagtttggggacacagtttttggaagcctgtctgcgggggttctggaactcaggggtggatgcaagaaagcagcattggttctttgtcacgaggtgagagcaacagtgtcaggaatagactctgtgagctcacccaccctcaaggggcatcgacttccagtgcatcactttcaagttcatctgtgtctggccataggcttggtcacatgctgaggtttagtgcatgaaccatcatgtctactgaggtacctgacactccagaggcattcaatatgttatgcaaatggccttcatgcccaggctaattagggagtccccattggactttgattattcataaaagacagttgataataaagccctggctgcttttgaaaattcatcaagtaagaatgcagggtttttccagtgggagctcagacaaaaagccagtggaaggacacaataggatcagtgctgaactcccatggttagttcgctctctgagatgcatgcacagacctctgcagaggccttgggcaacactggtccttttgttcgcctgggtccttttgtttgcctggtcagcagagtagagggtggtgtcctagtgaggacaaaggattcaggaagagcaaggtagtgtgggtaggggctggtaaggatggcgagtgggaagacaatgagcagagctttggagagcagagtttgaagtacttgtgggacaccaggtgaagacagccaggtgacagcaggagccaggtgtcctcaggctcttgctagtgctgtgtcctggtcaacacacttaatctagctgaacttcagttaccttacctgtatgtaaaatgaggatgttcatagctccctcacagtgatgttgagaaatcaagtaggtaaacaaacatggtatatagctttgggggcccactggtctgacagggcgctcaacctgtcctctttttttttttttttttttttttttttgagacagtgtctcgctctgtcacccaggctgcagtgcagtggcgcaatcttggctcactgcaagctttgcctcccgggttcacgccattctcctgcctcagtctcccaagtagatgggactacaggcgcccgccaccacacctggctaatttttttgtatttttagtagagacggggtttcaccatgttagccagtatggtctcgatctcctgaccttgtgatatgcccatctcggcctcccaaagtgctgggattacaggcgtgagccaccgtgcccggccctgtcctctctttcttgaatggtgctccttctagagcattccttgtaacatgcatgaggtggtctcttatcttgaagacccgcacctggtgaggagggtgacagacaggattctgttgtcaaggaggtggtaggaatggagtccagggtgctgctaagggagggccaggctgtatggtcaggtgggcacagctgcatggaggatgcttcaggggctctggagaagaaatgagtgacagagctttcaaggaccaccttctaggggtggggcttccaggcctccaaggagggctctgtgtctttatcagaccgatggctgcccagaacctttggcagaggggctcagcctgccttggtgccagtgagcttccacacaggaagacttcctgaggctggtggctttccatgagcaactacagggaggaaccgcgggggtactggtggctcagtagcctctgcttcctctgagggaatggaggggtcagtccctggtgtgggggtctcttccctgtcctctgctcatcatgaggctggctttcctcttttgcccaccccttgggctgggaccagagcacagccagtcaccagtatggtggcccagcacggcaggctgtgcctgtctgtgtacacgccagctccatgaggtggaagctttggcaatgggctcccagggagcttccccgcaggcttctcaggggaatgtgttgggagtagatgcatggagagttcgttttttctccctttcatgaatgagaaaacgggcagagaaatcacggcactcattggccgatgtttctgttggtgcagattaccaagggtgctgaagtcaaaaggagtgagccacagtcagccctctgggtggttgactgccactggggcctttagaccaggaaggtgtcgtgaccgaggtggacctggtggtgagatgcaaggtgtggcagcctgatgcggaggtagcagaagggagacaggccaagtcagggcagccggcaaggggcccatcacagagcagtgcaggcgggaggccacaaaggcctgggctggggtaacgtgggggctggaaccgggaagctccttcacacattgagcctacttcttgggactctgttccagtatattagtaatgttaggaatttcagtttggctttttaaaaagctgtttttcctttgaggaactcaaatattattggttgaattgtgtctccccaacagataatgaagtcctagccctccgtacctgtgaatgtgaccttatttggaaataaggtctttgcagatgatcaagttaagatgagatcattagcgtgggctctaacccaaaataactggtgtcatatttataaaaaggggaactttggacacagagacagacatgcacacagggagaatgcctataaagatgaaggcagagattgcggtgatgaatctgtaagccaaggaaggacaagaaaactaggagagaggcctggaacacatgtgccctcacagccctcagaaggaactgaccccaacgacatctccatgtcagacttctggcctccagacctgtgagacaatgcatttctattatttaatccaactcagtttttgatactttatgatggcagccccagcagacgaattcaccaagcttcccggatcccatttcttcactctctggaaaactgctccctctggtgtctgagaatcacacgtatgacctccctgaggggctcagggttggcaaggcctccccatctgggtggtgaaaggtgctctctgggctgcaaagaatccagacagctctgtgagcagcggctgccaattcactgacattgactgactctggggactctacccttttcatccccatgtgcccgtttgtccagcccctgcagaaacccctgtggggtctggcagtaagcgaggctgctgttccagggaatgtgtgtgctgaggctagccaggcagctgggctagcctcctcctgcacagtccttcttaggaatgtcctaagtacctattcagccctggcctgaagcaaaggaggcactgggtaatgaggactgggaccccattgctcatggtccaattggcgaaatgccagattaagcacagatcacttttcaaagtcaaaggcaacgtggtgagtttctttggcattaaaagtcctctcccatggttatcccattctgagtagccagttgtgtatttattcacccagccctgtgttgcggttattgtcttttgagtgtttgattctatcccctttatatgactcatcagcccccagaaagcaaaggccctgtcttgttcagcctggcacaggggcagccgaaattcccacagggctcacctccttcgcctctgcctgagatgtcttatcagcgtcactctcattctgcaggggaggaaaccaagactccagggtggagtgattggctgtatgtttcacctgcagccacgcgaggcccagaagtcttccagtgctttggaggttcacaagaaatatggtgactcaactggaaccacattagaggtcagcatttaacaggtcccctcaattttcccacaagggccagtcttgtgtcctcggctatgaccatgagccactggggaaagagatgctctcttccctgcagctgcacggctccccgtgctgggttggccacacactccccacccagtgcacctccgttgattgattgacgtggtgttaaacatgtggccttttgcaggcaactctaggagggtgatgagctttgcaaatctgcccagtgcctaaaactgaaccacacacataattcactcacacgcactcgctcagttgggcgtgcattctcactgccatcctgcctccaactcacgcttgacgcctcacagttctggacttctcttctaccacacagcagtgcctgccctggctggccagtactacattcctgacctttgggttttgggtccctgggggcagcttgctgccatccgaaccaccaggccctggccctcagcgaggcttctccaagtgttctgctgccttacttctgctttcgaagcaccatgcctgtcctggggtggagtcagaagtcagaagaagaggctgattagccggggtgcccttggaggggccagggtctcctgatctgcagccagggctctgcatttaggaagccttgtcagaagcctgcaattggcattgaatctgtttagagtgctcaacctagtgccaggaactgtgggaaatctgaagacatgatcagtttccagagagtcaagacaaccagcagaggattcaggttaataaacttagacttgtgttcagctacctggttcaaatccccattcactggctttgaccacaggagaatgatttcacttctctaagcttaatttctttgtaaaatttcacaaggtattatgagcattaaatatgataatacatgcagaatgctttagtacattgcataacacattgtaggcactaatacatcttaccttacaatactctggcctctcctctccactcccatacaagcgaggactcttagacagtgcctgtcatgtgccagacatctgtaaagggatcatataagcattaactcatttaatctttacaggaactcagggaaagactgaggcacagactgacgaacttgtccatggttccaaggtgcagaaccagggttagacctagaccgtgaggctcttgcatctgtagtcttgcttagagcactacttgcaaagaagccttgggtaacttccctatacctccatttcatcatctcgaaaatctagatgatgatgataccagctaggatcctcaggaaagttccctgaacttcattaagggcttagaatgatgcctggtgcatcctcagtacagagtaaatgcagtggcttcaataagaaatacaagtacacaggtggccaacaattcaagctattagatgcagaaggccaaggaggtgatccagctctttcattatggggaatcagagcatgcagatcagcaggggctgggttatgagagatgaggagtgggctgatccaaatgagaggtcagcttgagcagaggggaggatgtgggaaggcagagagtgtggaagccatgtgttgggagcagggtctgagaacatcaggttggggacagcccacgagggaccttcattagcagtgtggattttcacctgcactctgtcggcaagcactgaaggttgtcattagcacactggctgtcacagaccagaggggcttcccattcagtcaaatcttgctgcccatccccagtgaacggagcagtaggcagtgaggcgggaccggcagggcgtacaagatgctcgcccattccctccatttgaattgggcttgggacatcccaaggggctgctgcctgggccctgaacacatctaagggctatgggtttatggtctttcagctgctgtttatgtcacaaatgcctgtcacagaaggggcattaaaaataaccgaatggctaataccatttctcaaaataactacttgcaaagtgctttgctggggcaaatggctactaaaattagactccctggtggtatatgtagggtgtgtgtgtgtgtgtgtgtgtgtgtgtgtgtgtgtgtgtatgacttctaaacccatttccccccagggtgaggcccacagtttgcacccttttgttctgtggtcccttctgtcatagctgggtgtcccagaacagtgttcacccagtcaccccaagatgccctctttcatcctgcagtcctcagcaaattggagccactgccctacattgccctgttgtcctgctctaaggagcagaattttgaagaatcttggagggcggggtggcctcattgtagcagtggcctaattccttggtgtgccaggtaataatagcacgccgtggggggaatctcactcagcatgctgtccgaggggaaactgggccatggaacaatgtggcagccccactcaaggtgacctagtaactgagggcacggacacacgattttccaggccccagttccagatccaggctctagaactcttcagtggtctcctgggccagtcctttgggccaccaggcaaccaggtcactcaaatccaatcaactctccatccactaataatacaaaaggaaatgtgggatcttaagagcaagttaagaaaacaaagtgaatcagcactgtgggggattttggattcaggacaaacaaaacctgagagccagcgttggttttcttttagataatgacttgcacggaaagaggtggacctcagtgtctccatctttgaaatgggggaacactgagttatttagcaaccatttattgagggagtgcctgatgtgggcctggctcctacagtagggctgattagggctcctacagtaggccctggagttacaaagagtggttcaaggtaaaagcaaggtcaagatacatttacaagccagtgtgttgtctgtacgtggcagccctataaggactggggttctgtgtggtcctagagatttcggtcctggagatgaaagactgtgagtatttacctggaatggaggcccagggaggaatgaatttccctactcctgtgagagctgtatgtaaatagactgtttctgtgttggaaagagcacaggcagagtctgtgactttaggcaaactgcctaatttcttttcaactgctaaatgtgaataagcacagcaccaacctcctaggtctattgtgaagattaaatgacataacctagtgtggtcttagcgtgttgtaggcactctacacactctatcgttagtagtagtcatattaatattaaactagcaaaaactgtttgcccaagaagttccagtaaatcattcccttcaatcagggtgatgataattttattttttagtattattaagtcattgctgtctgtaaggccatcaaagagctggagccacttgctggaatcaggctaggtcaatttctgaatgctggaatgaggttgaggggagtgaggtagaggatacatttttaaaaagtttacatgtaatcaaaccctggtcattcacatctcctgttagattcattatgggagttggatatttaagaggaatctttgccacaaattcatgtgtaaacccaataattctcgactgttaaaagtggtgggagccctagatattaggatatagggtcatttaaccccgtggttctcaaccaggcatgattttgcctcccatgagacattggcaaattggggtgggtgctgctggcatccggtgcgtagcggccagggacactgctcatcttataatacacaggataaccctcctcaataaagagtaatctggaccaaaatgtcaacagtgccggggttgagaaactctgtcctaacctgaagatgagacaactgaccaccaggaagggggagtgacttgctgaggttaggcagcacagctgcaccagagctgggatccaaagtttgaatcaattgaccagaggccagaggccagacagaaccttgatactgtcatctcacctgtgaagtaaattatcaacctcacccatgtgaatgaggccttactctatagtattttcaaggctctttctcttgtgatattaagctctgctttggaaaaaccaggttttcctattctgggcttgctgatagagtaaggatggtagattcagcaaatgaaaataaggttgtccaggccaggcgcggtggctcacgcctgtaatcccagcactttgggaggctgaggcaggcggatcacctgaggtcaggagttcgaggtcaacctggtcaatgtggtgaaaccctgtctctactaaaaatacaaacaaaattagccgggtatggtagcgggtgcctgtaattccagctaccagggagactaaggcaggagaattgcttgaacctgggaggcagaggttgcagtcagccaagatcgtgccactccactccagcctgggcgacaagagtgagactccatctcaaaaaaaataaataaataataaaaaataaataaataaaaagaaaataaggttgtccagttacatttgaatttcagataagcaagataggtttttggtttttagtttttagtttaagtatgccctatgcaatatttgagacatacttatgctaaaaaattatttcttgtttattctgaatttcaaatgtaactggcaccctatcttttgtctgtcagccctgtgagctctacccatcgccctgagatcacaggtaggccctggggtcatctacccctgtctgaggctcctgcaacccttatgaccccctctgcctagagggggaagatgggaaggggcaggtgggccttgagtggagcaggcattcctagctcctggcctgtgggtgcctgggaagagccggctagccacactgggctaaagggcctgtaagttgagaggttggccaaactgtccctttttataacaggagaatggtttaaatgaagtgtcagcaggtgacctatggccctggaaaaccaagtctggagaagttgtggcaactttgcccctgattggggaacagagtgtcctctgcacttctactggtttccagagaacatggctgccctggctgaggagcacttggacatggtaccttccagggctgaggtgctgtctcctcgtcacccctgggctctgggcctgccccaggggccagagttgggcggttgttcctaatacagggggaaatgatgggcagggctgtgcacccacagagctgctgctgagccggcagctcagcctttttgtttagaagaggcctagatgtggagcctatcaacagatcagaaggggatgctggctcagctgctccctcaccttgccttatcccacacccctttcacctttgcttccttaccagcccagacaccaggctccaaaccagtcagtgctcagggtccggcagccaatggcacaaggtgggtggcccactgccctgccccattccctccgcctcccaatccatggtccaggctgttgctcccaggtgtcaggatgccatcccccttccccagagcagcttcctgctaggaaatctcatcctcacagctcctcctaaagggcagtcagctggccacagccacaacttggtggcctttcttcctgttggctcagaacagcctttgagggtctttgggagtaactgcttagggactcaccatgttgtctgccatcttgtcgacatcgttgggccacctaatgaccagggctggctccacctggcctttgctgcatgggtgcttattaataggcatatattgaatgaatatatgcctatattcacagagttgaggacagttaacccatattgcagaaggtgtctgatgataaaggctgaatgaagtcattggttctcaaacttgagtgggcattagcatcacctggatggccttgttaaaacgcacagtaccagcccaacctggggactcctgactttgtagttctggggtagggacaactttgcatttcttacacatccccaggtgatgttgcaggtccagggccatctctgaggaccactggcttaagctggtgcccttctcaaaatgtcttgcatttccattttacttttattaaaatattccttaattaacaatttttaaaaatcttcattgactacttactctgtcccatgcacgaaattttggggataaaaagagaaaaattgcctcaaggaactcacagtacagtgagagaattgcccatgacaaacaatgaccatttaatctaattacttttattgggatattgtgttgaaggtgcaatgggggtgtggtaaggggaatgtgcagtgttgttgggggtatccctttgagggcaagtgtgatagtgtctctctctctcttttgtattgcacttctctctctttctgtgtattgcaccaaaagtatatactttttgaagaagtatacacttctttttgtgtattacacttctgtgtggcttgttttccccagttgacttgcgagatttctaaggggagaggctgaggtgaatcttggtcttcttcatttaagtgtgttccagttgacataccaggcaaccaaaaaaaaatgtattacctacagaaaagaagttcatatcaaagaagtgaatgcctaatggtggaatttcagggccaagtctgtgtgggggtttactcatctagattctactatatgtgttgagttctagggctgagctggatggagagaaagttaggcaggacggtacctttcctggttcctaccatcaacatcgctgactgagtttatggggaacactgctggtatttcatcctgcagggattcttgaaacctgccatgagctaagacagctcattttcaagagctttaagtggtcctgagcggatgcttagctggggacttgtcatggcctgaggtgacataccctttctgcagagggagaaggcctctgaacctttctttcttcagaacctgggggactagggaggaagggaaacccctccatgacttgcctgcttggggctaggagctggaaatggagacagaggaagctgcttcttattatgcacagggccaggagaaacccttgggctttgcccggggccagggctggcttccctgtgactttctctccacacaccctctcatcctccctggcttcaggagtgacagatagaagcagaactaagccggctgtacccatcattaataacagaaatattcaggatagctcattctcatggagagctcactgttctttgaaaataccttagattcacgaacagattgaaaagggtcaagagaggttaagaacagccaatatttatagagcttgtgctctcagccacaatttcaaagtgttctgtgtgcattacttcattgaatctttagaacaaccctggaaagtggggtataattggctccattttaaagaaaacaatacctcagctatgcagtttgagtaatggtcccgagatcactccaaaaggaaaagtgtagcaccagatttggaatcaaacaggaagactccagagcctaagttcattctctgcggtcctgctctacttggtggtggggaaggggagggaggagatgaggtgaggttgaggaaagaatacttcagtgtgtgcttaatctgcctcctcctgcaccctgccctcctcctgaaggtctgtcctggccacggcagcctacattatgtcctctttccagcttctgttttgacctggtattgacatttgacttggcatggcttatcattatctctatcttgttaggattgcaacaccctagtgagcagggaatggcctccagctccctcaggctctcctaggataccttacagcagaggtcagggtagggctgataaacacttatagttgcccagagcccggtacctggtccacagctagggtgaccaaacattctagtgtgtttcagttttggcactaaactctggcattctgggaggccccacaatactggttggtcaccctatatctcatttgacaagcaaggacattggtccttgggggacacagtgtggtcccagtctcacccatggttattggtggaggctgatcccaaggcctgctctctgaccctgatccagttccctctcctcctgctgctttagaagtgagggctcagtctcctgctcttgcttgttaggtcaaaagcttttagagacagccactgtcttctctatgggctctgagatgcttcttattctcttttggagaaaagacccccacagtcaagaagctttggctgagccatccttacttacagagcttgtgctgggcaagtcttggagggtcagcctgtgttctctaggggcttgctaacagaaaggaaacggcttttcctcgaaccacagagcacagcaactcttcagacacgctcggtcagcctgcaggggcagggggtggttgccaaattctaatgatcagaaattagaaacgggaacagtgaattctagaccagcagcctccaaagtgggatgcacaaaactatcctttggaataggggaagaaaatgttaagacatctatttctatttacgtttatcactctttaaaatgattacatctgtgtgcactttattgcgtatgtaatatgagcaccatatggtgcatgatgggcatacaaatacacacgtgggagtggacactgatgggggttgctcattcagaagtgctccctatgtctccacagctgtattttaatgatcatgaggtgggctggctggaagatggtcactttcagcagaggaggttcagaagaaggagagagtgagtcttagagtaaattggcttagaacatcccttagttgatgtttaatgcagatgatgcttaagtgtttctggatggtgtgtgatttcttggagcgattttgtgcatcaggaagtgaacttcctgcagccacattttgcacatcttgttccattacttgtctaacaggatgctcacattagcttgtgggtgacaagaggcaggctagacagagcagaggttctcaaagtggagttttcatatcagcagtaagagcctcacttgggaagttgttggcgatgcagattcttaggcttgctttcagccccactgacttagcgactctttgggtggggcccagcatgtcttgtttggaccatttgtccaggtgatgctgatgataggcaagattgagaaccatggagatacacaggcaggggcacacagtttgaatcctggttctgctcctgctgcttctgtggcctgggacaagtgactgatggcccagagccttgatttccccatctgacaaatgagagtgataacacctctctcctggcattagtatgaggattaaaataggagacaactgatgtaaagtgcttagcactgtgcagagcacaaggagttactgcatatctagcctcagttgtgatttttaccattaattggattatgatgggggacggcaacttctataaggaggtggcacagaaatgtctgatttctccttccttctttcagtagctctgtgaccttgggcacatcattttccttgcctataagatgtagataacgacacccacgtaacgggataagtgaatggaggtgcctgcagtgctttgcactttgtaaaacaccaactgaataggagaagtttctagagagctctttactgaggctgcttctactttgtcctttctggaaaatacttcccctctgcccaaatagtaaatgagagaggagaaaaaagccagaaatcccacggtgccagacttgcaggcacaaagagcctttgcaccgtaggtgactttgtttcctgagtgccatttttggcccctcccaccctggtcctcctagatcctggcctcagcttacttcccctgtggttccatgttgattccttattaaaatgtcacctgcaagtcatgaaaactcagtgtggtttcctgaaagaggaggggcagtgattgtccagagtgttcttttgtcacgatgagaattgcttgggcgacagtgtcaagacagcaaataaattgcctcctccccttcaatgtctcagtgctgtttttgcagcatgaatggttccagtgtggagataatccttgctcatcttttcaccaggttcttgaatgtggaaaatgggcaaacagttctccctcaccacacactcctgttatttccagtgtcccgtggccatacacccatcagcagagaggcctggagtggcaagcaggggtggctggaagtctgctctcttctcatgagagtactgagggcccagtgaggtgtctgtagagcaagatagagccaggtgatcggggaagagagccctccaccccagttttcccaggaggcgacaggccccatctctggggggagtggcgcatgcctttctcctcgtcacctgccccgatgagccccacatggatgaagtgagagcctgtgtcaccaccccggctcctcaggaggctggtgatgaatagggatggcaggaaaaaggagctgggctctgctgtgacatgtctctatttttccagaaaactgccggatgtccttcccttgtaaaagttgaagagaacagaggagaggagaagggtcggagcagagagatttctgatatgctgttagtggcgctgccaattaaaaagaaattaaaacagaaatctccgtgggctgctggagtgaaaaagtctcctctcctggcccctctaaacccttgaacaaattaattggttggatgttgactgggtaccagtgaaattcttagatattaggtcttgttctatggtaggcacagaagaacaaggggtgtgtgtgtgtgtgtgtgtgtgtgtgtgtgtgtgtgtgtgtgtgtgtgtatgtgagagagagagagagaagagaggaaggatgggggagagaagaagggaaggagggagaaagggaaggaggaaaggagggaaggagagcaagagagagacttgggggcatcggggtgggttggagcagttcagggattgaaatcatgctgcatgacatttgggcattttggggtagctgagacaaaaactgctggaatttcattttgaagataagaaaaggactaggaaagagagcttctttaggccagaggagaacagattgaggctgtgaaggactcttggctcccagctcttcttgttctctgtggactttcaagcttctgcagggagacagtgaactgggaggaatatgtagtgactgtgaaggttacatgtggctggaaggggcaggcaaaaggtcccaaatggccctgtggtgctttagttggcagagagatggacaagttgatcctgcccttatgccgtctcatgcatttgtccaaaagctttgtttctgctgcgtggtcagagacagaaggaggaggctgcctccccttcctgggacctggatgttttggttcatctgggttcctttctgattttgtgatgccctaagcctcctgtccccacagcccttctttcctttttgtagattctcttgcaaacttacaaagtgtctgtaacctttggccctgggacccagcatgagcagcttactggagtcaggacagatgcacgtgggtgctgagcagagccctgtggagcctcggcctctggcctccttggccagctgctgccctgtcccagggacagtgtggcttcccagggagcacttcactccaatctctgagccataaaaaattaaactacagggctatcaaatatttaatctgcctgaataatgaacatgggcagattcttatgaattctttgctttgattaaataaaattgaaggatgggaactgtctgcttggcacgttagctgaaggcaatgcagggtaggcactttgtgccagggatctggccctgagtctggaagaaccatttggttcatgtttcctcacccactgtctatacttcagttgtggatagccctctggtctttattcttcttacctgtaaaatggggataataatgataatactacctcacttacaagattaacgtatgagatttatatcaaaagcctagtacctggcacctgttagtttctttctttttttttttttttttgagacagagtctctctctgttgcccaggctacagtgcagtggtgcgatctcggctcactgcaagctctgcctccagggttcacgccattctcctgtctcagcctcccaagtagctgggactacaggggcctgccaccatgcccagctaatttttctatatttttagtagagatgggctttcactgtgttcaccaggatggtctcgatctcctgaccttgtgatccgcccgtctcggcctcccaaagtgctgggattataggcgtgagccatcgtgcctggccaggcacctgttagtttctaaacaattgttaatatcattcattactttatttctaaaacagcatgattgaattgagcatttccttggacttggaaaggtatgattttggaggagggtgaacctgtgtaggctgttgcagggagttccttgacattatcaactgaccagtccatcaacaaatttatttgttcatttatttattaattcaaggatgttgggtccatttttcagttagactctggaaagataagtgattggtcctatcccttaagggaaatatgctttcattggagaaataacatgtacacgctgtgtgtatgtgtgtgtgtgcacgcgtgtgtatgtgcatacacatgtgtatcttttttttttttttgagatggagtctcactctgttgcccaggctggagtgcagtggcatgatctcagctcactggaacctcccccttccaggttcgagattctcctgccttagcctcccaagtagctgggattacaggcgcccgccactacctccggctattttttttttttttttgtatttttagtagagacaggatttcaccatgttggccaggctggtctcgaactcctgacctcaggtgatctgcccacctccgcctcccaaagtgctgggattacaggtgtgagccaccgtgcccggctgcacgtgtgtgtctttatgtgttcaccctatggggagagaaaaggttcatgaaagttgagattactgtgggtagggttgtcagggagggctttgccgggagggggaagctgcgctaggcaagctgtggctccagagtcttggaggcgcctgtaacagtccctgcggtttcaaaagaattcagagaggggagccatagcctggtctccaaatgtgcagcaccttctgggcaagcttagacttaaaggatatcattgtagataatgatttgcttatttcttgctctaggatatggggactgtttctttttttctgggatgctttaataggatagtaaaagtaaacgtgtccctgtctgatggcccttggctcagctggaagaagatcagctctgctgcaatttaggaagagataactggggtccatcacgtggctggttcagaccagggttttatgactgggatttgcctgctggagccctgggtcactgtgccagactcaaccacaggtcacaatctggaactggatccttgctgccagatgggaggcgggcagggccagccctatgctgtcattggcctgtagccagctcaggtctggtggcaagtgaaggacacatcctgatgtctgagtgccctgcaatttattggcttgtggtttaggggtgtgggggacaaacaccaatgccacagttgacatatatgggcgtcgtatttggtggggtcaagagtccggagggaggcgcatccagcttctgtcttggctgcaggccaggtctgcccatgagacggttctcctccttaacctattcaatccaataatcgatgagcaggtattttctgagatctgaagtgtcaagtactgaagacatcaccaggcttggctccgtgggacacacaaggaattataaagcaggaccccctcatccccctcaggagctaacagtccaattgagggaagcaagagagacagacgcacgtgaaaggttaaacaacttgtcctagcctgaaagacaagacccgtgggaaacaattcaggaaatgtcaccaggcagcatcttcttagtgctgcaaagatctggaggaacgaatgaccagccggggcacaggggcgagggcttaggcttctggggtccggttacaaactgtgacaccttggccacctgggtttacctgtgtgagtcctggtctctatatccctcagatgggcacagtaagacctgcctcagagacatggggaggatttaatgagacaatgtgtatagcacattgcctgacgaaggggaaaaacctcactgtgatagttaatttattgtcattggctgcaggggccagagagtctttggggaggctctgctggtaaaggctgagcctagccttgtattgctcatcttttggataaggtaaggatggaacctttgtgaagaggaagactggacacctcctgccccctcccactgtggtttgagtggattttatcccgcatctgttgtttgcctggcattggatggccctccacaccagagagctaatgcctgccttcatcactagtgtctctgtctctttgtttcatcagcttctttatgtgaaaagagagaaatgatctctgtctctttccaaatcccagcaaggctgaataatatctgtggatattcttttctatttcttaataccctcgcattgcttatgaaaatcctatgggcacattgtaaattatctgcaaaaaacagcagagtgcaaagaagcagaaataaaacctcccataatcacaacagaaacatctactactgttcatgattcgttttattttcccccaaatatattactgtgcatttttctttataatgccgagatcctagaatatgtgcgatttagtgttctgcttttcttcttaacattacgttatcagcatttccaagtgacactgggactctataaacatattttaaatgactatatcttatatggatgctcactccttttccttatatttgctctttactttttcctcttttttgctattataaatagcattgtactgaaatccttctgcagggttatgtacattacctcattggtttatttatttaacagactttgagtatctacaatgtgcaatacaatgtgcttttagttctgagaggaaaccatctgaaatagcaaaaagagacataaatgaaatacctcacatgtagagttttgtgatactcttttttatagtaagtatacctggcttggagtaacactgtgggccggttaattgttctgggcctgaatttctgcatctttagtcactagatggtttctaagctgcctcttgtctccagcactctgtggtcctgactgcaaatgtaagaatcaccgtagcattcatctatccttgtgactcactagggctgtttgtgtttggagcattcctggtgcacagatgatgtgttgatggacttggacacagtctgttctcttcccctctcagtcatgagcagagcgttcatctgctcagtgcttctttttaataagtagttcaggggttgactgcagctcagctctgttgggaattaacacagacataatagacttttataaaagtgtgagcagagcaactaagccagtacagactctttgccacatcctgacatgctaagagagaggtcccctttaaaacgcaagcagggtaaatattagaaaaatggcaagaattcatagagcataaagctcataataaactcagagaatgcattgtcctgagaagtggtaaaggaaggaagtggaatagacttcaacaaaatggcatagaattaacggcagagggtatcatgtacctgcagggtatttgaaccgggtgattttgtgtggcagtgcccgggatccacagaccctaatgacacccaaatttgtgaggcattcttctcagtttataaagaacatgactgagaccacctagcacatttaaccgggtctgaaggaccagctaatttcctaaaaatagcagtttcttgctgggcatatgtcttaggctttgctggctctaagaacttaatattaacaattcacacagaaggaatcgtgttcagggcattgaccaatactcagctcacctttgaatggccagaggacacagctctaaagaaaggtgtgcaacaaggagtgtggttgagtgggcatgttatcttcctaggtcacaagtaacaaagtgccactccccaactccatattcataacagacatccataatctatcaggatgttctttctagccaagccaagatgcaacttcaggatcttttttaacacagtgctccaggcagccactaccacacagatggggttcatttgctcctggaataaaaccttgtcatccctagacatagaggcagtctttcccctgtgagccacagcatatgagaaaatgtcaccatctagaaggttccttggtaagcacagacatatggtggcctgataaattgcctttctctacccttgggatctttgtccaaggaactaggtgccatcttgagtcagactggcaagtgtgggaaaatagaattcttattcctatcagccaacagaatcttcagtgtttcgtgttatgataaggagttacactgcagacatttctcagagggtctgttcctgtgttttatcatgttttccatggcaacccctgtgggatccacgaagttggtattatctccatggcacagatgatggaggcccaaggaagacaaatgaccggcaggaggcaagtcatgcagctaagagcttttcctggaatccaggtgtcctgccttcagatgccagttctcttgctggttttcgtttttgtttttctaaaaatgttttcacctgtcaagtatgtgctactatgaattctgggagggtagggtcgtgtcttatttatttctgtgtttttgactgcttttcctctccaatctcaagtgctgtgactaacacataggaagtactcaagaaaatatttatggcatataagtcagtagaaaatccattcattcattcattcatggaagaaacaaggaggtgccccgacctcttttgcatgctggcctttccaagtctgcactgggattgtgccctgagctttcatcataagagcagggttctggctgtgaggcttacctgggcacatgcacctgagcagcagacgatgacattatcagtccactggagacattttcttcctcataaaaaggctagtcattaaatccttatttgcagcctgtgacagcaggagccaaaagcctctgacccgctcaggacctggggttagagctgcatggaccctgaagagagggatccctgtgctaaggccttcggacagtggccctgaccgagcagcagagggaagagggcttagggagcgggaagcaccaatgctgggcttgcaaagggcagagcagcaggagagaggctggcataggagggaggagggctcacaggagtgggaggtggattggatttagggccatcaggaggggtgggaggccaaacagctcagctccccagtccctttctggggccatctttgttttctgatttataatgtgtcccctttgcggatggccttttgacatgtgctaattataaattgtcctttggtgcattccgagagttctaataattagaatttctaattccagtcctctgagctgctcccagcagcctcatcctgtgagaggagcttgactcatttgctctcctgctcaaagtcgctggaggaggccagcaccgtgcggcctggaggaagtatccaggtttgggggtacgggtggaacttctttctgcaacccaatacagataacccagaagacccttctctttgtggttgtggtttgtgttgaagaggaagattttgaagtcaaattgacagggcaggatggtctatgaaaaagaaccctggactctggttttagtccagccagagcctcactgtgagaccctgagcaaggagatctttagacctcagtttccttggcataaatccaaaggaatcagatctgtgattgccaagggcccttccagttctgagattatttgaatctgtgaaatgtgcatatggcgtgttctgggtggaagtcctcaggtcatgttttgaccctgcttgtactggctacaggactttgtttgcaggccatgtgataacaagatattaagtgactttgttaaaggtcaaagtaagaacccaagccttgtgcttttttttacactgccttattttcatcattaatctccccttgccttggtttcttcatctgtaaaatgggaataataatacctgggagattgtattggtgaaagctctatgtaaaatgcagaccactaagcgtgtgtaaggatcttaatttcacttctagcctttgggagatgcaagttacgatttctcccctgcctccttcagcacgaaaccacaatcctaaagcatctttaggactgtatagtaatgtggcacctaggtttgtggtggggagaagacaggcactccggccccaactctgaagacccaccttgccttgcccagggagttgccccttggggaatctgataaatgtagatgtcagtcttgagaagccactgggcacccacctgtccttgtcctctttcgtaatggtgagcatgcttggcatagtgtagactttcactggtacacaacacgtgcactcctattatctcatttacagatgcccgggagggggacaagttgaggcacttagcaaatagagcagctgggacaggaacgaaagctcctagctccaggaaagagtcaagcagcctcctgacatcacccacacctctgtgtgctccttctgcagttgtcccactctgtcctccagggcttctcccttctaggctcatgatctgaggctgccccttgctacccaggggcaaaattgttagtcctggaaggctctttaaaggtcattgtgggccaggtgtttcagttaactgatgataggatgggggccaacataattgaatagttcccaagactgagcagcttgctcaggtagcctggctaaacccaccagctctcccggccaggccaatgtcctttctctgacaccctattgcttttctttccttacattctctcagggagtcatatacaatgacagagaagtccagggctctgtgttgtttggctgtccagtctttgggagagagagaaaaaaaaaagaatgtggaacctccagacagggcacaccctaccgcgccccatgtgagtttcctgaggtgctgtaacaaaggaccatcgcctgggtggctcacacaaccgacagttaccttctcaccctgctagaggctgtaagtctgaggtcaaggtgccagcaggattggtttcctccgaggcctctctccttggctcttgtagatggccgccttgttttccctgtatcttcacatggtcttttttctgtccatgtcctaatctcctgttcttataaagacatcagtcctgttggatgaaggcccaccctaatgacctcatttaaccataatcacctgttcaaagaccctgtcaccaagtacagccacattctgaggtcctggggattaggatatgaacatgtggatttgcagggaaccaattcagtccgtaacactctctctcacatcatgccgtgtgtgatttacatgtctttgctgtgtgtctggctcttgtagactttgcgttttcacccctgtcttcctgttggaagtcttggtgaatgatcaagggagaatgtaggccccagaatggaaggagtgtctcagggacattagagagagggaagcagagagactgcccacccacccttcatcattgtgactgctctaaggaccggccctgggtgaggcggaggaggagcgcacctgttcagaacgcagcgaggctgagcggggagctagctggcagtccttctagggagtgtagctgattaaaataattatattaactggccctcaaagagacttatttatagccatggtgacacgttattaaggatctaatttggatcaggactctgggaatcttatttttaggcccagaagagagccctgcaggcaggtgaccaggaggtctcagatggctgtgtattcactctgtcgagtcagggattctcaaggtgggaggcaattggaaaggtcgcactggcccacccttcccccgatgtctgtccccctgctccagtgtcccactgagagaccatccacctcttcttaaatgcctcctgtgccagggagcctgtttccatccacggaggcccctcctatcttgtgaaagtcaggctctactgaaaagcaagagagagatttctctctaaatcttctgtctggtggttctggtctccccctggggatggacagaatacatctgaccactgggccactctcttcaggcccttgaagacagggctaaagctcttcttggcctccactgctccaggctggggcccccagttcatcagcccccctcaggagataattgcaagagccttcactgctccgtttctcagaggatgtgagtgttcagttctgcggtccagcaactcctccaatgcctgcctcctggggatagctgtaattctgggttgagatgaaagttggccagttgaagtcaactggcctttggttgagggcctatggtgaaaacagacttcatctaaaaagaactcagtcagcaggcacctgcactttggaatcagggaggagaaagatggagactaggaactgacagaagggttttcctcgtgtgaagggcagcaccaggccatgaggtgacccagggcaggccacagccgtggagggttagggtacagcaccctggtgggtggccccgctgggaagtgcacatttgggttttggtttgccaaactcaccctgcccaatcctagtacgagcccaccatgaatgtcagacagcatagagtaagtgcacctggagcccatcctgagcccttgagctaatgtcttcactcctctgatctctgggttccacctgcctcctttgttgtttgaagggtggaacggactgatgcctatgaataaacacaagctccagcgctctccacagatgtcacagatgaaagactaaaagctgcttctgcacgcacagatatttatattgtagtgccaaacaacaacagaataaaaagaaataatttttagatgtgggaaaatcagactctagaagatgttttataggagctatcatggtaggatggggctaattttccaaatgcctattttcctctgcttccttttaaagttctctctctttttatttttttattaaagcaaggaaataaacagtatgtgtgtgtggtgtgtgtatgtgtatgtgtgatgtgtgtttagtatgtatgctctctgtgtgtgtgtgatgtgtgtgtgacgtgcatagtgtgcctaggtgtgctatgtgtatgtgtctgtgtctgtgatgtttgtatagtgtgtgtgtagtatgtgtgtgtggtgtgtgtatgtgtatatgtgatgtgtgtttagtatgtacgctctctgtgtgtgtgtgatgtgtgtgtgacatgtgcatagtgtgcctaggtgtgctatgtgtatgtgtctgtgtctatgtgatgtatgtatagtgtgtgtgtagtgtgtgtgtgtgtggtgtatttgtgtggtgtgtatgtgggcagtgaatatataatatatgtgtgatatgtgtggtatgtagtgtgtgcagaatgcgtggtgtgtgggtatttatgtggtgtgtgtgtgtggtatgtgtatggtgcatgtgtgtatgtggtacatgtatgtgaatatgtgtcatgtgtgtggtgtgtggtgtatgtgtgtgtggtgtgtgtatgtggcattatgtgtgtgtgatgtgtagtgtgtggtgtatgtatggtgtatgtggtgtgtatatatatatggtgtgtgtatagtgtgtgtataccacttgtatgtttatgtgtgtgtatatatgtgtgatgtgtgtatagtgtgtacatgcgttgtgtataatgtgtgtatagtatgtgtgtgctgcgtgtatatttgttgggtgtgtgtatatgtgtggtatgtacgtggatggtgtgtggacaatgcgtgtatgtgtgttatgtgtgtatgtgtgatatgtgtatataatgtgtatgtgtgtatagtgtgtgtggtgtgtgtgtgtagtgtgtgatgtgtctatatgtgttgggtgtgtattatgtatgtatatgtatagtgtgtgtggtgtgtgtgtgtgacctgtggtatttggtatggagtgtgtgcagtgtatggtgtgtgtgtagtgtgtgctgtgtgtatgtgtatggtgtgtggtgtatggtgtgaagtgtgtgtgtagcatgtattgtgttacgtgtgtggtgcatggtgtgtgtgtagtgtgagttgcattgtgtgtggtgcttggtgtgtgtatgtgtgatgtgtgttatgtggtgtgtgtggtaagtagtgtgtgttgtgttacatgtgttgtgttgtgtgtgtagtgtgagttgtgtgtggtgtgcactgtgtagtgtgtgttgtgttacatgtgtggtgtgtattgtgtgttgtatgtgcgttgtgtgtgtagtgtgagttgtgttatgtgtgtaatgtgtgttgtgtagtgtgtgttgcatgtgtggtgtgtattgtgtgttgtgtgtggtgtgtgtgtagtgtgagttgttatgtgtgtggtgtgtagtgtgagttatgtaacatgtctggtgtgtattgtgtgttgtatatgtgttgtgtgtgtagtatgagttgtgttatgtatgtggtgtgcagtgtgtagtgtgtgttgtgttacatgtgtgttgtgtggtgtgtgtatggtgtgcgtctatccattggatgagccgggctgcctctctgagggcaggaggccctcttgcctgcttcattccccaccccggttttctcctcactgcctcagctggcatagttgtgcttgatttagctcaaggaacaaagtaagagaatccaagtttttggacaaaacaaatgcctagaaattgtgcttctaaagaagtagtttttgatggctcttgtagagaaaccctggttgcttgaaatgaggtgagagtttcccaagttagaccccagtaagatggcggagcctgcacacaggctttaaaaatgattaaattactcgttcagtatgatcaggattatggtcaagtgccttctttctgctcttctgtctgacttgcagctaaaaataaaagtcaggaattagattcttctttttcttctccactgaagagcaccctttgtggtcgctggcgctggttaggaggagatcccctgcccagagccctcatgtggggacaggatcttccggcagcactgggtgttcaaggtagggtgccgggcctttggtttacatttctggatgaagctcttctgctgccctaccctccctctgtctgaggccacccggagtcttccctttgcggcacacagtaagcagctttagtgacacgtttccgggcctcacctcctcagtttgctgagtctccattacatctgtggcaccgtttaagcagcccataatcatttgtggggtaaattaatacagtacatgtctcaggccctcccccaggattggcatagggaactgagaattccacctgtttccctttcctggatccttgcagttggtgaccagtggagaagatggccctggggtttcctcctcagccccaaattcctacatccctccaaaagaacctcagagagcaaaggcagccggacgcatccgaccctggcctccttctcaccactgctgacagaaggagcagaatcttggcagcattgttaggtcttcatctgctattagctgattaaaaagttaaaaaaaaaaatctgtatccctgggtagcccagcctgttccttgctgcagttgaagactgaccgaggagctatcagcggcttcccggccactgtggtgccatttttggcctcaaacccattgtgaattgctatcttttcccccagccatcagccggaagatccattaacaaattaaaattccctctagagtcagaatggctttggtttctgggttctaaatgaccttgattttaattaccatgccatacaggtttggaagaagacaccatcactgaatccctggctccttgctgaggcagcagagagctggggtattcagtttggccacacttctgggcttgtgggtgatacctctgaagtccttattggtttctaaaggtctttgtgccactcccagtttctcagtcagctgccagtgagttcacacacctctgagaactcttccaggacccccagtaagcttgctctaggccccaaggagtcccctctggcaaccgttatattcagggacccttctcaagacaaatttcttgaggagacacagttctggcgctgccctctaaacgctgtgttttccttaggtggccaggcaaactgtccagagtggtgtctgctcttcacctcatcttgaaggtggacgtcttgaccagaaatcctccttctccaataaactggaaggagaggcttctaatttctgtaatgtggggacttggatggcgtgtggatctctaactgcatcctaagttgtctaatattgataaaccaaggagtagcggggttcctattgtggcctttgaaggtattgggtggagagaacacaggatgggcaggcgggtcctacaacagtcagcaaagtacatggctagagcaaaagaaaccttatgcaagtgcagatttgggactcaaaccattcaaccttaaggtgcttggggcgaagtggtcggggagggtggtggggattgtgaagtgtgtgacttgtctgcagaatttactgttctctgctttcattataagcctcttttctcacacagaagagtaagatgaagcatgcagagaccaggttgggttaagactctgtactaatcacaagtagtgcaagaaacatttgctggacacctactgagtgctgggaactgggtactcaacacatctctgtgaggaagggactattatcatttctattttcttgatgaggaaagggaggcactgtattagtttgctaggcctgctgtgacaaagtactacaggccaggtggcttacacaacagaaattaattttcttacagttctagaggccagaagtctgagatcaaggtgttggcagggctggttccttctctgggttgtgaaggaaggatcggttccaggactctctcattgccttgtggaagactgccttcttctccctgtgtatgtatcatctccctcctgtatatgtctgtgtcctaatttcctcttcttctaaggacaccagtcatattgcattaggacccaccctaatgacctcattttaattttatcacatctttgaataccctgtctctgaatacatcccattctgaggtactgggcattaggacttcaatgtgaatttttggtggggaacataaatcagcccttaataggcacagaggggctaagtaacttgtgtgtagacacagagctataggagaagatggcaggcattctgactccagaatcccctggttctgacagaatcccctgacagttctgacagttcgagaccagcccggcccacatggtgaaaccctgtctctaccaaaaatacaaaaattagccaggcatggttgtgcacatctgtagtcccagctacttgggaggctgaggcacaagaatcactggaacccgggaggcggagtctgcaataagccaagatcgcaccactgcactccagcctgggcgacagagtgagactctgtgtcaaaaaatttaaaaataaataaaaataaaaataaaaacaaggaaacaatatgattgtactattcaaaggataatacttaatttgcaaacttcatattaattcctagtgtactaccagaatgagatctggtaacaggataaaagtttaaatcagatgatcaatgccatattttttccttccatgaatacatctccaggaatgtgtacataacctaatcaggaatagcttcaaggtcaaaattcgtggtccctgtgaatgtagaactcggcgagtggccaagtggccctgctgtgcctccctgcccttttggagcagcctttcagaaacttctggactctctgaccactgtcctctctcaagtctggaaacttgggaactaaccttgacctcgagttggctttccctaggggcaaatgcaggcgctggtggaaaaggctatggcctttatagtctctggcagctctgtgtgtccacacaactgtgatgctgtgacatagagttctgccactggattctatgactgaggatgaagtccaactaaattgccatgtctggaaccctgttggatcatcgcactggcaccctggagtcccttgggatcccctattcgctcagcattacatctgctgagcactgctcagtcaacattagtgaagacaactgcttcggagacggactttccatcatcaaaaaatgcaaccaacagagagcttgattaaagtgtagttatttggtgtgaaacatgtcctgccaacagtgtggcagtacagacatgaattaagatgaaaactgacacagtcactgagtctcagcctctgagaagcagctgcaatgtaagagtttttttaaaaactggtgaatctataaggccaagagccaggagaggtgatggtgcacatcaaatggaggtggcaatggctttatgacatggtgcccttcacagtctggcctagaagtcaccttaagatcacaggctaggctctgcgttcctctagctagatttttcctagcacaggggtctggctttcttttttcttttctctactttttctttttttccttctcctcttccttttcctctcctcccctttcccccctccctcccttttttctttctttcaggtcctgtctatctgattgcaacttcactgcctctagggctttcaaatcaaaggtgataacctgcctccctcatggacatcagcatcccacgtgacagaacaggcaagccctcagttctgtgaagggtggtcacagcagacggaaatgtcctgcacaggaggcttgtttgctcatattctcccctccttacctttctggctccttactctctcactagagctacattcagcctgtctcttgcatcagtctttctgtgactattgaagccttcaatggttgattatataatgcagtgaactcatttcttgtagttgattacaatttaacatatatgtaatatgtagtatttgtttgtgtacttgattggcctttgtctctcactagagaataagctctttgaggacaggaatcctttctgcctatttcactattgcactccagagctcatgcagtaggttctcaatgcatgtttgttgaaagactgagtgagcatcgtttgggctctctaaccatcctctgagatacatgggtggctgtgtcaattgggctttggagatgaagaagcagctagccagcagatgatgcaggcctgggctttcttagcacagtgtgtttggctcaagaggaccacagtgatatcagttactcccctgcccacagggagcttgctctctagttagggagaccaggcgaagtgagggagagtgggtgtggagagtccatgctaggcactgaggatcgaggagtgagggcagccaggcttcagaggggcagagaggtctgggccaggaagaggtggatgcagccctgggcctcatggtctatttttgccttagttcctgatgctcccgccaagggtatgcccttgctgggcatcctacttcctgcccactgagctcctgccaggaacactttcttgggatggtcccattttctgccaagggtggatttggatctcttctttccctcttagcatcccatgggtgtctccataggctgaggcaggttgtggactgcccagccccgggaagcgtcacacatctagaccaccatatgggcagtgcctcctgaagctgtgcaatggagcagccttgggctgaaggatggaattgggaatctggcttggactggttcaccctcttaatgtaatgtataaaggaagagaatattcctagggagaggctacccctcgaccagtttttctagtctatgttggagggagcccacactcattaaatgcctgctgtttgccaggtgccgatagggtgctttgtatatgttaaccttattcaatcctcttgatagccctctgacactggcattgttattatccccattttgcagatgagaaagctgtggttcagtatgtttaaatggctcacccaaggcagatacagctagtgagtggcagcatccagaatcaaactcaggctgttctaactccaaaactctgagtatttctgtaataccagaattccttttaagacctgggaaaagcccagcagccccaggaggtgccatcctggagccagaaggagggaccagcaaagttgccttaccatttgcattaaaacaccctccatagctgtagactgactggtgcccctgggtctgcaggtaccagctttgcacttagttgaatctccagccttaagtgtccttcccaaagcccagggaaggcaacgcagtttgctgcagggatcgtggcctatgcaaaggcctcattgccacgctcagcatcatcagagactgtatgtttggtctctggatggaggccgagagggactcaggcctggccgtctcagaacttaatacttgagttaccgagtgtgtgtgtgttttattttggggtgtgcttaagtctctcatctatttttgttttagaattttggctattcctttgttacctacccaagttgatttatacacggccgtcgtcctgtgcagaaggcaggtaattggccacttcagccctgggctaatggagggaagcaattcatttgatgaaacaagttaagcaataatttagaaactttctatctgaacccttgtgatatcatatcctcccagatttatcctcttaactctgtccaactcaggcaatagtcagaatgtcttttcccttcctgtcctcacaccagtctgggtcagctgtcaaggacgtgggcaccttgaggtacttaaaagagtttctcttagagggccgggagcctggcttcccgtcctggccctgtttctcactggctgtgtgactctgacccactcacttaacctctctgagccccagaagccacatttctcaagtgcagtagtgatattgaatgtcccaaaggcaatgggtaacaccagaccagggatttccagatgaaatgctctggcttacttagcatgactcagacccgctgcttccccattagcaagaggctgctttataattttttttttttaatggagagatatcaaggcttaaaatgacattaagaagtcttcttcctgactgcagtgtgtccttcaaggatcatctccccatctacctctctgtgtactaatgactccaagaaagcggaagggggcagcctggtagaaaatggaaacgtttttctgtaaaggccctcccatgcttccgaggcctgcagatgaagggtctgacttgagcctctcagaacccaggagaaagaaacaagcctcactcatcctgtagcccagaggaagaaattctagcacccagagaggtcaagcaagtcctgcaaaaccacacagcaatttgatagcaatagctggaccaggaactcagggattttgactcctaatcttgtgcttctcaaactttagtgtgcacaggaaatctgaggatcttgtggcaatgtatattcgggaggtctagggtggggtctgagattctgtttttctgatgagagccctggtgatgcagatgccgctggtctctggagcttacttggaatagcaaggggctccagaaagctgggaggctggggtctttgcagcccaatctaggagggagtagcccttccagctcctgtcgcctgtcccacttcctgttactaatttgcatgttgcctcctttctttccctcatgctcctaaggcctgggcactcccttctctgccaccccctatgcttccccagcccattttctctggttccgtcttgctcagcctttaagtaaacagcacttctcagctgggttgcatgaggcctcctggctcaggagtctgctgctctgggctcacagtccctgttccatggagatttgagtgcctgaattaactccctcttggagcaataaaccaccctgagtgctaacctagtttgtatttttagcgtgtgctccatcaattacttaacttgcagagcggctcctctctgctcatcagggaggtgccaccaaagaatgttcttcctcaggcttttgtgagttgcccctctccttggtcccacctcctgtgaggtcagagtcctttctccttgatgctgtatccttggtatttaggaggcaaaggttattcaccccgttttatagaagcagaggaaacactgaggtccagatagggtgacaacacagtacagtgtgatggtgccaagaagcaggtctcctaagcccttcaccttcccactgtggggaggtaacaaatgatggtgggtggtatcttcccaggctacgcagggccaggaggctctctctgagccagttttgcaagatagtgatatgaagggaagcaggtgggggccatgcactgtgttacctcaggtagaagtgagctcctcactgtggtttttacttgtaaagtccagccagaaaacctacatgctgggagaatggggccaggaccactttagtcagtggtttcttccaccttctccccaccccaggaggaccttcagccatccctagataagtcaagacttggtttgagtttcatcgaggtttctcccacctctggcagaggcatggatcagcaacactccaccaagaggccagcaagatgctggctgtttcccaagctgggatggggtgagagagtatggcttggaaactcagaggtgatagaggcagcaccggcttcctgagccaagctctccccatggacccaaggcccaggcatgagacgacttcattcatccgtccattgaggaaacgtgagcactagttgtgttcaagacaccaggcagatgctgtgggtgggcgggactctctcccgggggagagcccagggcacagtccctttcccagggaccttacatcttccagggaaagctcccatgtctgtctgtaaaggtaaaagctaaaaacatcacacagtgtgtaagtgcatgtgtgagggtgtgtgtgtttatccatgtgtgcataggtatataagggtctctgtgagcacatgagcatctatagatgtgtgtatgtttacgtgtatgtatgtttacatgtctgtgtgtatgcatgtgtatttatatgtctatttgagtgcatacatttgtgtttgtttgtaaatatatgtgtttttacgtctaagtgtgtgtgtgcacatgtatgcatttgtttctccatgcatatatgtatttaagtgtatatatgtttctgtgtatgtgtgtgtgtgctcatgtgtgtatgtgttagcatcagtgtgggtatacatgtgtatatttgtgtttaggtgtgtgcatctatctgagtatatgtgctgtgtgtatttatgttagtgtgcatgtgtctgtgtgcctgtttcattgtgtgcatgcgtgtatgtgtgtgcatgtatgtgtttatgttagtgtgtgcatgtttctgtgtgtgtccgtgtccgtgtgtatgtgtatgtgtgtctgtgttgtttatattagtgtgtgcatgtgtctgcttgtgtgtgtgtgtgcatgtgtgtgtctgaatttgtgtgtctgtgagcatggtactttgggctgtgcctctgtgaagccccatagtcagtggggagtccccacacagccctggctataggctgctctggaatttgcctttgatgacttagataggcatgaacaggacatgtcccctggggaagatctgtgagtctgtcctgggtgtccccggggcaatgggcagactcacggggaaggaagaggaagacaaagcacacagggtcaacactattgcatctggagcgtgcctgggcccatgctggatatgtgacagactcagaagtgagccagacctgtctagttggggcaacaagccccgtaagtgttctgcctggaggggtgctgaggcaggaagtaaggaacctctgtggaggggtgacctagtccagccctaaatcaagggtagaaggctgggtgatctgtgtccccactctcctcagtattgaaatctccttaagcccaagactgtactgaatcatgaatcaagacacatccatgtctggtcctgactctgccgtcactgtgtgaccttgaataagtcgcttggcttctctgggccttgcttccctccctgtaaaatgaagacattggatcatctcatcatttaacaggaacaatgaaattctacagcgaaacaagttgccccacaaatagcagggtggggcaagggtcaccacagaagagcaacttggaagtggtctaaggatgtggctaagaaaagagggagggtccagggaggcctcttttttgaaaaaaaaaaaagagggagtacaagtgcggttttgttacatggatatattgtgtagtggtaaagtctgggcttttagtgcacccatcacccaaatagtgtacattgtatccaataggtaatttttttttttcttgagacagagtttcactcttgttacccaggctggagtgcaatggtgtgatcttggcttactgcaacctctgcctcccgtgttcaagtaattctcctgcctcagcctcccaaggagctgggattacagtggcatgccaccacgcccagctaatttttgtatttttagtagagatggggtttcaccgtgttggcaaggctggtcttgaactcttgacctcaggtgatccgcccacctcggcctcccagagtgctgggattacaggcttgaaccaccatgcccagcccaataggtaattttttatcccacaccccctcaccgtcccactttttggagtctccagtattattattccattctgtatgtccatgtgtactcagtttagctcccacttataagtgacaacatgggcttttagtgtacccatcactttctgtctgactttgtttctgagttagttcacttaggataacggcctccagttccctctgtgttgctgcaaaagacatgatttcattttttttctaaggctgagtaatattccatggtgtgcgtgtgtgtgtgtgtgtgtgtgtgtgcacgtgtgtaccacattttctttatccagccatccattgatggacacttaggttgattccacgactttgctaatgtgagtagtgctgcaataaacatgagtgcaggtgtttttttggtctaatgatttcctttcggtagatactcattagtggggttgctagattgaatagtagttctattttgagctctttgagaaatctccacactgtttcaggaaggctacttgagcttggtcttaaaggatgggtggagagggaggcagagagaataataatacaggaagaatctgagaggtgggagagcgcagcagactttatcaacgaacattcatatagcactcactgtagagcaggaatcattctaagataggggttagtaaactatggcctgcagggcaaatctggctcactacctgattttataaataaagttttattggaacatccatttgtttacatattgcctatggctggtttggagctacaaggaccgaagtgagaggttgtgagagtctgtgtgacctgcaatgccatagaatatttgctatctggctctttatggaaaaagtttgccatccttcttataagatctttaaaagcatgggctcatttaattttcttgacaaccatattggaaagttattgttattgtgtccactttatagatgaggaaatgcaggctcagagagatcaaatagtgcgcctaaggccacgcagtgaggaaggaggagatgagacatgacctcaggcagtgggctccagagagtctgtgttctggccactgtgctatgccaagagcgggcccctgggaggaaggctaagctgtgaagattttgggtgctggtcttcagagcactttcttgaccttgccaggtttgtgaccagcacagtgatgtctcaaagctgtgttttgattaccacaataatgtgggtattcggggaccagcctgcctaatggggacgctcagtctccaactgtgtctctcaaatgctagacagttcttggaggcaacacctacatgctgttagccaggcactgctcacaagggtttctccataaagatttccgattttagcttattagtcagtgtttgtatagttgctgcatgctgtggtctgtgtcccagctgcctgctgtagatcacaaatgcttggaaggcctggattgtgtctctctctgtgtgttgtctccagggagaatggcttgtcatcaggtcagaggattctggggccacattcccattgcgaagaagctgtcaaaatgcctgcatccagaggtgcttcaacaagagcagaggtgatgtgcaggaagggctggtgattgtggcagaggctgtgaatgccctgcccatgcccccaggccactctattcctatcccactcaaatgcccctactgtcagtgccttccctccccctaccagtgtgagccaagacatctggaagtgcctgcagcaaatacccccaggtgcagcccttgccaatgatagaccctaatgggagtataaataccccagattctacccctcagatgacacagctctgaggcatggtctatgccagtgctacccctatgattttctgtaatgatggaaatgttctgtatgtgtgctgtccaatatgatagccaccagccatctgtggttattgagcttttggaatttggctagtggactgaggaactaagtttttcaattcaagtaatttaaatgtagatagctcaatgtggctggtgccttccatgttggacagggtggttctgccccatctcccagaggtctccagtggcattgagccttggttgtctgcagcagtgtcctgaccattaacaaaccctgccctctcactttcccattttatttccccactccccagctggttctcccctgggatcactacccaaataaactattcatgtaagccacatgaaattgccatttttgaggttaaaaaatggttgaatgtcagtattttcaaatgattaaatttgcactgaaatctctaccatgcatgtgtgtctggggaaccccaccataacagggagttgagattcgtgtttgttcatgtgtgtaagttgaagtcattccctgtccaggcagggttctaatcccagctctgcttccaagtggctgtgtggccttggaaactctctgtgccttggtcctcagggaggaggacctgcccatacccctggccttggtgcctgccctatctttagaatggttggaaggaacaagggagctcatagatagggctatttgttaaaagaagccagcacagtgaggagggaaggtgccctcctgcatgggtggggccattctggggcacagtgccctggctgcattatccctgggtggaggatgcctgcttgtggctgatggaattcagacagtgtgtttctttgatgctacaagactggctttcctgctgccccactttgtataatcgggtctttttggcagggaggacttagtagctagcgtgagctcccaagtaggaactctaggaatattcactcgggctgccgtttgatctgagcaagagcatgatttgatgggaggctgctctgggccttacatttgtttccctcatttagaaaaaggcagtaaacagtttttaactacattgcgattgtgaggcttttcctatataactttttttcctggaatggaaccagacaggatggaggcactgcactcgcaggcaacatgggttttcccagcccctccatcttcttgaccttcctagggatttgttaattcagctcagattggcctttccaggaagctaccaggctctcagaatgcccgtgctggagggaggctgatcccaccagggaccccagaggaaacccagagttcatgccaaaatatctagtagaaggagtttatatggggaactagttataaaggtgtccaaggagataaaaagccaagcaaaaaatggagaggcagcccagagaatagcaatggcaggaagctgctagcatcctagggctagagggggaagggaggagctggttttctagaactcaggatccagcagcacctggcggatgctggaactacagaaggcctgctgggctgggcaggatcacagaggaaaggactctggggagggcaggatacccagaggtgatagatataatgatggacatgttctctatctggagatgccaccaaatgcagaaggagggagaaatgtcctggtttctgcctgcccccaccctgcagacttctgcctgcattcctgctgaatagaacaaacttccctagaagaaagagcgagggagcctggggagtgtagtccacagtctacagacgaggggtaaagactgggtctcagagcaagcaggccaatgactagcagggcggcccaagagcctttaagtgagaggctgtcatcctggggctgtgaatgaacttcggaggggtccttgcccttctaggaagtgcaggcatattttgtctctatgtaagcacatgcatttctccagaaagaaagttgatatcttcagattctcaagttggtctgtgccaccaaaagattcaacataatcaataaccagtaatccaaccagcttatcttaaacatgggaagtctcagggctcagagaaacacccatagcgacagtgtctatactcttggtctagggtcctactggatgttgtccttcaactgtcctggaagatccagcctgttaggagagtcccctgtctgttccctgcctctccagaatcaactgtgtcccatcttcttggtcagctttccctgatctcaagcacacagacctgcttccacagtgcacttctgcagcctggggaaaccacaccatggatgtggatcctggtctagatgcgccacatagtgctcgatgcaggcagagctggcactggaaagagggcccagtctcctccatgcagcctccctccttcagcaaacatttgccttgcacctgccatatgccagacgttttgctaactgccggggatatggcactgatcaagatagatgatgtccctgctgtcacggaggtagaagtggaaacagaaaacaaacaagagaacaaatgcagcaacaaggtcatttctgattatgataagtgtggagataatagagtagggggctggcagacagtgatgcgggtagagtctgggggctacttttgatgggaaaggtttctctccggaggtcctgtgcaagctgacatgagaaggatgagaaggagccagctttccaaggtctccagagaaagtatgccacatggggacaaaagccagtgcaaagtccctggggtgggaatgagcagaggaagaagaatccatgcctatgtggccaaagacgaatcctgcctcacagtctttgactcttttgacttcccctgtcgtgcctcctgcagactcttcttgcttccctgggagaatgggtggcaaagagtgccttccttagccatgcttccttgtcagcacagtgcctggcaggtggctggaagctacagctgaatttttgcagtgtctttgagatgccaggaggatggcagatcatttctgttcaattcatcagccacacaaaagccctgagatcaaagagcatgggcttaatttattttgtttattttgcagaggaaatagtgcttccttggactgaaagctctgaggactaagagctgaatggaaagggggcgtttggattaaatgaatgggctggccagctctgacccaatttccacccagtgcagcagtgatgggggagggaattgccttctggctctctgctctggcccaggggctggtcatttctcaggtctgggccttctgtgtgagtcaggtttgatggaagtgtccttgaaggtgattcatggggaagagaggaggggaaccgggagtagtggcctcaagccctgcctgagttcatccttggatccctcagcctttcttgacactagctcatcaccttagcaatgaggacaggtgcagattcaggtgaagctcacctacatttcataggagcctatcaaatgtgagtggactcggagaaggaaatcactgagcctcacatggcaaaggagcactcaaagtagggaattctgaggaagcctagaatgggctgggcagggagggcagggtacagtcccactcatcatcgtgaccaggctggacctgtgattgcagtgaatgagacttggccaggagaggcttgggtctaggagtcctgggttcgagttccattaattatttgaccctgagctggtgactttttctattttagaagcctcagcctcttcacatttttgagtaggagtaagggtagctgcctgtgcttgggcttggtgtgagagcccggttctgaagattggaaagtattgccaagcacatggtaggtactcagtaaatatctgtttacttaaatgaaagaatgcatgaataactgaaagagatcaaagctgatatattcttctagaactttatgactacagggaatgaagattaatatggcaaggatagggaggaagttaaagccaactgccacaaggtacctgtggtggagggtccagggttctagtggcttggcccactctttcaggtgccctcatctcagaaagatcaatggtgcagacagactgcagtttatctagttcacattggatggatgccttggatccacagccctaggatacttgggcccatttttggatttcttgctcttctagattgttttagacagcagtccatatgaagaccttaagagagaatatagcccaagagtgatggaaggctgcaaccatgacattttgagtatgctccactaattaaaaattaaattgttaatccccaagtaaagaaggaaaatgtgagggcatctgaagaagagagcatgttcgtgtatcgtgatcgctgatcaactctaggtttaacagacagaactttatgaatgaggaatgaggagtcatctaacttagggtagagtgaaagggggtcaggtggctaaaacacaaaactggtgaaaactgctaaagatagccacagacatttgtaaaattataggcagagaattagaagatgaacgagatgggagagtatcactgcttgggaaatgtgacactgttagcaaacagagaaacaaactagaaagtgagcatttctgttttttttctctctcttgtttctacctaggattactgtctttagaatgaaaaagagaaaatctcttgcacagagctagagaggcactttgaaatgcatttctaggaccagaggggctctatggctgggtcctgaaatacactgtagatgtggttgcagaagtggggagtcttttgatggactattttttcattatgggttcaatttttttgcctttttgaatgcctggtagtttttgattggataccagacattgtgaattttaccttgttggttgctggatatcttagtactcctataaaacattcttgagcttattttctgggacatgatcaagttgtatggaaacagtttgatcttttttgggtcttgcctttgagctttattaggtggaaccagagctctcttaatctagggctaattttttcccactacagagacgctgctattctcagtactctaccaggtgctctgtgagcttgaggtttccactctggctggtgggaaggtgaaccgttcccagccctgtataaactctgggaaatgttctgtctgctcctttagggtgtttctctcccccaccttggatagctttcacacatgcctgtgtccaccaatacttagctaaagactcaagggggtccctctgctgacctcaagtattcactgggcagttctttttgctgccctggcctgtgaattccagcctccttggccttgctggaatccagccttcatctcctcaactcagggagacatctgggccctgctggggtcctccttctttctgctgtgacttggacgctctctccagacaggaagttgaggcaactgtagggctcacttcgtttctcctctctcagggattgctgtcttcccctgactgagctccagtgtctgaaaatcattgtcttgtctgaatttttagttgtttcaggtgggaggagagatctagtccatgctacttctttggagaatctttgaatggtgagataagattatttatttatttatttatttatttatatttatttattttttacctctagcattctggaacttcttgtgcttgttagaatttctcagtgggtgtcagaagatggatgctgtaatctgtattctaatgatgtcgtggcttatctctggaaatactcttgattggattttaaaactgagtgcttaggagcccttagagaggcaaatgctggtcacaggggccaagctagactctatgcaaacaggtcaggctggaatccccagttatcaagggactgaagttaacctgaaacgtttcctttaccatgacttaacctaaggtgcatgataatgagtgttaactgggtaccaggcttgcctttacaccaggttctgtccttatagcaaccccgtcagctaggtacccccatccctgttttccagatgagattaaggaactttcccaaatttagggtctgaattcacatctgctcacccttaaatgagatgccgcattgggcagcatctttcttatcatcttgattagggaggatccaagagctggaacttgaatatgaatcagtaaaacaaaaacaaagaatcagacacaagataaaggatccctctttgtccctgaattgagataagaaaacatcatcagaagcagatggaggctaagtactgattcccagaaaaggcctcatttttagaagggtatttagagattattcagtccccaacttacagctgtggttggcagaagccaagtggccaacagctcttgaggtggtgtcatactcatgggcagacagaaacttccctgacaggattttcccttaaacctccatcgcatgaaaggactttttttgcgcatttataaagtgtataattactatcccagtagctagatgcaaccttgtcaattataaataaatcatcacctcgcctcctcatcaccacccaaatgtctttcacactccaatttaattaactcacttactttattctctaataaactttcacaaaagttaaccccccattcccagctccatctagcaaagaatgctggctggatgtcagccatgttttgggcccccacctgaatctccgcctcaaatgtaactcaaatgtgatcatctcccccatctggggtctcacatgaggacatgaggtatgggacatgaccaggaggcatggccagtcttactgtctggattgccctgggggtcatggcaggcgaaaagatcagagaatgagaaattccttcctccttccagaggccaggtgggagggcgggggaaagggcagggtcttgttgaattttgttaaaaagcactttgctctcttggaatgctatctcatgtctaaagcagccaagatcattaagtaaatataggatctgtgcttttattttcactgctattagcaaagtttgcaggaggaaagagacattgaatggggagtttcatcaaagccaggggtgttccacaggaaaatacttgttaggcctagtttcctgtggtgaaagtcttatacatttcaaatatgttttgtgactctccacaaactttttgtttcctgcaggtttgtaattgagatatatgccctggggagaaaaaacatccaggcatccaggtccttagaaatataggtgccctgataggactgtagctggcagacttgcccataaaacaggtgaggcaggtgcttgaacatgtgattcacatgttgcatagactgcctactcctgggcaggggcacacttggcctgtatttgaatacacctagacttcaaactcagtttgtgaatcacctcctttggaagctgtccttgcaccctaggctggaagcgagctttcgtcctctgaacttcaattgccctgtattcatacctctgtagttcgggctctgctcactttctacctgggatttgagttggtacatgccttctcacctactcgcctggactggactctcctttgaagacagggtcgaggttgaagtcatctttgtgacccctgcagggcattgcacatagcagatgtgacctctcgctggtggtcagatcaacttcaggggcacagggttcctctttttatctgcccgatggcctttgtctagtgtattgctcaggatgacaataagaggaagattctccccctgtttaattccgggatgtcactggtcaggctcctcttgtatctcaggggtccagggctgagggctgtggcttcagctgaggctctaggctaagccagtagggcttgtgtcttgtattattctgttctcatgctgctagtaaagacatacctgagactgggtagtttccaaaggaaagaggtttaatggactcacagttccacatggctggggaagcctcacaatcatggcagaaggtaaatgaggagcaaagtcacatcttacatggcagcaggtaagaaggcatgtgcaggggaactccccttaataaaaccatcagatctcatgagacctattcactataatgagaacagtatgggaaaaacatgcccccatcattctgttacccctgactgggtccctcctacaacacatgggaattattacaattcaagaggagatttgagtggggacacagagccaaaccatttcaggtctactactttggtaacctcctggaatgagtctcatggggcccttctatcccctgtactcatgatagtatgactctttgggtgggtctgaggctggacatgactggtggtgaaacccaaactcttattagagaaagtatatcctcttactagtgagataccttaaagttttgaaaaggaggctttttatgataataaaattatgcttttatgggagaaaacttggcaaatacagaaaaattataaagagaaagcaatgtctgtaattctgcaatgcagaaatcacatttgggtgtattttattattatataatgaaatgttattctgaaaacttagattggttaatatatataaatgttaatatgtatattggttaatatacataatatatgtaaagctttaaaatatacttagtttaaaaaataaatctgggtacagcggctcacgcctgtactcccagcactttgggaggccgaggcaggtggatcacctcagggcaggagttcgagaccaacctggccaacatggcaaaaccccatctctactaaaaatgcaaaagttagccaggcatggtagcgggcacctgtaatcccagctactcgggagactgaattaggagaatcacttgaacctgggagacaaaggttgaagtgagccaagatcgtgccactgcactgtgtctcaaataaataaataaatgaataataaagccaggcatggtggaggaccacttgagcccaggagttggaggctgcagtgggctgtgattgcaccactgcactctagcctgggtgacagagtgagacacattctctattttaaattaaaaataaataaataggccaggcgtggtggctcacacctgtaatcccagcactttgggaggccgaggcaggtggatcatgaggtcaggagatcaagaccatcctggctaacacagtgaaaccccgtctctactaaaaatacaaaaaattagctgggcatggtggtgggtgcctgtagtcccagctactcgggaggctgaggcaggagaatggtgtgaacccgggaggtggagcttgcagtgggctgacatcccgccactgcactccagcctgggcgacaaagtgagactccgtctcaaaaaaaaaaaaaaaattaaaaattaaaaaaaaaattgaaaaagtgaaatgaaataaaagtaacacatatggtaaacattgaaataacttataaaaatataaaatgaaaagtaaaagttttctgcccaccctaccccacccaccctaatcctggaaacctctctccaaagatgtctactctttctaaattcctttgtatgcctgtgggtcctgggagggatgcatataccagcatttacatgtgtgaatacttagtttatttattgattcttaaacctagaaacatgtaatgagcatttccccttgtggttgctgacatttcaaaactatttttaatagcatcaccctagtttatcatgaggatatccagtctttattttctgttgttgggtgtcgagtttcttgccagtttatttcttattaaaggtaacacttcaaaataaaggcagcttttttatttaatataatttggtgtctctgcttatttttttcaggataggtttccagaaatgaaattattgtagcaaagaacagatttttttttatttcaatggctgtttgtaattttttttttttttcggagtcttgctctgttgcccaggctggagtgcagtgatgcgatctcggctcactgcaacctccacctcctggattcaagcgattctcctgcatcagcctcatgagtagctgggattacaggcatgcaccactacgcctggctaatttttgtatttttagtagagacggggtttcaccatgttagtctggctggtctcgatctcctgacctcgtaatctgcccgccttggcctcccaaagtgctgggattacaggcatgagcactgcacccggcctgttagtagtattttgttacatcaaattaagatacattttcaacagaaataggaccatttctcttgcccataaattctttttgatgatttgaagatttaaaaagtaatacaagaaaatatactattgataaaaatttcaaataatacagaagtacacggagggagaagaaaaaggggccctttctgaacctcccttctcacatctgaaagaaccctggaattggacagacctgaattcaaatttagatgtcgctgctgatcagttttatgatgttgcgagtcttgattgtctcatatgtaaagtgactatgtcaacaatagccttgtaagattgtggtgaggaaaaagtgaatgtgtgcagaggcctggccggtggcaggcactgtgacaattatcgtctttgttggtaggttgattgcctgttctctgtgtcatgtgtacccagcagactccagttgatatcaccctagaaaacaatttcctcattctgataaatgttggcccttttctgcaagattgctttaaatttggagccgatggaatcacaaggctgtgacctctccatgcaggagacagtgtttctagcagcttgaggggctgcagctgccccaccgagcttcaacgggtgtcctggtgcaaggttgtcctactttttgagtagcaaggtcttttcacccctttatgagaatgggcacactctggatatctatttctgagaactctgacactggagagaaaacaatcagttgagagaaatcccagcttggatgggcattcactgaacatccccttggaacatcagcctgctcaaaattttaggcatgacaccgtaaaccctgctatttatattgcaccagattctgcaaatatctttagtaacactaagccctcggttgttttaactgcgtctctaattataacctttttaatatttacagtggtgtcatgccatcctgattaaagtgccgtggtgagagatgctgttggcacctagtagcagcattgctgatgagaaggtgtcactaaagctgaccttccatcacttcttaagtgagccatcatttaggatggacacagaggtaccaatgagcccctgttcttgatcccaggatccaaaacctctcaggtgaggcatctccttgtgtgttcttcaggagccagcatgctgtgtgattcctagggagccagaggaagccatgctcttgtgatggcatatttatttcattggcctcatgtcatttggtctacctgatcagcagctgctgtgagtgtgcctgaaagagtggcaggctctgcaagagctccgtcagcaagtagaaatgctaaattatctcatgtgtttatcaaaggtttattgagcaccttttgtggcagaaacatgggctataataataatgaccattgattgaatttctggtgggagatgggtactggtggagaccagtttgagctcatgatgtttattaggaatccacctctgagaagggagaggcagaggccagagtgacaagagggacaagtcgagagctgatgcagcttccacaaaacctcggccaacccagcagacaactctggagtggatttatccaacagagatgatccctttgggcccaaattgctgtgcttctgtaccccacctcactctgtcaccagatgcaggctgtcccaggaagggtgaccttggctgaagctgtagctgaggctgagcctgaaggaaccgacagctgggggctgtttgcaaagccgtctccctgaagctgggcctcaagtccttcttcgaggtgaggttgggggcagcacatctccatggcatgcagagcttgatgaggagcttgagtttgacctgaccctgaagggcaagtggggctttggtaggcagagaggagcaggaagaacttgccagctaagcaaaacagtgtgaacaaaggtatggaggtagaaagagaggactttgtaaggaagtgccaatatggaaaacattgcagtgtggacgcctgggcagagaggctgtcaccttgagaaatggccaggggccacctctagggtgaccttctctggtgttactttctagctatcttctgaagcctgtctttcctgcccactctaaggaagtcaggtcaacttagggatgtgtcttcccaagtgacccccattggcctttgttggttgtcctccaagttattgccttgggcaactgggcagattatctgcatcttcttgcacagagtatggattttcaaggctcagctcatccttgactaagattgaggtgacttctagggcggctgaccggggccttgagaatctccctgggccctttcattcatttctcttcatgggctcttttggggtgggtgccaaggatctgggtacagcttccctaactcccaagcttggagaggccactctagctcttggactggcatctgggccagaagctaccagctaggcaacccatatttgctgggcatctaatagcccctcagatggtgaaaggctggtctttggcctggatggcttatctgtttcctcagacagctccagactgaagggacttcataggcagtgactctgtttagtttcactggtggtccaagggcctccttagctaggccctgggggaatcaggggctgtaagagtgggacaccgaacagaagtttcatctcatggaggcaggatttagaaagtgtagatctctttgaagagaggtttcagggagagaggtttcagggattagggtccagccagctccctcccgatgccagccttacctgctaagtgccttctaagctttcccactcaccctgtctgtgtttccagcctcttgtgtttatctctctctccagcccacactgccttttggccgaaaagggccataccttgagtccctgttgcatgaagttggatttcctttcatgtgtcctcagaggccctggcttgggtgttgtcatggcattttgtgatttgatggaggaggagagatagagcggccccatcgcctgtttgcgctagcctctctcagcttgaccgatgactgtgatgacatctgtggacagtaagcaggtccctggtgggattgagtttcctgagctattccatatcagcattcgagaagccagtacactggctgctaattgtgctagcttgtacctggggctgggtttgggtttcaggtccctcccttcctccctttctcccaatgcttggtcttattaggaaacattgcatcgctaaaataacaattactctacagatagagtaatagaagtgttcaaaggtagggttaattagaaactttcattaaaggaccttggaccttgttgcaattggtcattcattgatatttttctgatcaacaaatcaaccatagtttcttttgaataattgcaagattttttttatttttcatatgtgtgtgtgtgtgtgtgtgtgtgtgtgtgtctgtgtatgtgcgtgtgagagagagagagagagaatatggacgatgcagaggtggatggaggattattttctgttaaaatccccagcgtggctcagctcacctgtggggcctgcctcagctctgcatgccagctttgggctgccagatagtcttggagcttgccttatagaaagtggggatcctagccccatttttttcctgtggcttccctgggtttttctgaacatgaacaaaccttgctttccatctctaaacgctgctgggtggtccttgccgttgggattctggaattctggccctgtctggggtgagccttgggcatctatctcataggcactcatgcaacctcagttgggttgctatagaaaccaaatctcatggcctgctgggggcctgtttagttctttatgtcctgcctctgtctggggagataatgtggatggtgacactgttgttcactgctcaagtggagaattccctctatcacccaacaaggcttttcaaggacccaaccacagaagggactcggtaactcttgggtgtgtttttcctcttgctcggtgggggaatccaccttcaaagaggctgcccagctgctccctgggactcagcaggttcactggggctggtggtcctcaagtctttttgaatgccggggaagttcccaggacaatctccagagtggttaggaggcctggaattgataaccaccctgaggacagcccccgtctcaacatgggagacaagagaggcatatggcatggcattatagcattttacagctcatggaccagctgataggatagtgaatataattgccatgtgacaaactaaagtggctacaagtgagctaacaggtgtcgtttcattattaatttcaatcaaagtcattagttgctatttagggatctggctgcttggccacctacaccgtacttcatctggctgctacagcttttgaagaagacagagaaaagttctctttctctcctcctcctttcttcatccttggagaatttactatggcaaaacattgggtaagtctctggactaagtcttttcccagtgcaggagtctgaacaagtcactgcagtaattttgtatgctggcaagccccagccctattaagtaaggtcctgcaatgtgcttgtcacctttctaaattagagcctcatagtctcaaaacggtcctttgcagaaggatttctttttttaatgacttagcatacaggtcagtatcccatgtgtacttagaaaggatttgtaatctctatttcatatgcaggaagtctctctcccttttataattttaattttatttttactgataaataataaatgtacatatgtacatgtgatatttaatatagtcatataatttgtaaaggtcaaatcagggttattgggatatctatcatattaaatatttgtctttatgctagaaacctttgaattattctcttctagctactttgaaatatataatattttctaaactatagtcaccctactgatctatcaaactctaggtcttatttctgcagaagatatttttattttcattttagcattcagtatttctttatcacaaatctatccaaagattgtctcctttggttccatttgaaaagcaacctagaaagcactttagaggtggagctcagatgttgccatttctgaattagaaataatttggctcagaaaggttaaaggaaacagcacagttgacctagctaggaagtggcacagctaggaattgatccctggcctctgattccaaagcccactccctccatgttccacgagagccaatgcagtgccaggcagggtagattcctcgtgtgctggggtctctgaacttcatgaggggctgccattctctccaactggcagcgtctcaccctgccctccgtgttctctgtgaagcctagtccagccatactcccagcctaagaataattttccaagtcatgaccacaacccatgaatgctctgcagatgcccatgatggggggatagtgatggatctcaaggaggttggtggctatgctagaccatgaatgcagggcttctagacaaacagaaaccagtccctggcctgcaggagtgtcctggaagcctgccgggaccactgagaaaagctttccattgggaaaacatatgtaggcccctgggagggacagcctttccccctcttttgggagccagtctggcccctcgtgggatgatggtggcccccatgggctttttctttcacttgatttccctgtctatgtgtgtgtacccagccaccctggatcgtgggtgtcaccatggtatcctgtctctgagcaaacacatgagcgaaaaaacaaacaagcattaggaaggagggctctcccccacaccttggccacctatgcggagtgagggaccctgagccaggtaggaggagggaaggtgatggagattaaacagcaggtgtcagacagtcagggaaatgcgtttggattcacactggatggtcaggagccccaggtaccaaagtcaaacatgctgactcctgtggccacctggtcattcctcttgggtgtgaaggaggaggaggggagcgtggagaaaccaacaacttagcaaatgtgtgctgagtcccatgcatataggtgatgggagttggactcagagaaaagctgccagtaacaccccttagcaagcacttgctgtgtgccaggctctagatgacaacctttacctgctctctcgataggtcctcataagcagtccctagaggtcagtatcgttattgtgcccattgtacaggtggggaagctgaggcactgagcaatgaaacctcttgcccatgatcttacaactagtaaagtagcagacccaagaggccaagccaggctcatctgacttccatgccaggtccctgctaagattaggggtagggagaacagcttaggagctggggcaggagagtgcttatgtgtggagtagagaaagcccatcctagatggggaggtggcgggggtctaggtggcaaggggaaccctgggtgcctggcttcctcctgcaggcactgggaacatttgctctgctcacctcctggctctggatccagaggagtccattcctccaggtggctgctctcgcctgggaatggggtgggggtgagagtgaaggctgaatgtgggtgcagtgagtggtaaggtaggaaaagctgtgggtggctagagtgaggtcttggccccataggcaaggacatgcctaaagcaaacggacctttcgagtctcctgggtgatctctttcctaaaacccaccctgactctaagaactgtgagtgaccccagcacatctccttgctggcgcagttgagacagggctgtccctagctcatccaggacagttctgaagccgccctgaggctgtggtggctcaggtggaagacaatggcctggagggagggagtgaaatcctactctccaatcctgccaactagggaccctctctttgtttgcaagaccaaaaaaagaagaaaaaaaaaagatctcaggctattgtccaatgcttctatttatagctgccaaataattaagcggatcagcccttccaggatcagaaggggccatctagctggtggaccatatggtgagtctgcagggtcgcagagtggttaacaggagggaagagaggggagagagtttgtagagcctcttgttgatgttcatgcttcatttcttctcagtgtgtttttggtcaacagaaagattaaaaatagcattaaaaaattctgttctctggatataaccctgcgagggggtggggggactttggatcatatttacttgcttccctgatgacgcagagtgccaaattctaaagtccttaggatggaacccagctgaagacttccagctgaagtatcccccttcttccttctttggtcagtctctgaggagtatcatgaccttaacttcttgctttcctctgtcaagacccaaggactccttggccaacactttggggaatttattaattttctccctgcacccctagtgtatccagtgtgtcatcagcagacatttgggtcatgatgctcctctactctactgaaattcctctatgactccctattacttataaggcaaagttcagacccagcctcagctcacccttcctgcacccctgagccatcttcagtcgttcagggcccttcacctttccaaacatgagagctggccctttgaattttgattcttggccgggcgcggtggctcacgcctgtaatcccagcactttgggaggtcaaggaaggtggatcacgaggtcaggagatcgagaccaccctggccaacacggtgaaaccccgtctctactgaaaaaaaaacagaaaaaattagccaggcatggtggctggcgcctgcagtcccagccactcggagggctgaggcaggagaatggcgtgaacccgggaggcggagcttgcagtgagccaagatcgtgccactgcactccagcctgggcgacagaatgagactctgtctcaaaaacaaaaacaaaaacaaaaaaagaattttgattcttgctggaatgctttctgccctactctctcctgttcaagtcctgctcactctgcaaaagccagtgacatttaacctcccaggcttcctccaactcagaatgagctcacggtagaggggtttttttcctccccttttctggaccgttagagcaattttgtctgaacactttcatttgacaattaatcatgttctccctggcagcatctttcccactattatctcaaagaattatttaaatattttatcagcatttaaatcttcacttttgtcttgctccctcccctggaccgagtcttcctggaggtcagagagggggtcttgggcttctctagcaagcagcgttttgtggtggtcacctgtgcaggcttctgaaactgttgcccatgtttcacccttgctctgcctcttacttaaccctgtggccttaggaaagttttaatttctctcctcctgagttttctcacctatagaatgtggataaaagtcacacccaccttgtagagttgatgtcagtattaaaaacgtgcaaagcgcttagaccagggctctgaggtatctgctgagctccttagtatgcctctttcccctccacccagcatctggcccactgtcttgaacataggagatggccagaatttgcttgttttttttcctttggtgtggcgtcatttgtaaagctctgacccagagaggataggaaggtttcttaaggtcacatagcaagaagtggtggagaagctatggtgtcagaattgagagtccagcactcccagcccccgccctggccccaaggcctttcataggcagccctcttgcagggtctttactgtgcgtgggacactggagaaagctgctgtttatgctcgaacaacttttgcatgaatcagatggacttgaagattgccaccactctgcaggactccaggaggaccattcacattgcattctgtgggcatggtatccccttgaggtgtacgaagaggccccaggtgggaaacctccctgacaaccctcccatcccacgaatgcagctaaaagacacaggaggtatcagggccacagagtgagaataaaatcccactggagcaggtgaaagggctccgaagataggtaccgctgcccttttccgagtactgcctctcctgctgtcccctggccactttcagagagcccatgggttgacttagccttcagggtttagggagatattttggggtggtgagcttttcccaaatacccatctctccctgctttgagccaggggagaaatcagagctggttgggatgtgtgttgtgatgatgtgtgcagatgttcctggatcaacactctccttcctgcctgcccccttcccacccccatactccccagccacaaagggaatgggatgagtgggtttcagaagaggccaaattatttctaattcagaaatggcaacatctgggctccacctctaacgtactttctaggttgcttttcagatggaaccaaaggagacaatctttggatagatttgtgatagagcaatacagtaaaatttaatgtttatggtataatctaggtgatgggatacaggtattgtctgtgaaatcctttcaacctgttgtatgtttggaatcttctcttctcttttcttttcttctcttctcttttctcttctcttctcttctcttctcttctcttctcttctcttctcttctcttctcttctcttttcttttctttctttttttgagagagtctcgctctgtcgcccaggctggagtgcagtggcatgatctgggctcggcctcggcctcccgggttcaagtcattctcctgtttcagcctcccgagtagctgggaccacaggcatgcaccatcaccccggctaatttttgtatttttagtggagatggggtttcaccatgttggtcaggctggtcttgaactcctgacctcaggtgatccacccgtcttggcctcccaaagtgctgggattacaggcatgagccacctgggccactacactcggccttgtttgaaattttcttaataaaatgttgtggagagaaggaataaggactttgtagtagccaatcctggctctgcccctttttagctgtgttaccttgggcaaattacttaatgtctctgagcctcagtttcctcatttgtaaaaatggggccaatcttacaacatatcatagagtagtgagataatacatttgaagtacttctttgtttttttttttttttgagacagagtttcgctcttgttgcccaggctggagtgcaatgacacaatctcggctcactgcagcctctgcctcccaggttcaagcaattctcctgcctcagcttcccaagtagctgggattataggcatgcaccaccacgcccggctaattttgtatttttagtagagacggggtttctcctaattgaggctggtctcgaactcctgacctcaggtgatctgcccgccttggcctcccaaagtgttggaattacagattcaggcactgtgcttggtactacgttttttagaaactggatgccaacagaaaaattagagcccacatgaaagtctagttttcttctggtgtggcggcccatgcttctagtcctagcaacttgggaggctgaggcgggaggatcactttgagcccaggagtctaaagctgtagtgagctatgattgcaccacttcactctaggcaacacagtgggatcccatctctaaaaacaaaaaaaattaaaattaaaccaaacatttaaaaaagtatagattcccaacttctctacactggcagcatggggcccagcattcacctaggtctgggtagcagctgcacccttggcctccgggtgtgtgatttccaggccaccataggctctgatggcccattcagttctgtgatcccagcctaactctttaaagcatttgagtttgtcactcctgatcgcatgcagcctcttactttaaggaagacgacccgagtcagccaggtaagggatttgcctgaaatcatctattttgtccacagagcatggtcctggccccggtgcaggcctcctgcctctgtatgttgtggcctctctttgtgggtgactagcccctgccatcagaagcccattaagctctgtgaaattcagaagcttggtccaatgggtcttggttgtggctctcagggggcctggggataggttaggaatgtatgtaacactgttttataaaattatcacaaaccaagttccccttggtgacttgttctgaattttctatccatgaatgtttttatatctttctgctccaaaattttacctgctgtaaaactatataagaacattaaaagacatttacaaaagcagtcataatcccaccaccatagcacagcagctgttcctatctttgatttttagaaatgctttcaatcacagaaaaggctattatttttatccggtgccactgacagtatattttaaccgaacttcctgcctcccatcctcccactctccccttcctttttctccctgtcttgtgcttttctttaccctccatcctttcccacctattgtccaccaggtactacaatccttccatcttacatccagagtttctggagggtacagccacacaatgctgctccgtggcagccctggcccaccctaggtaatggagttctgtgctctgtctggtggtcaagataaattccagatcctgggaggcagagtggggaacaccaggcatcagcaataagctagacttatggctccaggctctcttttccctccactaaagtggaacattttggctgaaggagtgtgtgtgtgtgtgtgtgtgtgtgtgtgtgtgtgtgtgtaaagaaagaagactggaatagtaggactttaggcaccaagaatcccctcccttgctagcctggcatattcagataattttcttttgatacctctgacctgtaataaattttaagctccatatggtcatctttactgtgtatggcattcttagcatttatgtatattcatgtcaataaatagttattgcactgtgtgccagaggggtatgttttagtagatggtgataacaaaatgcaaatggcacttccttaggaagttccatgtcatgtgctgctggaaacagcccctgcttctagtgctgtagtacctgtgtgaccttggccaaattacttcacttctctgtgctgtttccttttctgtataatggagattcttaaccctgctgggaggattagttaaatgagatactgtaagtgaagcatgtagcacaaagcttggcgaaccaatggtgcagagattccagttccctccccttcctttctctgcaagttttctttagtgcttgcactcctgccaaatggttagtaatctgttaacaaacacttaagtctttaggggtgctcagacgacaaagggttgcttttggagagtgaagaatcttcttgtaatataaatagtcaactccaattccagttttaaagtttggtacgccttgaattcaacctgttaagttagcccagctctatctggggttctggaaaaatctatccaagcctgatgttgcttgagagcagggcctgggtatgtggcctgtgaaggccagctttgctgtgattttcaccaatttccttacaaacggattttggaccagacttgtgcaagcttcccccagcaggtcttaggaacatctggggatccaattcagccttttctgacgttctctacgtgcagggcctccaccaagtcattgccttcatttcttaagggccatttggctgaacttcacaaagtggtggaaacacatattgcacacacaggtagtctaagatcgggaataaaaagattacaagtcctcccctttcataggcatctgggtcccatggttcatccaaaatgaagacctctgagctctgtcactgccaggtggatgggttgggtacattccctcctctctctctgcttttctgtcctcatttgtaacccgaagaccataggatataatgaatctgggagggccagaaactttggaaatctaattcagtcaacagacctgtgttgtttaggtgctgtctttcttccatgcgcttgatttctttgacattaaataatctgcttatggtgttataggacctggatgttgaaagaaatgttaaagctcatttcagctttatggtttccccacaccacaggtggtgtagcagataccttctagtgatatatggacaggaccctgagtcaccaaggagggatttagttcatttccagttttcttccagtctttctagttatctcagggagaaagtctcggtttactgtttgaacatctcttaacccttgcctgtctcccttttgaacaaaggcacagaacagcccccattgagactgcatgcaaacggaggcatctacctagaatttcataccctggttttgttttgcatttattttgaaagttttcttctattttgtttattttgaaggttatcttctatttcttcactggtgataccagtttttcacatgtggtaatgttacggagtatccttaagatatatttatttaagctgggtgcagtggctcattgctgtaatctcagcactttgggaggctgaggcgggaagatcgcttgagcctaggagtttgaggccagcctaggcaacagagggagacaccatctctacaaaaaattaaaaaaaaaatagccaggtgtggtagcacatgcctgtagtcccagcttttcaggaggctgaagtgggaggttgagcctgcagtgagttatgatcacaccactgccctccatcctaggaggcagagtgagactctctccccaaaaaagatatctttgtttagttaaaaaatttgactccattgaaagaaaaatgtttagtgaatagcataggagtcatgcagctagggcagaagttgtgatgggagtatgtgaataacacatttaagaagcactgatccagtccttcttctagattagtccaaaacccgctgaccttgactccatttctgaccccaccagtgacaaataacaagggggaatctcccactagccaaaaaactccttggaggcaggggtggtgtctttatcgtccttgtatttccagtgctcgacaccggcacttggacgtattcatctatttcacccgtattgatggagcacctgttcctcagcagctgtgttctgggttcgggggtcctgtcgtgagagatgccatgtgcagcattgaatatcttcatacaaaagaatgtatgtcaatccataatggtccaagacatgcatcacgctaataggggagcctctcgcttaggagagggttgagctggtgcaggctggccttgagatgtgtgtcgggagactggttctctcagggatggtgttcttcctgaacacgatcttccctgttctgaccgccagcagctccagcccacactgtccagaacaagatacctcctttccacaggaacgagacacacttccacagcagcaggaagaatgcctgttctggtgcagtctgattttcaagcagtttgttcttctacagagaaaatagcctagaaggtgagaggcaggcctggctgcagatgtctagatgtgccaaggccccttgccagtggtcagcaggctgtagcgctggcctgagcttgtagttagtggggactgtggttggggaagccgaaggaagcttgaagctaggtggtgacgttgaagataaatgtcccgtgtgttgagtgaggaagggacaactctgaggttggggcgtgttggtgacataaaaagtttaactgagcttcctaaatgggaggcattctgtatttggctgtggcttgatggaattgcagttacccttgtggcgtgggaatcagcctcgggaccattaggatattatgatacagtcccttggtgccactgattggcggtgtcaaactcatctgtcaaaaaatgaaatcgatcagccaggaaggatgctggtgttgaggctgacataccttttgagcataataactactgtggcttccggtgctttgacaaaacctcagatacatggccttctggctgagcatctgtgatttcatattgttggcgcatttgttatttccctgggggttgcaaccctctgtaactttgctgtggctgaactaaaaaagaaggcatacacggattctacagaaattatgattctatgaaagattttgaggagatgaggtatctttcagagtgcaaagtgattttggaatataaagtattcctttgggaagaattacctagagatttgtcactgacctgtgttcttgaactataaaacatgaatatgtggcttaagaaatagtttttcttaaggctgggcacagtggctcatgcctgtaatcccagaattttgggaggccaaggtgggcagatcacttgaggccagaagttcaagaccagcctgaccaacatggtgaaaccctgtctctactaaaaatacaaaaattagccagatgtggtggtgtgcacctgtagtcccagctactcgggaggctgaggcgtgagaattgcttgaacccgggaggtggatgttgcagtgagcggagatcatagcattgcactccagcctgggtaacagagtgagactctgtctcaaaataaaaataaaaataaatagtttctcttgacaaataaacaacaaatttttaaaaatgaaatcacctttgttttgaaaaattgaaacttacctcatgaccattgcctgattcctgagtcctgctcctctctgaatatgaagttgcggagtctttttaaattcatgaacagatatccgtgatcttttctcaccttcagggaggttcaaggctccctaatctctactccatcccaatcatgaacacttccaccctcactcagtcccttccccctcaccattcatgaccctctccttcttccctccctgccccttccccctctgtaagtctctctcgcccaggtgtaggataagaaagtgttttgcaacctgtttggtagttttttaaaagttgaaagtttaatgatttgttgttgttttttttgagtgggaccagagtgtcccagccttaaatggctcttttgaaatgacagtatggaagaaacacaacattgaaaatggggacctttgagatctctgctgtctgggcctggctctgccaccacttccttgtgtgagggtgtatctggcctttccctttcatgggcctctgtttctcattgaccatagaagggatttaggtccctcatttgagtgagtctcttcatttctgcatgccagttggcttgttgctgtgacagtgactccaaagctcatcttcaggcttctgcttctgaagttcatgagtctgacactggatggctgtacttgggttccacagttgtgaaatggggaaataagagaagcaggatgactgcttgtttttgatggattttacgaagagcataacagagtaagagtaacaggtgagcagggccttcccagcctcacgcagtgcctagaatagtgctcataagtgactgattaagtgaaggaacataaggtgattctatgagttttgtgcaaagcaatcaaaaagcctcaaggaggcaaagtccctttggcctctcattaagcactactttatcccagtaacccgaaggtgctcagaaggggaaaggaaaggagagaggtagagtgcagctgtggctctgggagcctggagtcctgcaggtgtgagaggcttgctgtatgcttctcctgccccgaagctgagcatcccaacctccacaccctttgctgtgagcctttttttttttcagagatagagtcttgctctgtcgccaggctggagtgcagtggcacgatcttggctcactgcaacctctgcctcccgggtccaagtgattcccgtgcctcaacctcccgagtagctgggactacaggtgtgcaccaccacacccggctaattttttatattttagagatggggtttcaccatgttggccaggatagtctcaatctcctaacctcgtgatccatccgcatcggcttcccaaagttttgggattacaggcgtgagccaccgctcccggccttttttttttttttttttttttttttttttttttacaacagaccagacttcaggggcatgctgcaaatatctagcagttgctgctgcatttgtgttgcagctgccctagggctgagcccttagtctcaactcagtggtctgcaagctgcctgtgtattctttggactggctggagccaaggtaaaccaagagggggccccaggtctgccctctggctgagactcttggctgttcctgcatccatacactctgcttagaatgtcataaaaggattagagaaatccctaggacactgttctgttcccagggctgaaagaggattcctggaataccagaggcctcaaggtatgattacatttcaatccccatgcaaaattgtagaatgtcataccatccagtttctctgtcaatattagttctattgtttgcaatctgagaatgggagccaatctatggcctctccagtgcctgcttttggcaagagagaccatcaagagactgaatgaccagtcactgcatgttttctacctagaatgataggaaactggtcccttgatgtactgtcttcaggagggacattgggctggctgatctgagctggaaattgatcttttatctttctgaactggcgcaagtgaagagatgacagtagatgtgtcagggaagcggggagctgccatcctaaaaggagtagttccctgcagcctggagaggccagggtagaatatttcccaagaaaatcatgaagaggacagagaggattggggaggctttattgtgttggtgacgatctgtgaattataatcaaggcatgttgatggacaagtccttagcatgtgttgcctaacagtttattccttccacctaacttaatggaggcccactctgtgctcgccacaatacaaagatgtattgcattgatacaaagacgaatcagctttagtgattctcatgggagttgtacttatagtagattagcaggtgcatggacatgatgtaagtggatggcgcctccttgcaccctcccttgttatgaccactgtgaggtccttctcaactatgtctgcaaaaagtgcctgctttgtctgttctcctggggaacagaaatgctgatgtttcactaggcgttgttcctaggtgagtattctggatggtggtggtggagcctataaaccaaaacatgtctgaaagagttctcaatcaatttagaggttcattttgccaaggttgaggatgagcccaggaaaaagagataaaggctacagtagactctgtggcctgtgctttttccaaagagggttttgagaacttcagtatttaaaggcaggagagtgggaaggagcaaaaagagggacactcaatagtgcattcggctcctgctcagtaaatcttgtattttacataagataaagtaaacatagagtagaggaagaagaagtcagatctgcatttgtcttgaggtgggcagagggatgatttctagtcttgtctttgtcccttacctgtgaagatacattgtcagggtgagagaggctacctggggagataggtgaccttctctcttgcagcaatctgtttaggaacaaagagaaagcagcttttgcatgacaaagttcactctttcttttggcatagtgagttgagggtcccaagattttactttcctttcacaaaccaaattgtgacatggctgtgagaggatggtttcttgtatcttgtatcttcttgaggattaatctaaatcatttgtgtaagagaaggaggtagactgggaatcaggacttcagcttctatgcatggctctgacactcatctcttagtaggattttgaaccctgacttgcttattgcttcagttcctcttgttcaatggaaaggttgggttgcctgatatatcatatatatacatatatgatagatacatattaacatatatataaatcacaatattctttggaacaggaactctgaaagatgcaaatataggaataaaggggttttgtttgagaaagcttgcaagatgttaggtcaaacaaaacaattaaatagtgttcttcttattgcagaactttttagggcctttaatagactactatggggaatttccaaaagagggtacaatatgcagtgattctcaaacttagttgaccatagaatacttgtgttggggagaagcttatgaaattaatattccttggaattctactttgggaattgtaagggtagaccagcgatgttcaaatggtggcgattttgccctcgaggggacgtttggccatgttgggagacattttagttgtcacaattaaggatgggggtggaatggaggagaatagctactggatagatgccagggatgctgccaaacctcctgcaatatacaggacagcctcccacaacaaaaagtttatccatctagccaaagtgacaattgtgctgaggttgagaaaccctgaacttaaaacccccttctgttcctggctctaacacttgggggattaggtggtttggtgacccttccgaacttggcataccagttcaccctcaggcatctttggctcttgaactgtatattattctctagaaggcaggagaggtgaggcctttcatactcatccctgcagacctgcacatttctggcaccagacccatatatctatatatctatatattcatttaccacagcccagcattcctggcagcctgagagctggtggctagttgagaagaacatttagtctccctttcctgggtcttgtttccacccctagtggccaagctggggcagctcgctttgctctgtggtctgacaaacttggatttcaaaacccactgcctgccaggagcagttcccgcagacagagctcagattccaagaagactatctggctcttagagatccatcatctttatgaagttttaaaatcacagatggtttttatggatattcaaggtattccagcctttcatgttttctcttcatccctctttcttccccaatcacacatttttctccagtaaccaaaacacaataggtaatggaaattccattacaggctgacccacagagactgcatgggaccaatgcaattatgtctggagcaaagcactgtcatgactaattagcctctcacataaatgaattttcctatggataacttcagaaaaatcagcctgcaaaacacactccttattagttttccttccttctctgggcttcggagttaggctttccctaaggattctctccaccactgggccacgtgaacagtctagcccatggtggaaatccattttctgcttgctcttcaccccctcagtcctgtgcttagtttcattagagactaagtctcatcagagacctcgttatttttagggtgatgagctatttattgagcaacttgcttctctcttggaaggcaacataggcagtgatgagcaggggctctgtcaccccagctctgcactgacagtaactttgggggaaccttggagaagccacattgggacctcctggttttgtcttcccacctgtagagaggggcattgtccttgatctagagatatcagctgtgattgaatgagtgtaattcacggagcagactttattggccactgaatttagaagggattataaaacacatcttccttcaaaaggatgcttagagctgggcatggtggctcacacctgtaatcccagcactttgggaggccgaggcaggtggattacaaggtcaggagatcaagaccatcctggccaacatggtgaaaccctgtctctactaaaaatacaaaaattagccaggcgtggtggcatgcacctgtagtcccagctactcgggaagctgaggcaggagaattgcttgaacgtgggaggtggaggttgcagcagtgagccgagatcatgccactgcactccagcctgggtgacagagcgagactccatctcaataaataaataaataaataaataaataaataaataaataaataaatgaatggatggatgctcaggattggatgacttattgggcaaaagcctgggcccttgcttaattggttcagacatttgttgagtgttacctatgtgctaggaagtactgctatttcttctgaaggttgtagaatctctaaatatagagacaaaaagagaggggagggaaggcccttgtgaggtgttagcaaagacctcccaccaccactgactggcactgattcagtatctgtatctgggtgctgtgccaagtcatctccacatctcagctaacaccctctgtggtgcatattgatagtgcccccttccaggggagggcactgaagctcacagaggttaagaacccgtccaataacatctgagttagtaactagcagaggtgagatttgagctcagttctatcatactctaaagcaagcctcttcactctgtgtctgctgtgagcattgttttgaatgggtccttgattcccagcctgtattgactttccactgcctgggtgctccagccaggctcagggctctggggaatatataagtgaccatctgggctgggacagcaccatgatgctgatgtgcaccaggaagggctgcctttgggaagaattgctgtgcactgcactcagaaattgcatgtgctagatgttggagctgaactcccctaagaggaattttctaagtggattatgaaatcaatttagtgagttgtaatcaatgttaaaaaatacaggatatcaaagtacattccatgtaatagtgtaggtattgtttcatgaatcctgtgttgcaattacttgtatagtaggtatgtgtgggtcacgatgtaaaatgtatttcttactttgggtccaggtcacaagttggaaagcgtggccctggaaggaggtggggcatgcagcagtgctgcagagggaggtgtgcaggctttgccctttaaggctctgctggggatgccttgaagaaggcagagggcacagcaagtcctggcaagtgggtcagcaaactcactctgactggctctatgaagtgctgcaggggcttcagagatgttataggggaggcccctaccatttgtcaagaaagtgggagagagactagctctgctccgcaagacaagagactataatagtcaacatctacaagaataataacagcagcacactgtatccatctttaactaacacgaactctagcgcagactgtctggatttatatcccagctcaacctcttataactgtgtgacctcgagtcgttcacctaacccctcatgcctattttcctcatccgtaaaatgggcataataatagtacatactacataaacttgttgtgaggattcaatgagttactatttagggagtgctcagaaccatacccagtagacagtcatcatatatacatgtctgttatatacaaaaaaaagtcatataagctttatatgagtgcccaatagaaagctttaccaaggcaagacttgaagcaggccttgaagattactccattggatcttcttcttttcatctctgtcatcaataactgtttatttcaggggccataaatatgttccagacactgcagagtccttcacgtatgtcctacagtctggtgaagtgggactcatatgctcattttacagatgaggaatgaatatttaaagagagtccaagccaggccccgattattctggctgtgtagtctgtactcttgaatcagacgacacagtccctctttggcctgccatctgtgttgtactggggtctggagatggttggtgtcctgttctgccccttgcttagcttatcctctctcagcctcagaaaccaaggccctgtgtggacagaaagcaccgcgatgaacacaggtgcctatttgaagtgctctgttgtcccagactggaggccagcagactcctaagcaggatgtgtcacctagcagagacccatgcatttttaaatgtcctcctgcctttggagacaggtcctgaaaaaataccagaatcattaggactcttagtcatccagttcagccttggggagctgagtatcacagccctgttgtcagcagcagaagtcctgccacctggacaaggctgggaaggcagcccacattgccgcaccagggagaccccaagaccaatgcctctggggtcgatgtgggatgattggtggttgactgatggcaataaatgaggacaaggagaaggcagggcccctcagctgcatgccatgggcaggtttcaacagagtgtgggctacatgtccagatctcacccaagcactgtggacaaacatgaaggagaaggcagggctgctgcccacatggggagtctcatctatttggggagataccagtgctcagaagcctaaattcaagtgctgcaggaatccagggagggggcatttagggaaactggggtggttgtgtaaaacttcccccaaaagagaaaattcaggtgagggtaaccaagatttggagtgactacaatgttaaataaatcggggcaatgtgtttatagataatgtgctctccttctgcaagctgccaccagcctgccaatacttatatcctcatccatccatccatccatccatccatccatccatccatccatccactcatccatccatccatccatccactcatccatccacccatccatccacccatccatccattcatttattcagcacatacctcccaggtgcctgccctggcccaggcccagtgctaggccctgtgtagacaacgagcacagttgcatgctgcctctccttcctgctcatggtctagtgtgggagaccagcattgaacaaataaatcagcaaatagctgtgaaattaaaatcacagtgagtccaacaaaggaaatgaatgggttgtgatgagaaagaacaagggggccctaatttggactgaaccaggctgagtgcatctgtcaaaatcatgcctatcctttgaggctcagcagaaataccaccaccttcattaaatcagtctgttcctgccatttaacaggtcctctgccatactctcttcctccctggtgtcatattctaccttgatttagttttgggtacttgtctgtttcccctgagagatcttcaactcctggaaggagagattgtatttttttttttgtctgagaacctgttgtgagtaatcctctctcagagatgcccaggtgaattgttgaatgaatgaatgaatgaatgaatgaacacagatcttcattcctagccccaggcttccactatgggtatatagcagtccctgtggtgagagcaccagctccagaatcagctgcttactgactttgtgactgtgggcaggtgccttgacctctctgagccttcatttgccatatgggggcagtgctataaatagttgtaaggatggaaaagattagggcatgtgcattacttagattcatacttggcatataatgctttataagttagaaggaatgtgctagacacatccaacaactctcagaatcctcacaaatctgctgcaaagcacttataattattcctgtattatagctcagaaacctgaggtttcaaaggattaactaacctgctgtagtttgcagaataaattagattttaacacaaagcaaaacaaaccaacaaaacaaggccaatatgcaaacctgggattgtctgactccaaaagcttgtcttccttgacagtgtcccattcctctgccaagctgaattctcacctctgcagacagaggctgagatgtttgcattttggaagctcaccgcctggccaaaggctaacatattgttcatggatggactggacatttgaaattacatgctggccttgggagggaagagagaaggaatgcttgacttccacggggtgcctctgccttacccatctcaaagaatcagacccctctctcatttttcaagggccttggggtgagcatcctaaaagtctcacagtctgttgcagcagaaagcgtggctttgtcccccctataaaacatctggagattttcaagtttgtgcagaccccatgtgagcagccagccctgggttggcatggattggagaggcagagaaggcattcacttggctctgatttttcatcctgtggcctcagagcttcagaatacagagtccctacccctggtgtctccttcctctccatccaccatgacaagctgtgtccacattctctttttggctctttcctaaggtatcgggcacaggactatgtctgcccaagaataaaaattataccccttatatttccaaaaggagaggcatataatttatgactaaaactggggtactctgactgaaaatatctactgcttagccgtttctatgtcgattagagaaggtgtttatagctcagaactagaggagaagaaaccatttctttgtcactgagaaactccttgccagggtctctcagtgagaaacaggacatgtggagcccaagatagggcaaagccaagtctccttatcttatttagtgacatttttttaagagtaaaaaataatcacatgctttttgccaaatccagccctaaggcatggatccaacaaaacatcacattaattagataatctaatttccaaaaacagaccccagcgcagacacccactgtctagcagtgatgacaaagggaacagacagctgacatcgtggcttcctccttcagagttcatgtggacacctaccaagaataaggccttggccagagctttatctgtccttggactagaatgtttcttagtgatgccataacaacggggttgacttaaaacaatgttaatttattgtctcacagttcagaaggctggaaggcttaaatcaagatgtcagcagggccagcctccctctgaagcctgtagggtttctccttccttgcatcttccgtgtttctgctggtggctggcagtctttgacttgcagccaccactccagtctctgcttctttggtcatggggcgttctccctatgtgtgtctctttcctcctctcctagggacaccagtcatattggattaggagctcaccctactccagtatgacctcattttaacttgattacatctgcaaagaccttctttccaaataaggcttaccttcacaggaactggggattactattgaaacaaatcttttggaaaaaaacactgcaacccattacaggtgcctaagactagaaagatgggtcagagctgctactgccagtgtgagaaagtggacaagttggagttcacctgggaataagatccttggatggaggagcaaactccagctagaggaccgaagccttgaaatcatttattctgcagatcagtgtttctcaaaacggggttcccctagccatcagcattagcgtcagctgagaaacatgtaaggcatgtaaattcttatgctccaacctaagcctactgaattggaaactctgggctggggtagtttcttattttaataagccttcctggtgactctgatgcacactaaagtttgagacccattcctctaaattctgccgtctctcctcactgcatcacttttcagtggggctgcccttggacactggcagatattttgggttaaagaagaaagttatttggtcaaaatgagtgtgggcagcattgtattggtctatgttgaacaggttccttgactgaaggctatctctgagcttttgctatgctgtatgcagtgagcattgaacatttgttagaagaggaatgatggcatttccagatttcactgcaaagagaagtgtcccttttgtatggagtttcccatcagactggtgttccgtgaatttacactgggaaacatggctctagtccacatatcaaggcattcagtgaatttttatgaaccgccttgtgagaacaagacactgtgctggagagatacatctgtgaacaagacgtggcttccgtctctaggaaactgatagtctagtgcaggagctggcacaccacaggctgtgggccaagtctggcctgccatctgtttttgtatggcccattagctaagaatggttttcacatttttaaatagttgaacaaaaattttaaatgaagaatatttcatgaaacatgaaatggtatgaaattctgatttcaatgtctctaaataaaattccgctggaatacaaccacactcctttgtttatatattgtctaaggccacttttgccccccagcaacagagctgaatagttgcaacagagaccatatgctaaagcctaaaatatttcctatctggccctttacagaaacaatttgcccacctctagtctagtgaagcaaagaggccctgaacaagtacttgcaaatgccttgagtgttatgaaggagcagtgcaaagaccacatgattggaaggttttattgactgatagcaatggtggtggtggagtggaggtggagggtgagttaggaaaggcttcctggggagagatcttaaatatgagtaggacatctggaatatgactgtgtgaagaaggttgttacaggaaaaggaaacctaggacatgcagatccctgaattagaaaagaggagtgctcattgaaggaatgcaagaatgtccagtattgctgtggattaagggaggtgaggccaagagtatttcagtatgtggccagatgcctggcaaaggccagatgtgccagagcatcttcgacggccatgctgagggccttaacttttgcctaagagcaagggggagtccctgagaagagtttaagcacaggcatgatgtgactgatagaaaccttgtggtatctctctggcttcagtgtggagaatgaggggcagaactaagtgggaattgtaccattgcatgatacaatgtaaatgattatgaagcttaggagtcaaccaggggagagaagctgagatggagagaagtgggtagatttgaaaggtgaaggttctctgtgatgcttggcctccctcctgccaggccctttgtgttctctgacaacctaaagaaccttccttcctggttactgggtctgtgctcttggaccctgatatattaataaatattgattgtttgttgcacacctgctacaaatccaccaggcccagtgctagatgctatgaaatataagaattaataagccctggctcctgacctcaggttcttagccgggagactgatggatgtagccactggactagaatgtaatgaggactgataagcagagaaacaagtgatatctgaggggactgatacctgaaaggaagtattgagcaaacagccctggagacgttagctctactgaagaggtctggagaggcttcatggcagaggcagcgtttaggctttctcttaaacaatgtgtaggatttgggaaggagaacagtggtcattaatccaacatgagcacaatgacaggtctattaacagcctccggtgggtgcaggggaggctaggggagccatgtggctggcatgagccatcagtggaggcttacagagagcaaagaggtgctcctgttttggaaactcaatctagactcctgattgcttcatgtgcctgacagttcagtgaaggctgtgctgggaccatgagttaccctcagcagtggatcagcagggcagcagaagacccactctttcactgatggccagggccctgcgtaccccaattcacttcaggcccttccaaggcaggtacaaatcatgaatcacattcccctctctatgactttgtttataggcagagctctaaagctgggataacagcaaactgcatcaacaagttctctggggcctctagcccattgatcctatgacttgttgtgattgcccctgacctcttcactttcttcttcagtttggtgctttggccactgggaccaatgacttccactgaagttttctggttctcagtcctgctttccagggctgtgacacagggtgatttgcagactgatttctgtcctgtgccagaagatacttaataaatgctggcaatgacgatgggtccctgaagagcagtttgcccaatttattttttaaagactttaaaaaaatagtatagacagaaaagtctataaaatgaaaaattacaaaatagcaaattattatagaaaatttgtgtcactaccactgagttcaaaaaataaaatactgtcggtatccccagaagcttccctgaccatcccttctccttggctggcgtctcacctttgacgtctcaagttcaagaaatctgagtaacaactctttctgcctagcttctagtaagaaaaacagctgcaaaaggagaaaaacaaaacaaaacaaaacaaagagacttgggattcaggtaaccacctgacctttcttccggatctgctcctccaaaaaaggtctccatccctgtcagtgctaagggctggatggttagttgttatggagacgtggggcgtctttccaagacgccagcaaagttgatgcctgcagcgctctggcaggtccctctgctctgcagggctcttctctccttgcagttggcagatccttataataagagacttctgagatgtaaaaggaactctcccctcatgtgaccttcatgccagtccccctggtgccaccccacctcagtgcagtagctgagcagtaacagagggacagccagtttccctctgtccaggggagattgtgggtcttcaggtgagagtgtggcggcactaacaacagcctagtcacaattcattagtaaacttggcattcaggttactgacatttttgcaaactgcactttctaacaattaccctctggttaaaatctgtatttgtagaaggaggccagtctgaaaaggaatgaggggaagaacgacttcccctggagaagtctgaatgaggtggccctctcttctaaaagaaaggtgtgtgccttttgagatttcaattattgagccacttccatcgggagctcttcaattatttatactgggtgtgttgcaagtagattcaccaatttagaaagttgggggaaagaggggacatggtaggagggaggcccccgtggatgcaagtgtgtgggcaagtccttttggcttcctcttggctctttttctggatccaacttcatcgtagggctggaccagccactttgtcaagggtatcctcctcactgaggtctggagatggggacagggtgtggatgcccctgggtgtagggaaccgacacttccagacactcggtgagctctgtctgggtggaaaacctcatcagaagccagattgaatcacaccagtttctaagacattcctcaaccatgttaggcaaaagagtcccccactgacaagctggggtagaaggaaacctgatataattttggaaaaaaaccttacttgagaaagaaggttctcacagctgccgagtctctctcgacgtccagggttggaggggtcccaggccatggagagaagattgatgggtctagcggagccaagtagagagttgaggctttgcagggccaggcgcttgccatccttaactcccattagggatcgagaaggaaaaggagaaggagttctctgaatccaatggaaaaagaagtcctgtctcctttccctgggctgttgaattgtttttatttcacattagcaactgctctggactctcttgtgtttggctgctgtgttggagacctagatccaaactagggtgtgtgggaacccagggacatagaggctgaagttttggaacccagccagttcttccaaggggtgaggtcagaggcagagtccagggagcagggcagctctgggagcctggttcctcaggctgggctgtgctcggagcggtagatcctgactgccgctgtatgcctggtaacctggccatctttctgcctcccaaagtctgtctgtcttgctagcccttggtttcctgaatggggatcatcttaagtgtggggaaaggctgtctgacgacctaattgggacagctcttttgacccgaagccaagccccatccaagttcagcaaatggaagaagcgggaacatgttcagttggtgaggtctataggcacagactggattaggtcctaaatcatggtggaaattttcctggcacgggacaaatccttttgtaaacaagaacattcatctttcttttgactgacatgcctggtagggcatgtgcctctcagaagctccatgtcatctgatctcatttgggatttagtgtttttatttgaaaatgtagctgccctgaggaacagcagttaggagccaacccccagtttaagcttcaagtcatggaaactggcctggtttacccagacgtcagtgatgcctgggaaagctcttgcttttccagtgcccactgagcagagatttaatttactcaatcggtacgtgtctgttaagcacattgctgtatgccaaacactttgggcataaaaggtatataggccttgccttcaaggattgtccaggctaactggggcaatgcaacatgcatggaccaaaagacagctaagtacctgtcccatgtggaattgggggagcagatgtgggccctggagacaggacagggagagctttggggagatctagccaggaaggagaacttcactgcacctctgggatttgatcagggaggatgaagatggttggggagcaatggggagagcatcccaggagtgggaacagccagcacggaggtgtggcagtcaggaggaccaagtcatagccgagaagtcaggtggaagagcaggtcagtgacgagtggggagggcagccggcagcctcagctccaggccttgaagatcaggccttgaggagtttgacttctatgcttagggcattgtggacttggcaggatttttgagattccagaagatatgagcgaagagtgaaaacaaagcaggacagaacaaaaaacagaatttcttcatttattatttcagtgcactgtgaaatgctcaccgtgtgctaggtgctgttcaggctttgaggatgtggagtgggcaaatcaggcagactctgccctgactgctagagaataagcacacgtgtgtgatgaaggtggtagtggtgggaagcaaagaacagcagcgaaggggatgaccgtgttcccttccgtgtggggcactgggctgtgacttacattgctctcgggttactcatctttttactccaaattgcttggagtcctctgttgactctgaagggaatattcaaccataaacaattcatcctatctgctatctgtggttgaattctttcttcccagttgccccttgggtggtggcttggggccacggtaacacttgtagtatttcccgggaggttgttatagttctgtgcatttcctgcagtagtggtagtgaaggcattagatgccaggaactcaggcggttggtatggccctgagctctgaaaatgcttgccttcccctttcccctattgtgtgggccagcagcttgcagagctcctccagccctgagagaccatgcctccatccctcagaccctacctttcctggccccaaggctgcctctggctagtgtgacagacacaccctgggcccctgaagtctgaaagccacatttttcgaggggaacctggccactatgagtgtggaatattggggccttaaatttcctgcctgtagaatgaggcatttgggctaggggagtggttcctagactttttgtgggataatcaatgaatttttataaaacagaatatcacaaggccaccagctttttattttgacaagcaaaaacataaaaaaagaaactgtcaaatgccagctctgccaccattgtcatttcattaaaaggacatgttaatacccaacaaaggagtaacgatataatgtcaaagaaaaggacagttcttcctgggagaggcccttcatcagttgtcttccactgacacacacagtgcgctgtactgaggcttttcattccgtaccacatcaggggcagcactgccctgtggccatgcaggacccatgggaacagagcacctgtgagctacctgcaggagcctttgctgaggagagtgaggctccttgggggctggatcctcctcctggtctacaggatggcaatgggctccctccggtaaaagttaacttggcacgaagatttctgcattcttttatgaacatgagggtttgggatttcctgtgtgtttggttatccatatcccagtctgccctgatgagaaacaaatgtaatttttgccttcctgctgggcccctgccacagttttcttgtctgggcaggtcttgagctgagcttctggggcaggatgggctgccctgcagactggcagctgagtctccgagtctctgatggacagcaggctgtcttggaccctgccagggtcatcctggctgaggactctactaatccaattcaaagtctctatggctctgatagtggactctggactgtcacttatattttccaattttattaagctaattgaaagagaaggagattgttattttacaaatacggcacattggccaggatgtatgtattagccctgaaagtttggaggttgccttactaattttaggcagcatatgtggccatttgagaacatatctaatgtctaatgagcattgtattcccaggttggatccccgtcccctagcccatttctccaactctctgtccgtacatagtggattataactgaatttagatgtctgtactacaggattttgttacttagaagccataggttgtgagatggttgtttcagtagtagtagtaaacagaattttatatggagattccatctctgttcttgcacattggacctatcccaagacagtgtggaatagagagaaaaaatatggccttcagagttagaatggactagattgaaatttcagctctgccacttacaagatgggtaatcttggaaaattacccaatctctctgagcctcatgacattcctaccttgcagccaggcgtggtggctcacgcctgtaatcccagcactttgggaggctgaggcgggcagatcacttgaggtcaggagttccagaccagcctatccaacatgttgaaaccccatcttactaggaaaaaaaaaattactggagcatggtggtgggtgcctgtaatcccagctacctgggaggctgaggaggagaatcgtttgaacctgggaggcggaggctgcagtgagctgagattgcatcactgcactccatcctgggcgacagagtgagactctgtctcaaaagaaaaagaaaaaagaaaaaaagaaaaaacattcctatcttgcaggcttcttgtgaagattaagttggtgtaaaatcaccaaggacagaacacagtagatgtaagaggggatcagtgatctcctgagcaccagttgacccccttggtcctcagggaatgggagagcagctttgaacctggctctgagaagagctgaaaaggaatctgtcctgcagcatttcccgggggagggaaatgatgcttgattgacttgcccagggttacagagctgagacagtgcgtgcaaagtaagggacttaacaatccaggcctccgggtcagacagtttagagctggacagaccttggggagtgtttacatggctccctgcatttgagacaaagaaacctgaggcacaagatggtaaggacttgttaaaggtcacctggcctttttctaccatgaagacttccaaagagtagttgttcacacccagcgcaggggtgcttctaagagtgagaatctggacagggcacccagaaagcaatggctaaaaatgcctcaatggtggagcactgtaggtccagccgagacacccagtaaactcacagggctttctgacagctcggggtaatcggttaggtcccagcttctttataagttcctgttgcctgaatctgtggacagtgtgtcccttccctaaaggtacagcccacagttagcaaacacagtaactgctaggtgaattaatcagtgcaaatgtcttaagccctgctggtgcagagtctccggggtgcagagcaggagaagtgatggcagccagggagaggttggactatgcaacttcccaggggcagaagtgaactctgccactcctgacaccagctctaggaaagacctgggtcccctgttgccctatttctctggtccttgagtctcagagtaaccacctcctccatccattccctttgcagaactcttgccatgaaaaccccagctggtggtgcccatgctatgcttgatttgcttgagctgctttgggtaatctgcctaataccctaatatgcaggattattggtacctgggagaatgcccgtggctgggaaacccgcccaggaggtgaaagaggttgctgggtggatgtcctctttggcatgggaggggggacacggaagacccagccccagcattcggggctggtgaaaacctgaggcgaaggagaggagagcagcccgcggggagggaccagcagccccagggcttcctaaggtattgaggttcagacacttctggatcttaggccaaactgtgccacaggatgtcatagttattgtcatgaaacaaagcattttttaaaaagctaacatggggccgggcgaggtggctcactcctgtaaatcctagcactttgggaggctgaggcaggtggatcacttgaggtcagaagtttgagaccagcctggccaacatggtgaaaccctgtctgtactaaaaatacaaaaattagccgggtatgatgacacacgcctgtaatcccagctactagggaggctgaggcacaagaatcacttgaacctgggaggcagaaattgcagtgagctgagatcacgccactgtactccagcctgggcaacagagtgagactctttctcaaaaaacaaaacaaaacaaaacaaaacaaaaaaaagctaacatgggcctatggacttttactcaggggatttctaatgtttttccccagaaaatcccttcactcagatgcagtctagcacagaaccataataggtgaaattgctcaatgcagaggcgcttttatttccgcggggtccggggccctgcctcctctgccctcccttggtaaccagcccccctggggcacctcacaatgctgggcctcaaggtacagaaaactgtggatttaactcaccaccccctctcgtctcccagatagggactcttctcagagaggttaggtgactggcccagggcacacagcctgtgcctggcttcatagcttctggtccagaaggcttccccctgcccccaccctttggtaggagagaaggagcccttctgcattgtgcccagttgaggacagcagcatgtggggctgctgggtcagtttcaacagacgagaggagatggggcaatggagtggccagggagagggtggggtggggctcctggcagatggaatgagtaactcagagcgcagtccatcaatgaaggctcaggggaaatggccttctgatgttgaccaggaaaatttgaggacaaaggggctgtgaggcatgaggcccttccttctctcacagccctctgggggtcaagcatcctgggactatcccatggttccagggtgctgggcagaacatccagcttccagggatgagaggggcttcccagcccctactctggtcccaaaagggctagcggagatggttttgtgctaacctgatctctcctgttccctgtcagaaccctacctcccactcaggtgcgtcaggcccggcagagctcagcctcttagtgctggagaccgctgggcagagcgtgctaaggactccaaggatacgcatggcgagggaggaagccaaatcttcctttagcagcatctgcatagagaaccgtggttcttagcaggagggcttcacagcccgtcagcttggccacgctcatttccaatgtgatactctgctccacgaagggtgaatttatggttccgggcaggttcttggcagagaaaggaactgtgtttctctgtccttgatggaactgccctccataggcacagggccctggaagaagggtcgtgatggtacaagcagtacccagaagtggcatgaattgagtgctcttcatgttaataaacctttcgtgggcactttgcagcagccaataatccttgcacatgcattctcccgtctgctgctcacactgttcccgggaggacagcaggatgggtacgtgtccctttttggcatcagacagctggatttaaattcacactgtgtcttcctgggccagctacttaacctctcatctgtcaatggaggacattagtaccaacgtcatagagttactatgatcatgctaaaaaacagtagtcgatagtataattattgttagtagtactatttactagtaatatctattctagattgtgcatggtaagaactgactttccatttgctgtagctctcctccctcctctcctccttcccccactccttccttccctcccacccaccaagatttgtcaggtgcttactctgagctcacagggattcaatattgaagatacagccataaatgaaacagacatggtgaaacccccatctctactaaaaatgcaaaaactaaacaggtgtggtggcacatgcctatactcctagcactcaggaggctgagacaggagaatcgcttgaacccaggaggcagaggttgcagtgagccgagatcacgccactgcactccagcctgggtgacagagaaagactctgtctaaaacaaaacaaacaaaacaaaaagaaacagacaaaaactctttccctcatgcagcttgcagacagcacacaatgatgaagtaaaggaagcaggtggcagacacactccggagaagacagcacagacagggagaggtcgggatgaggtggagagctcatggacaaagtgaggatgtgaaccaaagctcgagagaaatgagggtgcagccacggggatctctggagcagaggcagaggccagtgcagacagccccgagacgggactgggtctggaatgtcctggcagcatgaggaggccattgcatctgaagtggagctagtgagcggcagactcgcaggatgacaggcacgagtggggctgattgggtgtgaagacttcacttgtcctctgaatgggccaagaagccataggagggtgttgggtacaacagtgacatgatttcagttacatttttgaaaagtatttttcttcccagatggcctttgcctaaacaacttcccagatcctggatgaggaaccagtgtccaaagaactgacacgtagttaaacccgaggcagacttggagcttcaaggcttggctctaggcaggcagcagggaggggccctgggatcccctcaaggcgggcccagccagcttctcatgcctgaggcagtcatccagcaggtgtggtgcctgcagtgaccttggtgcctggttcagcttgacaggtgtcaggagtgtgcctgggggtgagagagtccaaccgggtgagagcaggtgtggcagcagctcaccctgtcagggagggtgtgcccagcatgacaggtcacctgctgagacttggcaatttgacatcctgttagggtgcagggtgacaacgggggacctgccctgcaagttgcagctgggtaggaatctgagtgttgagccctgcgttctgtgagggctctggctttgtggcacaggacttctttctccagagcagccctgcttcctgcccagaaccagaggacagtgactccacttgcctgccgtttgtaaagcagttgctttcagaaaggcaatgctctgttaccagattagggctcctgcaagaatcaggcagggtgacaaggcaggactcatccctgttcatagaagagaatatggagggtttgaggaatgacatgacttgctggaggccacccagaaaagttggacttggtccagagtatcttttgattttcatagttcttcctgccacaccacagacctgagagtcccagtatactgggtctaattcagcaaggatgagagacggagacagccaaatctgagggatggggctgtggggtcctaggattagcacaagcttgctctcctgtgctagaccagagcagctgtcgtggctggggaaggctgggccctttgaagacaagcaggattagcccttgtcgtgaccctcacacctgaacccagtaccaggctaggtggagccttctgccagtcctaggaacaccctgaactccaggttccaggctggggcagcagagtgactgtcacttgggctagatttggagcaattgtcttatcggggaggcaacaagagataagggaaacagagcaactggggcttgcttcctggcccggtggtcacctggctgggctgggtggccctgagcttgtggctttccctctgggcctcagttttctcatctgtacactgtgtgtgtggtagttgggtggtggtggggatcctcaggaattgctaaggtcccttctcaagctttggtctttgatcttgtgattcagcgggaaatgcccaaacgcatcagatgaggtttgtatcttgagcaccaggtgatggggtgcagtcaggcccttggccccaggtgacataggaagggtgagcccctctgcggccatgtcaacaaaaagtcatcgtggggaacaccactaaagggaatggggagaaggcatagaaaggggtgagggtgtaaggctgggcacagccccgtgagaggttgcctggtagggtgggtgtcgggaggggactgtggccactcttctctctggtgttccctgcctcctgtgcctgcacccttgccctgaattcctccccaccttctgatgtgggcactgaaattagatgtcactgttgccactgagaggcagctgtggcctgctttacacaaggctctagtggggagagagggcagggttggaggcagatccagagtggcctccagtgcaaggccgaatccctttctcagggagctgccaagggcagggggagggctcctgcaggacctcctctttctgagatggcctccccacgcgatggcctcacctctcatttttctccctattcttccctccatgttcctttcttttcccaagacatcttttcttgcatttcagaagatctggtggcctgtcctcctgaagctggggtagctggaggctgcagccagtggggtttctctcccttacacacacagacacacacacgcatgtgtgagcacacacacagatgcacacacacatgcacacattctcagacatgcacacacacgtacacactcacacgtgcacacaaacgcacacacacatgcacacactctcacacgtgcacacacatgcacacactctcacacatgcacacacacatgtgtgagcacacgcactcagtgatttcctgactgacatcgggctgcccctactgggaagtgcttcctgtgtaaggacagggtcctctgcagtgggaggtggaaggtttgggcgtggctgcatatcccctttgctatttggaacaaaccatttgttcccctgtgaggcagtatcctgtggggccaggagcaagaacggaatgctgggactcaggaggcagcctctccctggtcctcagcgttctcatcttaaaaatgggaggttgatctaatggggcgagtcagaaggggtctgagatgtcactgggtctggggtccaccctgtgcgggaatccctgccccagctgtcctgggtggtggtcacacagcgcctactagaagccctgcaggagtcacagcaccttgccttatagggacttcttgctcattggaggataacagtgttagaacctgcacctccttatcctccattctgtgattatttattaaaggttcactctggccagtgtgcctcccagggccactggttgatgaaagtggtgcagcttcagtggattactcttagaggccccagccccatcagcgggtgcttcatcagggcagctgtaaccactgtgtgcccgggactgtgccaagcttcagcttccccaccaccttaatgaggcggcatgtttgtccccatcttacatggaagaggctgagactcaagggttgatgggccacagccatcagcttggaagttctggagcaggtacaagcccaggtgggctctctgcttccagcctgagctctcaggctctgtgcctttttctgagagatacctgctcttagttaccctgtctgtaaaatggaaataatttcacttgcctgttggatgtattataaggtttaagcaagacaatgcatagaaaacacttaattcttagttgctggcacctagttctggcttgttcaatggtggccaacactcttataatggactctgcccctgcatgttcccagcaaggctactgaaccttctctgctttttctttggagcatggagttataatgcctgctccccataagaggtgctttggccagagtgaagtcagtggtggagagaggggcctcttcctccaggcacaagatctgtggctagcctggtggctagtctggccggctggcatcaggctttaaatagctcccccatcactcctcccagtcctgcttcccacacatggtaattaagctcacaacatctagtgtaagcaaataataacaagggcattatctccctttagtctgtgtttttccttgcctatcataaagtaattaaaataatgaatgccttgtaaaacaataggtaagagggctggcgaaatagcattatctgccacatacctcttgtgctatgaattactgatgcagttaaccactgtgactggagggcccccctgcctcccagcctttttcacgttgatttctcctctccagggtctaccaaggggctgtggaacttgggcccccaggactgaggagcagggagctatcttccaggtccccacgtggtggccagggaccagttcagaaacatcctgggaggcttgactcaaaaggaaacactagagcctcagatgtgggacgatctccctgccctcctcttttcctcacccctccaccaatgtccaatattgaaacaagcaggtggttctgtccttgggtgaagggagaggccaggagagagctgggggtgaagatccatgtctcatttcagcagtcaccgagccatactagggtagtcaggagctgtggtccccaaagtaggcttccaagcccagcagcatcagaagtgcctgacatcttggttcgaatgtaggttctgggatgggcccagcacactgtgtttcaacaagccctctggtgtgcttatgatgcccgctcattgtgataaccattgctttatggtgtcaggggcacgagaagaagcaaggggtgctgggataattgcttgaacctgtgttttgtgctattggacactgtttaatcctgacaatgcctgaggggctggcagtactgtccccatcttattgaggtcccacagcggtggcagagctggattttcccccgaatctacaccttcagttaccatggttgaccctgtatcagggcctccccatcctcctaaataccctcctgttcagagtctcacagggcagaggctcagggaccagggcaagacctaacaggtcctatctgaggctggcctgggaggcttgggcagcaggtcccacacatgtcagcaggcagcccccagatacatctgcccagtggcctccccctcctgggcctcctcttggatcattgtagctctgtggggcttaacacatttggaaagaaaatattagcgtccagggctgcaggtcccacttttctcttccccagcttccctgagccacaggcagccagagggagagaagcaggaatcgggaccagcttcctgcctgccgtggccaagtccccaagaggatgactcaccagtgcaccctccccacctgcctcccacgtgcctggcctccctctgccccgccccctttgtcactgcagacaaagcttttcaccactgtctttggttcttccccttactccaaatcacaatgatccccagtgtggctttgccttgggaattaattccagagttttaaatgatgaacataatttgctggcatctttttaaacatcttcatctgcagtcatagttgcagtgggtatttgtgttggggtccagttaaatgtacattgttagataaataataaggttttagtataagcatgtcccatgtggtatttggaatatacttatactaaaaagttatttgttgtttatctgaaatttaaattttactgggtatcctgtattttatctggcaacactaaacccagcctttgtagctaacgaggggctgatactcatagccctttctagtcattcattcatggttattgagccaactctgtcccagacactctattaggcaccaaggctgcagcagtggggaaggcagacagtaagtgaaagaagtaaatgaattattaagtatattagcggttttaagtgctatggagaaaaataaagcagaaaagtgctattggaaagaaagtgttgcaaatttaaacaggtggccagggaagacttcattgaaaaggagatatttgagcaaagacttaagggagcaggccataagtctctgtgggagaagagtattccaggcagaacactcactgtatgcaaaggtttacagtttcggcccctgtgtggggctcagttatctgatgaaatcagccttgtttcctcaagcacattttaagccagaaggggaatgtattgtctcctgtaactggaaaggtctggtgtagatttcaggcacagctggatccgggtgttcaaatgatgacatcagtagtctattacttttacttttctctgcagtggcttcattctcagggaaggatgacttttcctattctttcctgcaaatgttccacgcttgagtcttattggcttggcatggatcatgtgattattaatggcccaattgctgttggcagggggtagaaaggactccaatgttggagccaatgtgaggccatctgtcccctttgaactacatagactgagaggaagagataattttcctaaaggaaagtgggggtgctgctgtgaaaaggggcatagaggctgggtaggcaaagaccacaggacatctcccacactttcctcctccctcctcagcatgccctaatcttagacagattgcgtttcctcttgctttggtattttctttttctttaaaatgggaggagaccagaactttgggaggctgaggtgggcggatcacttgaggtcaggagtttgagaccagcctggccaacatggtgaaaccctctctactaaaaatacaaaaattagccgagcatggtggccgcgcgcctgtaattctagctactagggaggctgaggcgtgagaattgcttgcacctggtgggtggaggttgcagagagccgagattgcgccactgcactccagcctgggtgacagagtgagacttcatctcaaaaaataaaataaaataaaatagaatagaataataccatccttctttgtttcactaagatattttaagaggaaataaagaaaatattcttttttaaataaaggctttaaaaaaatcaaaggcataatttaccccttctgctttactcctatacctttaagctagtttccatctcagctggggaccccttctggctctggttctttatgggtagagcatgttatttaaatccattgttccctatgtcttaactcttgctctctctgttgccaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggtgagtctccacccacttctcacaccaggaggccttgctgtctgggccaaggtggctttgcttatgagacgtgatattccccagggtcttctgcaggaggctggctattgggaggtgggggtgagcagcaagtgctcccgcgtggtcatggaggagaggctcggttccttgtgtacagtggtttgtggagggattttcaaggagtgggatttgcagtggagaagggttgttgggaagatgtagcacatttcctctgctaaagcacacatgcgcgcacacacacacaccctccatcatcttggagaggagaagagggttaaggaaatataccagaaactcatggaagggctacaaatgcggggatcctggggagtgctgagtgagtgtgtgtttggtggtcttcgggggatgttcttcttgtcctgtggtagcccatagggaccccctcttgcagcagtttcctaattttctgcagtgtgtgagctgggccctgtgcacggtagaaatcagtcatgctgatggtggatgcatcagtagcccacctgaggctgcctggcccgtgtacctagagctcgcttgtgtgcccttttctgatgagattgtctcctaagcccacctgcaaccagggctgattctgccccttctctgtatgtttccaacatctctctgatctgcttatatgaagcttggcttcactggctggcctcatgagcccttggtttttgtcaaggatcattactgggacaggcttatagtgatcaaccatcccagtttgcctgagactgaggggtacatgagacatgagtctttcagtgcaaaaactgggaaagtcctgggcaaacagggatgaattggtcgccatagccaggcccatgctctaggaaagccctagcttgctttcttgggtctgctctgggtcaggagtttccctgagaaggatattgcattcggagtgatttctcattgtgattctggaagctgttttgtttgggccacctgtcctggcatgaagctagggctcagtcaagagtcatttggctcatagatggaaggagtagggacatcctgaggcctgcgaggctcaaagaccaggcagggacactggaaaacagtcattatctctgagtctcacagcaaaaactcagtgaagaggtgactgtagatggagggaggtggtgagaatttcacttctcagaatccttcttggggagaactcaatgttatgtctgggatcaatatcacacacacttttgtgggaaggagtgagagaatgaacgtggtgcttgagtaatcaaaggtgctggccacacagccttcaagaaagacaggttctgttcaccgagggatctgccgtgagctgtgtgctgaagggtctggttatgaaaccatggctgatgtcaattgatggcaaaatggaaagaggggacatttaaagttggagttttggaggaggagagagaaactggtgaggtcagtggctgcttggaggaaggcagagagggagacaattcagtctggtgtgacccaggagggacagtgtctagtggggacttggaggtgacttgctgttggctgagctgtgtaacagcacctctatctctcctcctgcctcttgactgaagtctccattgctctttcatgcttgaagaggagtggattctgcattggaaacttaagagaggttgaattctgagtctgggtattcatggggacaaaatggaggtagtgtattctatatgtatggtggtgatagtgaatggggagcagcagacagtttagctgcacaaatgtgacacttgttccttccatgtggccattatagacagttctaattttcttcatcagcattgcaagagttactgaacactaattctgggccaagtgtatttgtttcagctctggagaaaacaaggaaggatcctgattctattgcaccatatgcggaagttattgaaggaatgcatggaggataagtgctatgagtacaaacacggtgtgcacttgtggagtgtggggaggggctgtaggggaaagtagggctgatcagaaaagctttcatagggaggaaagtctttgaactaaaactcccatttcaagatgagctgctttatggcgggaagatataaaaaataaaaacatatccaggcttaaacacaagaaaatgaccactaggtgggctggaatttgtgaagaatacttaataagacagaatgcatttgcagtgagcttttaagtgtgagttaggatcttgagagttaaaggagaagaaagccttcaaagtgaggagcaggaaaaacagagaaggagcctggcgctctgggaaatggggggtgcagaccccaaagtctggggaagtgtcctggagacagcctggtggggctttaaaggccatgctaaagaattttggggccaggcgtggtggcttacacctgtaatcccagcactttgggaggctcaggtgggtggatcacgaggtccggagatcgagaccatcctggctaacacagtgaaaccccatctctactaaaaatacaaaaaattagccagtgtggtggcgggtgcctgtagtcccagctactcgagaggctgaggcaggataatggcacggacccaggaggcggaacttgcagtgagcggctctgctgagatcgccccactgcattccagcctgggtgacagagcaagactccgtctcaaaaaaaaaaaaatgaatttttgaagtttgtagaacaaggagattttgaggcagggggtgttgtacagagagagctgggggacaagtggagactgaatgggtgaggctagagcttggaggctataggacaagttagggcagtaagctactgctttagtgatggcatgggagcagattcctgatgtggtcctggtggggcacggtctgcactgacaccaagcagaagatgcaggtagcccatgtgggtgatatcatggaaatggaactcattgggcccagcacacccagcggccaccttgagactctcctggcaatcacactgttgaacgcctcttgtgatccaggcactgtgctaaccttatatgttatgatcagtttgaaggggaaggacaatgtcgtatttcttccgtatctccttattgctgttgtgttgtaggggttcattacaagaaaacaggccaatcttatcagtgaattcatctctgttttacagttgagaaaatcaagatatagcaagggcaattatttgtctaaaaacattcagctttgagtgacagagccaggctagtacctgccagctccctgtctcccagtctggtgctccttttgtgtcattacttcccagtcgaagataatgccttttcttttctaagccactgacagctgtcactttggctgtgacattttgacattaccatcttttagccaatttggtcctgaggatgcttggcctgcttgttaaacatttgcatgtagaagcatggtccactcaggcctctttgcctgagcctgcccaaggtgccagctgctctctgaaggtctccttggagaaaatcctgcccaggctgttggggccatgcagagcaagtgggacctgctgcacagaaagcaggcatctcagagctccaggcggtatcctgagaataggcctgccctttaggagcaggcaggtccctgcactgaacaaagaagagatttcacaattaagtaatggcgggcaagagaaagcagcactgcctgttcagaacccaaagctgtgtttgtcttgagccgtccaaatgtttatccctgcaacaatgggaccaaagcaagaccagacagctggctattcagtttcccgtttcaatttttaatttgttttccttgatgcacgctcaggagcttggcctcctcatctgggcctctatctcacctgtctaattgtcacaggtgtgaatctcgaagctgggacatcatgagtaaggtccagctggggaagaatttgccaatacaacctcagaatatctgtaggatctcccagacgagcacatccgttattcactaagtgtttactgctcatctgtacctggcactgttcaaggcactgggcataaagcagtgagcaacagagatccaggtgtgaattatttatattgataaactagatataaggatgcagagctcaatttaagaaatgacaaatgataattgccattcaccagtgctttttatagtcaacgcctggagcctgattatccacatgataaaaattccttgaccccccggctccagatctcagaatagcctgtctttgcctcctctctcaccctggcactcaggctcaactggccaaaaacagcaggactggacagagccttctcttggagcacgtggctgagggattctacattaaagtgaacaccaggctgtcaagagtactgcttccttttatttttttcttaactaaacaaatgtttattttctgattataaaagtaatatatgtttgctttttttaaaaaaattgaaatgtgctggaagacgtgctgataaattccactgtgggatttggagtcggctcatgcggagggaaatttggatatagcagtcaatgtcgtcaggatttctcttaactgtttgggtgtcattgaggactttgttcactgcatctcatgttacctgctttatgcacagactcatgggataagtagtgttttgcaccagagattgttgtggttttcctggtgaacatccagtgagcatgctaaatcgagaaagggatcatgtctctcagtggtggctgctcagagccaagtcggtggcttatggaaaatacagagtggctcaggtttgcgctctgtgtctttgcacccctgctctggcttgtcttcatcatctctcctctcattttccctttgccctacttttcttactcctatttggaatttacatgtatgcagttatgtgttccatacatttttgtcaggtaaattaaatccccctaagaataaggtggtttctaaataaagagggcaagaaacgtatggtgtaggttttagtatagtttggttgtgctgtatagaatcataagccaaagtcaacagtggtagtcaaattcagggttggtaagtttttccataaaaggccagatagtaaatattctaggcttgcagaccatgtgggctccacgactcaactctgccacagtagtttgaaagcagccacaaacagccttggtgtgactttgttccagtaaactttctttatagaatgggagaaaatatttgcaaacaatgcattcaacaatggcctgatgtccagaattcatgaggaacttaaaaaactcaacaacaaaaatcaccaaataacatttaaaagtgggcaaaagatatgaatagtcatttttcaaaagaagacatacgaatggccaacaagcatatgaaaaaatactcaacatctctagtcttcagagacatgcaaattaaaaccacaattagatatcatctcacagcagccagaatggctattattaaaaagacaaaaaataacagatgttggtgaggatgtggagaaaaggatcacttatatggagatgtaaattagtacaacctctatgaaaaacagcacagaaatttctcaaagaagtgaaaacagaacttccatttgatccagcatttctactaattggtggctacccataggaaaagaaatcattatataagaaagatacctgaactcctatgtttatcacaacactactcacaatagcaaagctatggaatcaacccaagggtccatcagtggatgattaaataaagaaaaaaaaaatacacacacacacacacacatacacacatatatacacacacatgcatatatatcacattatatatgtatatatattacatttatatatatacaaacacacacaataagatactattcagccataaaaaagaatgaaatcatgtcttttgcagcaacatggatggaactagacaccattatcttaagtggaacaactcagaaacgaagtcaaataccacatgttctcatgaataagtgggagctaaatagtgtgtacacatggacagagagtggaatagtagtcaatggagactcagaatggtggaagggtgggaggtggcgatgagtgatgagaaattacttaatggttgcaatgcacgctatttggatgacggttacactaaaagcccagacttcaccactgtgcaaaatatccatgtgacaaaactgcactcatactccttacatttatacaaataaactgtatttatagaaatagggggtagagaaaacagttgactggaaggaataagttccagcatgtgatagtacaatagggagattatagttaacagtaatttattgtacatctcaaaatagctagaaaagaattagaatgttcccaacacaaagataaatgtttgaggtgatggttttctgttaccctgatctaatcattatacatgtaccaaaatatcacatgcatcccccaaaatatgtacactattatatgtcaatacaacgttttaaaaaaagaaacaggtggtgggccagatttgtttcacacaccatagtttgctgactcagtctaatttatccccttgttttatatataaagaaattgaaagtctggggctggaggcgaagagattctctaaggtcgagtagcaagagtgtcacactctttgtaaaggagcgttacagactcagtgatacacacacaaagataaatacaggcacacacacatactctcactatccacattgtcacttagtttctgcatgttcatattcatttccatgttgatctcacagcaactgtctccctagggaaactatgtcctgtggtgaaggacagcctcacctcaacttgggagcgacatctacactgcctagactttacctcaaccccctgacagattcaatgttttgtgtgtctcttcaaagactggtcttgccaaaatagctaccagctcctgagcaaagctagagagagcccttagaatcactctttgtagttactttccccatattcctatgctgttacatctgtgtattgctccaggaagcttacacagctaattctatgaactgaaagcatatgctacttgcttgaatgtatagggatgatttatcgatgtaagaagaaagaaaaatatcagcctctctctttatccccctaaatatgttgcatgtgtggcattttacattaacgttatatacatagcctggaccatttcatctttatctccaagggcccaaaagaaaatatgtgtcaaatatgcctttcaaataggaataatcctattggtttaacagagttaaatagatgtacattcactgatgtgctgtttgcgcatgaaattagactggttgaacccagtgggagtacacatgggcacacacataatcaaatatatcacattcattgcattcacttctgttaggtgccctatggaggttgtgacatttcccatcagtatcctctacttttctttctcagtggtgcctggtggcaaattcacacacacttctctctctctctgtctctgtctctgtctctcacccccctcatctatgccccagcttttattatattttaggcaaatctatgtaaaattcttacatcattggccaatgccttgtgtagcagaaagactagaggtttcacaggactgtacttttagtaagaatgtcccatagtgaataggtatgtcctgctctctgctattgggaatcagttggagttttattggcattgttttaacactcctaagggaggcttctgtttaaaggaaccatatgataatttccttccaggacttaatagtggttctgtatttcatcccatgcatagatactgaaatcacattatgggtatcagtcaaaaagtcaaagaagatacattctttttttactattaaacatgaaattttgtctttatctaatgaaagatacactagatttgcactagatttgttatttttgactcaacatcatttacccagatgagaaaacatgagtcagagaaataattgaattgagcagtctcccccgacaggtagtgagctgcctgttactagaaatattcaaagagcagcaggatcgcatttcatagtgctgttgctgacagttggttagactttatcctcatggctttaattaggttccatagaacactagacccacgaattgttcccggataaaaatggttccctgggaacttggatagacttcatttctcatccccctcctcgagattgccaatgcatatcagcatataaatacttacagaagtcctgcagtcagaaagcggaaaggctctgttttgcccagcattttccattttcatttccctgtggaatcctttccccatgtaatacctgtgggcatcacatagcactcactttgggaaacatttaattagcccagggatcagttagttatagcctgtgggacagtctggctcattgcctcttttgtgtggttcataagctaaggatggtttttacatttttttatttttttttcagagacaaggtttcactctattgctcaggctggagtgcattggtgcaatcatagctccctgcaacctcaaactcctgggttcaagcgatccttctgcctcagcctccctgatagctgggattacaggtgcaggccaccatgacatgctatgttttcttaaattttttgtactgatggggttctactgtgttgcccaggttggtcttgaacccctgggcccaggcaatcctctcaccttgacctcccaaagtgctgggattacagatgtgagccaccatacctggcctaaatggttattttttaaaaatcaaaataagtgtattttgtgacatgtgaaagctatatgaaattcaaatttcagcgtccataaacaaagttgcattggaatacagccatgctcactcatttacgtatcgtctgtggctgcttctgtaagaagctacaaaggcagagttgagtagtatccggagtccaaaacacccaccagcctaaaataattaccatctgtccctgtaaagaaacaattgccactccctgtatgcctgtcaatattcctcttcaagtggcctacaggacttgctccataagttacctatggcataggtaatagataagatataacatctgtccccttctcatggggacgtgtctacattcacttccccaagctcaactaagtactgcattagagatggagaggccagagccaggtgggtccccaagttccatagcagattcccagctggggtgaacatatggatttccacttcgcaaggtcaggagaatatgtctgagaattttgtagcagcatcattccttgagtttctccatccacctgcccactgcttcggcagcccccacaccccaggccctgctggcagctcagagtctaagccttacccccaagaggacccctgatcagggcctgcaggccaggcacctcagctcgcagcagcttctggtctgcaggcctcgagccatgtgctgggctctccggcacgccctgtaaagagcagctgttaattttactagctggtgtgttggctcctctgccctccccagggctgctgtgaaaatgaaggagagtttcagaaatcaaccctcagttggctccagagtgaggaagagcctcctggtccagggacagcccacttgatcctggccactcatctctggctcccaggccctcagggctctgatggcaagtgctggcatggctgttttccctctcctctgaagtttccaggtgcatgtgggtgcctgctttggccttccatcccattgtctgtctgcccatccatctatgtccattcatccacctgtgtgatccaccgacattgattggtgttccctagtatacagaactgagcgtagcacaggtcagtgggggcctggtaagcaagcagagcacttgcagcctctgtgcagtcagcagccagtccggcctgcttctgccggtcctgtcttgtctctgtccgctttgcttcagtctctgttggggcctgggagtgagaaaccctgcccctttgtcagtgcatcatgatctgaactagagctcctactcttttttgatctccatcttgctccttgtgtctcgttctcacttgattggaacaaacaaggaggatgggtggagcccatagcagcctcaaaactcacttcagctcttgcattgcctctctccctgggacacccatcttgggaaggagctgctgtgtgtggtgcggctgggcagttggaagcccagcctctgcagactcctgactcccagctccatctgtctcaggggcttggcttttaccctgggcgagtggcttcattgtctcatacctcagtttcctcatctacaaaatggggacaataatagtccctgcctcttaatgagttaatgcatgtaaaatatttagaacagtgcctctgacatggttagtgcttgataagcatggttattattatttttgttattgtgtgtgtgagcccggtcaccatgtcatggaggaaatgggctggtatggagacagacgggtcagggggtgaagaacaaatccttttctggggcaggggtagaagaacagcccttgagcctccccaaacccagacatcttccaagagtgctgagcagctctgggcagggccatctgaaaggctctgaatgccccaggcaagccctggtttggatccatccagatgatgatgtttgctctgtgcacacacttaattcaggcttgtccaggctgcgtcctctttgcagctggctcatgccagcctgactcaccattgtcaaattggccaggaaattctcacttcatatagcctccctgagctggctggggactggagaacgggctgggctctccctggagctgtacgttgtgggcgcatgtgtcacaggaaatgccttggcaggacaacagatgagtcttaaggaaaaagggtcaagtgcacttactgtggtctccgtatccacttctccctggaggtggggcgaggctgacagggcagggacaggctggtttcggagggcacatctgcaccagtatttggggaggtgggtttgatgtacattttgacaggtagtgaccacacattcattgaaaggagatgggaaagcgtgtgaggtcaccagaagataaagacccagattctactgcacatgcgaggcagctcctctgagctattcctccatcccttcatccattccttcaaacattctggagcacctgctcggggtcagatactgttcaatgtgctggacatatgttggttcattcagcaaaagctgcaaagtgcagtcatccaaagtgttgaaggtggaaatgttatgcttgcattttctagaatgatttggggtggcaaggtttctgaagtagggtttagtgataagtcagaacctgtgacccatctctcagtcccttggacaggcctgggagctcagacattctagtcctgattgcacatcctgtgcagttctgcagctgaatcccaggggcctgggcaaatatgtgagtagttggtttccctccctgcctccctcccttccctcccttgcctcccttaccttccttcccttccctcccttcctttccctcccttcccttccctctctcccttccttctttccctctctcccttccttccttcctccccactgccccctcccacctcccccactcctccctcctccctccctcccttcctccctccctcccttccttcctcgcctcattccattcctccgtccttccctccctccttcccaacccatgaaagctggcgccccctggaggcatttcaggaaatgaaatgtctgtatttgcggctactgagttgggctgggagacttttcttacccaggttttcccccaaggccttcagagggtgctgatggcttagcactccgtttttgtcagaaaaatatccttagagcctccatttcagctgcgagaaagtttgtttagcagggagactcaaaaatagagatgatgatgacaaagtcatcagcctttgtcgttgcaggggagtgcatgcttggaaagtcacactcgggaccacacgcaagctgatgcttccaagtttagtttacgaggctatgtttaggaggaggcagactgactcgtgcctacgggccccaaacagcccaatttggtgcactaaaagcctcatttttagactctgggtccagagtgaggctttttccagaaaaaaacaaacaaacaaacaaacaaacaaacaaacaaaaaacctacttcagggaaatgacaacaacagaaagccaccatttgccctaaaatttttattgtaaaaactattctctcctgtttgagtagtgagggatctaggacataacagtggcttctctggctttcttaaggaatcagggcacttggaaactcaattaaatgtacccaagcctcttaagcaccaaggctatctttttgctcatccagttaatttcagtttgtaaaattggccttgtgctgacatgatggagacggggtgagggtgggaagccagggtcctctgtgagcggaagcttgcttctctgttcacaagcctccaagggcacacatccttccctggggcatcaagggggaccattaaacctgtttgcaccacgtccctgggagagcaaacttctgggccttccttgtttactggaggttggttaattcggaaggtagatggactgggcatattggttccccactggcaggagcagcccaggattcagcaggttaacgcaaaggatcgagaaactatcaccttcctagaactgttcccagacttttagcaaacaggctgaattttgacctttttcccatttttctttttaatcctccctccccacatgttttgtggcttttggtgaaatggctgtcctaagggaaacaggacagttcattgaaaaggagagagaaagtaaagacccctttcccacaccaccttccctcagatgcagcctttgcttacactaaaaatagcttgaaacagaggctgaatcacaaaaaaaaaagtggcatttcaggggacagaggctgccagctccctggctgctgctgaagtctgttgggtttgttggtctctgagccccgacttgcccaggaaggcgtggggtttggaagtgtactgggataggtccagaacattctttttgtttctagagcaagggcctggttgtgtctgccttggttggagagtctgtccagagctaattatatcagcaggcactgatagagcctctgcctggtgttatgcctcaggggtggaaaatcacttcctgcaaaggaaaggagttgttttcaggagctccttaatccctgaggcacctgcatgggctcccagggaagctgccaggaggttattgtttcctctgaaccatgaggtgggcaacttggtttcttggccacctgagatctctccaggaaaaagctcagatcatcagaaagagagaaaacagtttactcaccttggtctatgctgtgtgtctctctggcccttggggattcatgacagtgtttgagatcaattctggatatgggagaagagaggcaagtcacttacttttatctgaggagctgcaatcagcagaaacctggatactaaccctggctttgctatcacttttctggttgaccttggacaagtcaattccctctccaaggcctcagcatctccataaatagagggggccgcagtagtttttcagtagttcgttcccttgcagcccaaaatatctttatgttttcttatccccttcactgtccttcatcagcaaaggccacaagtgttaggctcacatctactgtgcccttggccctgtgctaggcaccaggagaactgcaaaaggagagagaatgcacttttcttagctgccagagtgattggcgtgaagcagagttcatcaaggggtgtctctgcatggctctcccatggttttgcctccatttgaagtaaaatctgaaactgtgtccctggcttacaaggccccgtgagttacggtgcctgcttttgactcacctccaatgattcttttccttctttgctcctttctagagaagaagcaaagcctataggtagaagcatgtagatgggcctgaggcactgggcagggggaaggatgccgtgggaggagggggccatattccaaagggccagctcaatgagaaggagttggcttcttttgaatcatttcagccatggagctctcttttggaaccttcctcagttggaagcctctaaggggatgttgttcctagttggtatcaaacgtggtgaccccactagccccaaatttgactggaagagcctcctttccaattgagtatcctctgcttgaggagctcttgggtgagataacagcccctatcctttgctctttgtattgcttttgactgaactgctgcaaatcatggggcccctgaaagtccatccctcctccagaggtagaagcgcctccatctctgtgtacctgaaaacaataaaaggcatgtttatttaaaataatgactgccggaggcccccaggaggggctgaggatcgaggaaacattactgtggccaaagtcattttttatttctggagcaaggtagcagactcaggggggtggcaggagctgccaagctagcccccaaatttatagcaagggtgttaaacactgtgggtgatcagtggagttgacattgcagaaattccccaaatgaaaattccttgtaggttaacttttagatgaactttaaaaaacaggggcaacagaccctcaatgggctatttcaagtgtttccaatttcattaacatgatttaagcaaagactcccccttgcctccctggatgctaaattagaaaacatcactattcctctgcccttgtgcctagtttgcaaaccagtgggtttatctggttgttttccccagagttggagcactgcagctgtttccatagcactgcggcccacagggagttgtgtgttgggggctcagttgttgtcttacagaaaaaaaccttgtaaaggcaattcagcaagccacccttctagcaccaagagatacaattcctcttcccggggctgagatggagagatacagatagagagaaaagaaataaataaataaccagtttctctttcatttaactctcagaaacagcctctggtgctaattatttctgctgtagattttgtcagactttgaatcccaatccttttgccataggtggtatattttagagatgcaaaatgatataaaaaacaatccactttcctgaaagataattttgtgtacattaaacagacacattaagccatttacaagagagttgtttgttctcagggatttggaggaaatctgaatttctaattctgggctctttaataattttcaaaagaactgaggctaatgattaaacgtctttgaacttccccaggctgtcttctatcccatgatctcaaagcatttgaaaaggaatagaattctttaccttgatgaaatcagcaggagagtagaggagacaccagccccaccaggagctttgtggcagaatgggggaacgtaaagtaaagaggctcaagaaaagtgcacaaggtcactttcagagcttcagatgtggagttgaatgaagagccttcataccagttcttatttcacagccttggctgctaagacttggaaagaaggccaaagagaaaagaaaaccaaggtaggacttagttaaggatgtctataatgagattacacatgacatgcaatcttatctggctctagtgtttaaggattagaagagatcaagtctagcaatggtgaactttcatcatctttcatcagctttcatcttctgggttcattctgattgatcagtagcagctacagagaatatttggccaaagatttaaggttcagcagcaaacagtcataatggctctgctctaaagaattccgagggctgggtgcagtggctcacgtctgtaatcccagcactttgggaggccaaggcaggtggatcacttgaggtcaggagtttaagaccagcctggccaacatgctaaaaccctgtctcaactaaaaatgtaaaaattagctgagcatgctggcaggcacctgtagtctcagctacttgggaggctgaggcaggagaatcacttgaacctgggagtgagaggttgcagtgagccgagatcacgctactggactccaacctgggtgacagagcaagattccatctaaaaagaaaagaaaagaaaagaaaagaaagaaaagaaaagaaaagaaaagagaaaagaaaaaaaagaaaagaaaagaaaaagaaaagaaaagaaaagaaaagaaaagaacaattccatgactgactaatgatgcctgccatgagtgccagcttggagggtggtagtactagtgttatttgtgccttagctacctgttctaggtcacattccctaaagtttacattatgtgtgattaaagtggggcttgtccaaggtcatttggtcagtttcagacatgtctcctgaccctgtctagtatttgataccccagctgcataggttagacctcagagaaacagcaaatttgtcagcttcctgtagcagccttctttttcttttcttttttcatattgcagcctgacttcagatttttccatctggagactttctttagtgtttggagagcagagggggtggatttcagagccacagtgattctacagacaaacagaaatgcaagcacaattttcctgtttgttatgtccactctcaaaattctctttgcatgaagcacacgctgatcacagccctcccactgcaaagccttcccctcagcccactcccgggttctttctcccaatcgctgcagatgcctttccctgtgccccactcccccggcactgtaaaaagcttttggtgggggttgatgcgtcatcatttccttccatcatagcctcaccttctatttcttcctgtttctcccttaatgttctttctcttagctattcatgctcacatcttaatggctgtgcttacagagataaatacattttgcctctgaccaaaaacagtttctgccctgacttgaatttaaaagcctgccagaattgcagtggggagcagaggcagagtcctcagtttcatcctgggagccataaaagttttctaagagtttatcatctccatcaagatgaaaatgggatttcaaggcttcaaataggaaagataaataacaaggaaaactccagcttttgtcaaagcaaagttctctttaccagttttatgagtctacctgttgtgcctgcaccctggcatctgtttcactgtggtatcagacaaagccttctccaggaatttatgcaaacctacgactggatagagaatttcaggcaattggtagagcttggaagacggctgacaagtcatattcttgggccgtaactcactctcagactcctcattcgttcctcaattcttcctcttccccttccagcataatgggaattggaatagaaagccctattaactgtaaggcctaggctgtgatttataggacattataacaaacgggactatggttcgttgtacttggctatcttttgcatttgaggtggccaggattctttgtcaggattagattttgcccccttggcctcagtaaatggctgcatgcaactaggaaaggctcagccagtgtttccagctgctcaagatgaccccatgtttcctttgaggaaagcagtgctatagagcacccatgtgccactctggatggccacgaaagtgcccagtgagtgctccttggaacttgtttctgatgtgaaagttttggtgggaaactcggggagacatattacatcctggtaggaggcacgtcctatggatttgcccttgatgcttctttttccattgtcctggcttaagccctgtgaccccttccttcactcattatagcagctacatgtcactctcctcatttgtcccatctccccgcttcagtccatctttcatgctattgccagatgaattttccccaaagccagctttgcttaggtttccccatggctcagagaccttcagtggctttccaaggtctaaagcccaaacacttcaagcaaatggtcagggcccctatcctctttccaacctgtccttcttctgctctcctccatgcactccatgtgttcaaatcctacctcatctttaagatgcagtgcatagtgtttcctcctctgaatccatcagtcttggagagtattcgcatacacttgtgaatgtgacttatccactctaaaggcaatgaggctgagtggttaagagcacaggctatagagccagactggctgagtttgacctttgttctgccatgtactagtgtgaccctgagccagtgacagaagacaatcgtagtacttacctcatagggttattatgcagattacatgacctaatatttataaagtacttagtacagtagctggggcagactaagtgttgtatacattgttaataaaacatagtaaactgtaagttcactgagagtcagaaacatgtggtttaattttataatcctctttgtcctgtgctgggctgaaacaaccttgaaccagattgctgtgaaaatgaaatttgaagagagagagagagaagaaatatatgtgaaagcacattgtcatatttttattcaataatcaataattcaataatcttattgagtatctggagagaccaggctctctgttgggtaattgttgatcaaaatggaatgagatataaatcatgtataaacacattgagtatgactgtgtagaagacaagtggcaaacattattcttctcttgtccccatgttacaggtgagaaaaccaaggctcagagaatctttaatagcttaggtgagatcacacatccaataagcatctgaactgagatttaaatctgggatctcatgactcgatgacccaggctgttttcatgttaccatggtgcttctcattcaagaatgagtgaaggaatgaatgggcataggaaagaatgaatgaatgggaagatctcaaacatacgtggctccagaaagagagcaaaccagaggcttgccatagaaagtgagttgtaagtcagcttgggcaggtagcaaatccctgaagccataaccatttgtccagtcgagcattcactatggtggtgagatggggcagtttcattgcctcccctttggggaccaccttgctacccctagtgtcatacctcagtgctctccagttatttccctctgtggcaagagtggctttattttcttctcttttgggtattacccaggacaaacagtggatgtgacgatggatggtaaaggtacgtcatcattccctctttgatgtgctttcatcataatgggcctatttggaaggtttccataagtacaggaacaatgcctctccactgggcttcgtcagccaccaatgatccgagcaccagggaaaaagtctggagtgatgctggctggtttccatggcaaccacggcttgcctcaaccctgcacacatgctgccctctttccaagtaggaatgtgtttatttattattggtccaacctgggagtgcctgtgcagctgcataggtgttgtccctacctctgccattgaggtcatgttctcaactgggagatgaaatcacagctgggtgatggaggcacggtatttgctccaccaggaaaagctctcatttaggcttcagatcttgtattgtccatcagcgtgatgccagtgatctccgcgggggttagagaggctgatctagaaccattagagtcagacaccatctagggtcctgcggtgaatcgcaaactgccccagagagctgatggtgacgcacaaatctttcataaacatacagcatgctgctgtcccttggagatgcccatgagctggctgagcacgcacaagcctgagaaactttaaacctgggcagtccaacaccggtggtcagtgagcatctgaaatatgaattgctgtgtgctgtaaagctgggagtagtagtgcacacctgtagtcccaactactttggaggtgaggcaggagaatcgcttgaggccaggagttcaaggactgtgcagtgagctatgatcatgccagtgcactccagagagaccctgtctctaaaaaagcaacaatgctgtaagtggaaatttagtacaaaaaaagactgtaaaaaaaccttattataatgtttatattgattacttattgataatattttgtatagattaaactccattattaaaattaatttcacttttttctttttacttttaaaaaatatgctttctagatggataatggtgatggctgagcgaccatgtgaatgtacttaataccactgagctgtatacttaaaaattacttaaatggtaaattttatcttatgtatattttatcatactaaaaagaaagcaaaaaaaaaaaaaaatctcgaggttaagcaaccatctctccaggcctcttcttcagcagtctggcccacatttctagaagcccccagcacacctgcacatttatttcacaggtcaagaaccagtcacaggtcggtcctaagccaattgttggcataagaatgagagcaccagggcttgctcagactaatcgaggtctgcccaggagtggggccagcatcagttttggtgaggtacctgcacccctgaacaaaatcagggttctctgaatgagggagggggatggaaatgactgttaggaggcaatcaacattataatcttaaagaaaaatgtacaagaaaattaatgtatgggagttacaagtgagagcaatctgaaaacttctttcctccacttggaatatatatatatatatatatatatatatatatatacacacacacacacacacacacacacacacacacacgtatatatatgtatatgtgtatatatgtatatatatgtatgtgtgtgtgtgtgtgtatatatatatatatatatttttttttttttttttttttgagacggagctttgctcttgtctcccaggctggaatgcaatggtgtgatctcggcttactgcaacctccaccttctgggttcaagtgattctcctgcctcaggctcctgagtagctgggattacaggcacccaccaccacaccgagctaatttttgtatttttagtagagacagggttttaccatgttggccaagctgttctcaaactcctgacctcaggtgatccacccgccttggcctcccaaagtgctgggattacaggtatgagccaccatgcccggccccacttggaatattatttgtctttaaatttgcatagagttgtaaataaaataagtgtcaaagaaatgtgccttctagaaaatttagaatgacctgtgtggtttgtcttatgtttcttctggacagcgatgctgataggggctcttctcctccaattacaaactgtcatcttggacaagctgcttcactgtgtctcacttgcttcatctgtaaaatgggaataatgataacacctgtttcatagacttgttagttaatacatgtaaagtgcttagaatgtgtctagcacatagcaggagttgaacaaggatcacctctcattaggggctgcagggggactggtggctgctgctgaagccttcagaacctcccttcacatgctcaccacagctcctccagcaggcagaaggcttactcggtggtgcagagaaattaccccaaaggaagcttttcatcagaggtggctgatgagtgcctgatggatgccttttcctccctagatggtcccaagatgactcttcctagatgaagggcctcctcctgagccttgttgtagctcagtggaaaataaataaagagggaacaaaaagtccacgaagaagaaacagtttgttgggtggcgcctctcagggccagtatgatttaattgacgtcaagcctgttatgagtactcatgtggctaggataagtggcattggaagccgggttgcccagcatccttgctctcagagccccacttgatgaccttcttaggggttagtgcctatcaggaggctgttttgagagtatctgtggggaagaagggctcagatttaaaactgattctaagtcaacaattcaaaaatataaacaagggaatttgtggttgctctcacaattaatttggaccagcagcccactggagacattgctgggaaccccaaggaatgtagggatttaaaaaaaaagtcattgaaacttagaccacaatcactgggtcccaacaggctctagtgttaattcaaattgctatctattgggtagagaaagagaatttcagtgccagaagctaccatagagataccttgtagttccaccttatactgccgagaaggaaaccgaggcctggagggagcccatgatgtgttcatgtttacaccgcaagttagtgttaaatattccattttttggaaggaattttacttacatgcatattttccattatgtttataaatttccccctattttaaattatccccattccctactaattgtatctttcattttttctttataaaccttataattctctaatatactatatatactttatttattttacttatcatctatcttcccctgtctccactaaaatccaaactaactccataaaagcagggctttttgtctgggtcactcctgtatggttgacacttatttcctggaacacagtaggggctgaatgaatgaatctgttgaacgaatggatgagagcctgaatgggtctcatagacccatcttggtagaagtaagttctcctttggtcatctaattcagagaaccttggggagaaatagaaaagccatttccactccaaatgggaatctaaggtcagaaaagcacagggttgcccagggctaagctgtaaatattggcattctgagaaagaggtcataagtttggagactttgcactttctctttggaaatggaaaagtcatttcatttcaccacatccactaaggtgcatgaagtaaacagcagacacgctggatgcttggggcatcattccttcaacagggacaacagctttcatgagggttctactaggttaagtagagaggagcagatttttcaggggaagggatggcagaagcaaggctgagaagtcaggcgtgatcattcatctgagctcctactatgtgctgggctcagaaccagatgtggatctacagcttatttatgggtgcatttgagggagtaagcgtttatgagtaggacaatgagggagagaaggattaacattttctgcccgtttcctgaaatgtgtcttaattccttcctaaggaaggctgaccaagaaaataatgcaagaagagaaagtctcttcaaaggagcccagctaggggctgtagatgaaaggattcctttgtgaataaaatgaaggaaggaaactgaagtggttcagtggttgaaccactggctgaatgaagacctgaaataagggaaatgcttctcaaaattagagaccaggctgggcttcctaaagacgactcatgcggagggaggccccttgagctggagggctcagtggaaacctagagacagaaatgagatgtagcagtcaagcagaaattgaagaatgttctttatattgatacccaccatgtgaagagggtgacagtgagtgtgatgcctttagatgcacatgaaagaactttcagacgacaacataaaatttccaaaatattttgtttaacctgttcacacactttcattcatttttccccctctgagagtaactatttgtaaccccaactaataatgaacactagtgtttatgaaggatttactaaatgccacctacaataccaggtgatttttctacatcacctcattaatcctcatatccctactatgagagtaggtaccgcattcatccccattcagtggagcccataggggaggaaactgacgtgggaggctggctcagttcccttagtgatggcagtctgatggaggtgctgacccaagtggacaccaaatgttttgtattgaaacataatacagtgcagcattatggggcagggatggggagctgctggcccatgagctggatatagtcttgatgtgattttatgtcattaaggaaacaattactaagagtaacacaccctttactcctgtagtcataaatctgtagtctacttttaaaatctactgataagcttccaaaattatgggttcctttaagaaagtttctctttagttctaattttattattgttgtttgtttgattgttttcttttctgcctacatatgtctgattttctcttcacaactgcatcctagatgccttccttagtctcttctgcttctcttctgttactcttgttttctgcttctatatatttatctgctgttttcctttctgtacttttccctcttctgtctgtacccattagtatcccttaaatgcctgtgaaaaggaattcaagtgagttcttattgcttattgggtagaagagggttttatgctttaatttaaaaatggttgaggatttaatagtatttctgtctttaaaagataataacattacattgcttttttactttatttgtattagaaaaatattctgactctccattaggcagttgtccttgatagagtgggaaaaaggctcagaattccgtcaagcaggtgtatcaagaagttgctatttggtctgttgtctttcctggttattcattattcagtttaacacagaaatcattaaacatacactgttttctatggtgccaaacatcaaatgaaacatgcttaggcctgtgaaccaagaacttctagaaaccagacaattaccaagggcgtcaaaatgtctcatcttgttgcttgtaactgaacagtgaaaatgagcgtacatgtaggggccatggaatgaggattttaatttgaatcagaggatggggtgaagagcagtcatttacaatattacacaagtcatcttacaatgaataataattctatcttgaaattccacccttcctgccatgtgattataaatttgtttataattgggtaagtcccaccagtcctgtgagattgcaccatgctttatgtttgcatacagtgctttatgcttgtcaaggtgctctgccttctgctgtcttatttggcatctaaacatcctaaataccctgaaagtaatgagacctggagctaagagctctctttacaatgaggaagctgaggatcagagagcttatgtcatttgccttgactacagcaagttgctagtggctgtagacccaatgcaaaccccacccaaaccagagccccacccaaaccagggcttttctcttgaatgcatatggcaagagagagacatcccactgtccattgtgttgaaggtagaaaatgcagaatgtggcagagtgagctaacccgcttggtggccctcaccctggcaagagacagattttccttcctctccctgaagggttaagacaaagaaaatatctgaaacttttcctagctgagcctttgctccagaactcagacacttttgcgacggaagtggggcattggggaggcagaaaaagccaatacataaaaaagcagcaacctcaccacctcacctgggtccccatgaaaccattccacccagatgagtgagtcagtgggtgttcttttcatggcctgtcggctcggtggcacctgaggctgcagtgacccccagtgctgcttcaggtgaatgagcacacagagcattttcagaactatggcttactctctcagtgtatagcagtttaagtgctagggacttctctgaactcattgaaagaaataaagcccctctgtctttgtatccctagaattggaagctcatgtatttgtgatgctggaaagggcaaatattcattgaaagaaaatagctcacatttactgaggtctcactatgagccaggcacggagtgaagcaactggttggcctcaccttgaactctcacacccagactaggagctaggcactgtgataactgctgttttacacaggagggaactcgggctcagagtggatgaatgacttgctgagggttgcacagctattaagtggtctgcctccatagcctctacttcccaggatctccagcaagggatatctcctgaggcagtggctttcacactcttagaggcctggagctctgtgtacactaactgaaacctagctgctttggttagaggattggggtcaggaggagactgtatcctcatggcccagcaagagttccgcaaaacccttgggattctcagtagagcagatcaggatgctaatgccagccttctctggaagtctgtctctttgaagttgaggtcatttccaccacaccccagagggacccatctagtcgacgcctgcctgcctggccaccacttccctactggaaaatcatcatttcccatgttctagttggggaaggacccagcagctctttctctttggcccatctctcttccttttatgagccagctaaaaggaatcccccagaggtcatctttgtccttggcgtgggaaagagagaggccttgtcagcaggtgggggaggtaggaaatgctgttctcctgtgggctgaaggtcagtgaaaggtgagctggggctcctgaggccagcaggttctggcacagaagcagcccgggaggaagctgccctggaatgtgctgtggacagacctgcgtagatcccttctttcccacgtccaggctgtcccagcatctctgaccaggccaaggtcacctaggcgcaggctcttctccttacctcacagacaaaaagaacttagcactgtaatctaagtgttcccactcctcatttgaaaagggaagcatttcatttttatgtatgtatgtatgtatgtatgtatgtatgtatgtatttatttattttgagagggaatcttgctctgtcacccaggctggagtgcagtggcacgatctcggctcactacaacctctgcctcttgggttcaagtgattctcccacctcagcctcctgagtagctgggattacaggcatgcgccacgactcctggctaatttttgtatttttagtagagatggggtttcaccatgttgaccaagctggtcttgaatacctgacctcaggtgatccacccaccttggcctcccaaagtgctgggattacaggcatgagccactgtgcccggcctcattttttttttttaatgaattaaaaaaaaaaaaacttatgtggcagttgataaaataattattttgaaattagccacttatcttctagaaaaaaaaatgtttgttgctcttctgatattggtaggagtttcttcctcttccaaggtgactttttggataacaccctgaggggactacccttcatcctttatctccatcgcagccattccaggccttctgtgactcctgggataaaataaacattagtgggcactgttccattacagggttcccttttggtgtgttccattgttatctccccctctcccccaggacctattctcccgggaaatgataaacctgggggctttagtggtggagaaggtctacagagcccaacctcaacttaaaatttccccagcctcttttggaagccaactaggtacctgattttcctgagtgggacacggcagccccctgggtggtcatagcaccacagtatactgttttacttacctgtatctcttggccatgccagcagcaagagcctcttggacctagaatgaccaaggaccgtggcctgtctgagttttaactctggatttagaagattggggatcttgtttcagacatttactcatcaacaaataccaagttcattgcaggtagggttcttggaaggtaagctctgacacgaagttgagtgtgctggaggctcatacccacgggaggaggggaaggcagcaggactgtgcagaggttgagtcgtgatgcaggctggatgcagccacagccagccccaagagcaccaagatggcctgccagcattgtgctggaatgagtgctgggatgggctgacatgggcctttattccatcactcccatcactcagaggaggtgggctgcccctgaagggcatgacctctggccaggtagctctctgcaactgagcaagccctgaagaagctgctgacaaccctctcacgagctgagcagcaagtccttcttgaagggggtctgtgcctgtcacaggattttctcaatggctgaggcactgtgttgaaacatggcagatcaagttggaaaggcttggtctctgtccatgaagtgcttgcagtgctgttgccctgactgcagtgcggtggatgctattatggaggactcttgtggtggctgcttggtagccccaggcaggcaccaggtcattaacagccgcgtgaattcccttgtcactcctaggagatatatacctgcacctctgttttgctgaagaagaaagtgaggttctgaagtgttgagtagctcctaggggtaatacggccagctgggaaagatgccaggattcaaacttaggtcggactctgaaggcagtgtgctttcctttattcataattgcctttgagattgaaggcagagccaacaggagcaggaccattgtgggtgttcagcagtgtcccctctcctacccttgctcatacccagttttagctctgtgcctggactctagctgtcccccgccaatggtgccacagctccatgccttttctgtgaccttcaccactttctctgcccttggggcttcctcttcctcttgacttttctcagcacttaggtgttggccataactgtttttggatgactgcattgggtaagtcccaccagtcctgtgagattgcaccttcccaaaaggcaaggaagttgtatggaaactggtttaggccttgtgtgagattcctttgctaacagtccaggaagctgtgtctggggcagcttccttcccccaaatatagatacttctccaagcttcctgtctggaatcagggtgttgtgaaatgtgggcactcattcagtcctaggggtcatggggaaccctaccagctttcccattaaacccagctggtaaaatggactcatgtctgtttgtttttggggtttgtattccctcctacctaaagaaactgcaagagaagggatagaaaagaccaaggcatcagcaagtctgtgcccaggagtgcaataatccttgtgtttactggaaggggaggctggcattgaacccatgtcaagataggtttggagaaaacccaaagatgccaaggccttgccttccatcccctgtgatctactacttaatcaaatagccaaggatgtgttaagagggagaaatgtgtaaatgtttagagagcagtgagttgtgagctgtaaatggccctggcatgtttataagaaatgagcaggccagaaatgaaaccccaatagtttttttgtgtggatagaattaccaaactgatggatggagggagtgttctggttgttaaatatttgggccttgggagtcttttgatgtagcaccttgtgacaactgcttgcaaagtgagctcagactagcttaaattagctcaggcccacatgttcgggaagggaggctggagtagattcccgccatggttgtttgcagctctcccttctaagagttcaggactctggtagtcagagcgcccaggcttggccagatcagggcacctggggaagggtttgtctctgcctcttactaccacatgaagtactcagagtctgggtgattgtggacagggcttcagatcaaggaaacttaagattctcaatcagccattgacatatgccaagaccaatcaatctttttcatctcatctcccattatccacccttcccacagccataaccacccactggtcactgtgcatgtctccctcctttgtcttctggtgtccctgccatggttccttcaggcaaagatgcttcttcaacctatccctaaataattctgcttgaaccttcagggtcaagctgaaagtggtacctttttcacagtcttcctgggcccaccaactggaagcaatcactgcctctactaaagtccacatcaattaaatagtcaattagatagatccagagtgaaaatggaaaccaccttctttttgcatcagtgggatggatgactggaaacatggatgaccagacaggtgaaaagaagaatggaaggaaacatgagtggaaggacaaacatagtgtctcctcgttaaaaaaaatactgtttcagctttcctaacctcacctgtaatagagctaggaacaatagccccatctcattatgtgagaattaaaatacttagccccaggtatgaagcactgtcccattattgttgttattttggaaaataactccgtaagatgttcaaccctatgaggaaattattctttttaagattcaggcttaaaatcaaatattcctggggcttgtaatttcccatgcagacctacgccctcatgttactgttgaagaaactgagtccagaagaggggagggagggacttgctcacactcccagagttggtggcacctgggtggcaaagtataattttcaaaaagttaaaattgtgactcatacaaatctagaatgtggacatgtcaaaaatgcatttagctcattaatgaggaaaccaacaagatggcagcatgagtttacataggcactggaggaagagtgttggaatgagattgctaaattagaaacaaaactggttaatgtcctacacgggagtcaattaataaactttgagattatcttttctcctgaacagaaaacatttgtatttctactaggcaaaatcctacacattaatgtgtaacttcacataatctggctatttagttggtagcaaatatcaagtcaacaaaggtacttactttcctctaggtaattaaatatttcttgggcaggctgttaaacattgctccacagatgaccttgaaaggacatgacacatttccattccattgcttgacccctgctaatagaaccaagtcttctcacccaagctgctcctctcttcctcttccatctctctgctgcatgcagggagcctggtgccttgcttccattttctcattggaaaaatgagggccataatacttgccttctccaccagactaattatgtccagttatgacttggggaaccaggcaagcgcatggaagaagatcacacaatcctggatccggaagaccttggcatccaagggaaaaacaggtgtgggcaaacaattgcaccaacatttggcaatggctgtggcaggcaagagcaaaggactgcggcgcctagagagaggagtgacttggctgagtaaaggaagagaaaaagattgagagaggaacactgaactgggatttccaagacccgtagatctgttggtgaaaagggagaagggcatggtcagcctggtgaactgcagatgttaagatatagggactaaaaagtaaggcactttccatttaatgtgcatatgctgagcttttgttatgtggcaggttctgtgtttagccctggggagtggcagcgatgggaacaatcgtgggcaaaacaggaaacaaattctagtccttttggagtgattccaggaggatgggggtttgggtggatttgagaggggaacaagggaagtggagtggaggcaaaagaggctggagagactggtcttgcactgagtgatgatatggttgatagctcctgaccaaacaattaatctttgttcagaactttccctttggaaagtctgtggctgccttctggggaaggcaaacaaatgtgaactcaagaagtttacaatttagctagggaaacaggatgtgcaaacaggaagaaccaactatgtgaaggtaggtaagataactgttgactccatgctttaaggaaaggagagctctttgtggcttgggtggtcagcaagaattttttaagcagagatactcttgattgggttggataaataaaagagcaaggaggacattgtaggaggggaattgctcccagcagagcctagaagcagagagattttccagggttcccaggagaagagattgaataagtgcagtgggccatgtggtgacacatcttgagtgtccagctggagaactggaagtgcatatcataacaggggtggaaaactcagaggttgatagggaatggtgaggttgcaatgaggggaccggtggggactttgaccagtggagcaagagtctttccagatgaagggagcagctgcctcacagctctggccagctgtggacatttggccagtttgtaatttgtcaaaagaagtcagaaatctgcattgttgtgaaatctccagattttttacatgttgtcaatttaattaaaatattaaaatcagcccaggggtcaagactgctgacccatgcatggggcctggggggaaacttgtggggctccagcttgtggcttctctgttggcggtgcagctgttgaagattcctacacacaggtgccacaggggaagatggcacaggaaaggagtgtggacctggagaatcaagtaaggagcaggcagcaactgaggcagggccatatgcaactgtggccaggggtcacatatcatactgagcagagttcaccttgcccgagaaccacaaacccaggacaaatagaagggaaacaaaataaaggaaagggagccagcgtgtctcgttcagtgttgggtaagtagtatgaatttggtttgttttcctggctgtctttaaagaacgctgggcggtgctagcctgtatttctgatgagaggaaggggatttaacctgtggttcaagtgcacttatttggatagctcagagtcttcatatggtgttgttgtgcaaagagcactggactagaagttgggagacctggattacaggaatgactggtgttagctgagtgccccactgtgtatcaggtattttgtgcacattttcagtaattctccaaacaaccctgtgaagtagagggcactgtgactctactttttcaaggtcaaggtcacagagttggtcaatgcaaggctgggattggaatgagacttcaaaggccaagtcttttccagtagaccccgctactgcactggcctatgctgagtctctccacatgctccatgttacctgttgtgtgaacttggataggtcatctaccacagaggagcaagaggggaaacttcttcagggtttgcttggtccagtctcaacatgctgtggttctgcagttgagatgcatgttgaaatgcatttcatttgtatgttgactttttttattctaaaggtctttggatgtttaatttcaaacaaagagctagagattggagaggcatcaatctcaaacaggcagcggcaggggtgtttagaatgaacttgacagccctgcaagaaaagatgtgttcttatcatatgtggaagggctttttttttggtaggaaataggtacttggacatgtaaaaatcaggcattccagcatggctgtccccaaggcccccacctggaggcttagactgcagcttctgctgttttcatatctttctccccttttatcctctctgaatgtttccaaacccccaaaggacctgcaactttaaagagaaatattattgatgcagttgaatctatttttagcctgctggggttggtgcacatccaaagcagaagaatttggttttatatctattttatctacatcaacacttctttacctaaaatccattaaaagataacagaaacagagctgacttcagacgacattcaattggttcatattttggggggcaatatgtcatgccccaccttgctgtagctgagacatgcctttaacatttccaaggagccacagaaaaagacatagaaaaccttcgattgcatttagagattagaagaggatttttctcctaaatatggagctgtttccttgactcagcaggtatgtgagatggatatgaaagcaaaagatgttcccttgccatgaagcaagtatttttgagtcatagatcttattgatcagactcattcaattggacatttctcttgtgtgcacacatgttccctctctcctctgtctcctcctgcctcagtaacttgtagagagacttccaaaaagagagcaggtttttagagttgagagttaaaacttctggaatgttgttctagctcctggggttgggcagggaaaggtaatcctcaaatataggtggggcctcagaggaagtttggtgaatctgtcaactagaattttttcttgaaaattctcattgaagtaacctctatcctcaaaggattccaatatacatctagggttgaaaaggaatgaactgatggccttaatcagattgatttaatgagcatagggccagagccacaagagcccagactgggtttagagtagaggttcacacatggctgccagttagaatcacctacaagacatagaaaaaattccagcacctaggtcccccttcagagattcttattcagttggtctgagtgaggtctaggcttccatattttgtaaatcctcccagatgacttcactgtcatttccactctagagctgtgcttcccagactctaatgtacagggaaattacctgggattcttgttaagatgcagattctgaggacctagagaaatggcaagacataccatgttcatggactggaagactcatcctagtaatggtgccagctcacccccagatttctctacagatttaatgtaactccaaccaaaatctaagcaggactgtttgcagatataaacaaaccaatttctaaaatttatgtgaaaaggcaaagcaactagaataggtaaaataattttgaaaaagaagtgtatatttgaagaaatcaccaatcgccctacctgattttaacacttgctataaagctatagtaatcaagacagtgtcatattggcaaagggatagacacatagatcaatggagtagactagagtccaaaaatagacctacaacaaatatggtcaattgctttgatagaggtacaaagacaattcaatggagaaggagtcttttctacaatggtcttggaacaattggacatccaagggcaaatgaaacaaaacaaaacaaaaagctcaacctaaacttcatgtcttatacaaaaattgactcaaagtggatcacagatataagtgtaaaactataaagctttgataaaaacacataggagaaaatctttctgatctgaacttaggtaagttagacatgaccccaaaaagatgattcacaaaagaaaaatggatcacttagacacgtcaaaattagaaactattattctgtgaaagatactattatgagaatgaaaagataagctacataatgggagagaatacttaaaaatcacatatattacagaaggctttatagccaggatatataaagaactctcaaaattcaacaggaagagaacaagctacccaactggaaaatgggcaaaagacttgaatagacacatgatcaaagaggatatttggatggcaaataagctcagaaaaagaacatcagcatctttagccattagggaaatgcaagtgtaagcaatgatgagatgtgaacacacctattataatggctgaaataaaaataccaacaataccaagtagtgatgaggatggggggcaactggaactctcagacattactaatgggaatgcaaaacaatgttgctattcaggaaaacagtttagaagttttcttataaaattaagcatatacttagcatattaccagaaattcaatgtctagatatttaccctagggaaatgaaaacttaagtttacagaaaaaacattcatatacatgtttgtagcatctctattcataattacccaaaactaggaagaatctcagtgggtgaatggctaaaacaactgtgatacatccttaccatgaatacatgcagtagcaaaaaagaatgaactattgataaaagcaacaacttggatgaatctcaacaacattttgctcaattaaaaaagccagcgttaataggttacatattatatcaatttcatttatgttacttccttggataggtaaaactgtagtgacagaggacagattagtggttattagtgggtaggggtgataggtgtgatcataaaggataatgcaagatagtttttggggcagagttgttctgtatcttgattatggtggtggctatacaaattgacacatatactaacattcgtagaactttacaccaaaaataaaaaattaaatttactgtatagtaatttagaaaatgaaacttttgaaaagtgcagattcttattcaagaggtttagcaatggggcctgggactctgcatttcttataagctcctgagtgatgctggggctcttgggaacacaagtggagggggttaggctctacagaggaaacatcgtaacatgcagattcagctcatttcattcctacgctgagagacctttaacggatccatagttcttccaagataaaattcaaatattttatcacttcaaaaaacttaaagtaagctctttcccctgaaatctcccatatccctcagatcataccctacagcagtgtatattctctgctttgtttgtggcctagagtgctctctatccacccattccctggaggatgagtgaccccttagtcactggccagcttgaaaggcaccttcccagggaagccatccccgaccctgccagtccctgacacacccgtgcggaatgagggtgcaccttctaatgcagtatgcatgctattttgctctcatgttctttcacttttcagatgtttctctccctaggaacacaggcttttcaaagacaagatctatgtcttgtaggcccggtgaccagcatcatggcaaatagtgagggttgctgaggagcttacagaatgaagacaaactgactttatagaaatagtgaatgtttcagaagcaggaaagtatcctcttaggaactatggggaaaataatgaaggacattcattgatttccaagaacagaagatgccagggaaggaaaacagcttcctccacaatctgtgctgcccactccatgcaggagatagggttcatccacatttgtaaagaacatgtgtgtgtagagtggacttgtaatgtaagcatcacttccatcaccaccaccatcatatctccccagtatcaccatcatcttcaccattaccactatggaacatcagcaacattgctgtcatcatcactgtcatcaccaacaccaccctcataccatcatcatctcaatctcttaatgttattgcaatttgtgtggtgtaacaaaaataataatgactccaaaaatgaaataataaaaatgttaaaaagcacatgtggccgggcgtggtggctcatgcctgtaatcccagcactttgggaggctgaggtgggcggatcacctaaggtcaggagtttgagaccagcctggtcaacaaggtgaaaccctgtctctaataaagatacaaaaattagctgggcatggtggcaggcacctgtaatctcaactactccaggggctgagacaggagaattacttgaacctgggaggcggaggtggcagtgagctgagatcgtgccattgcactccagcatgggtgacaagacagaaacgtgatctcaaaaatagaaagaaaggaaggaagaaagaaagaaagagaaagagagagagagagaagaaaagaaaaagaaagaaagaaagaacatgcatagtacctgagaatttgcaaagtgcttccttggaattaactccagctgcataaggaggatgcactgaattattcacctcactgcagtctgagttttattcttttctccaagcccttatatattattgtctttggatttcctacatttgtgtggggatctaggctggaattcttctgcccatcttgcaggtagtataactgagaccctgggaggttaagattatagaacttgttagtgaaggatcaaggaggaagatggtttctaagtagggcccaccaaagtgccagagatctccatgagaggtgtgatgagtgggctgaaccatcacagagcacaaagcacaggaaatcggttctcagaactcatttgggaagtcagcggcaagttcacacaccaaggtgaaagcggcactataaaaggatggatggaggtacagtaaagaggaagaggaagaaaagaggaaacaaaacgtggccataaagtgtagcttctgatacatagtgaagggacagaaggtgaatccttgtaaagtggctagcctgtcgggagccacactatcacctgctccaagttacccctcctctgcccccaaccaaagaagattgtgcatgagagttctaccattgattgagagactctctaggatcataacatctggaattcagtcctgctttagccatcgtctatggtagtaagtgatcttgaagaagtcaactaaagcctcctcttcagaaggtccccagacaaagtatctaggttgctgaaggcttgggagtggaggatgcacatgaattgccattgcctgtcttgggttgggttgtggtacttttgaaggagacagtgacaaggtggctttgtttcctagggtggggtgctagagagtgagattgtgatgcttgtcatttggtccaattgctactgctttcagttgagcactggtgaggaaccttagttgattcttctatgtaaatggctcttgcacctcaattttcttggcaattactccccagctgtgcccttcttgctgcataaaacctcaatcaatccttcattaaaatgctacagaaactgaaagcttttcccccttgtttcctaatttttccccgagtggattggatttgttatgactcaaatggaaaaggactagctttgtaagcaggttcagattctagcccggttcctatttatttatagcccaaattatttcaacaactgctgtccagtaaaaactctgtttaatcagaggcaggtaaacgtgccaatttcatctcattgcctaagtagtctcctctgctgtggaggaggaggatgccactctgggtcttgtcccaggtgctgtggggctggggaccaaggcagttctagactggctacccattcaggcctggccactcaggttgtagccacttgtgtcatttggtaggaaaagtgagaagttatgagccagaggtttcaattatggttttgccacttactgattctatgacttataaggttacttagcttcttggggtcagggttcactcatttaaaaatggtgatgttactaactacaaatataaatgagttaatgtaagcctccagtcacagcttggaagacagtgttttctttctctttttttcttttcttttttctttcttttttttgagatggagctttgctctgttacccaagctggagtgcagtggcacgatcttggctcactgcagcctctgcctctggggttcaagagattgtcctgcctcagcctcccaagtagctgagactacaggcacacaccaccatacctggctaatttttgtatttttagtagagacagggttttgctatgttggccaggctggtcttgaactcctgatctcaggtagtccgcccaccttgacctcccaaagtgctgggattacaggtgtgagccactgcgcccggccgcacagtgatttcttaatttatggttcatggagattataaaaattggcattttaattataagtgattgaatgaagtcagacattggagaactgaataaatggacacatttattcaacaaaggttgttgaggatctgctaggtgtcaggcattgtgcaaactggtcgagagaataagatattctctctggcttcatagagtttacatggtcagagagcgaggacaataaacacaaaaacatatcgtcatgcatattgacaagtccattttaaaaagaacagggaactataggagagaagggggcaggagtgggaataaattgtactgggaagcagtcaggggagtttttcttgaggaggcaacatttgagctgagaccagaaaagggagcaggaattaactggacaaagacggggaggagtgtatgtctcactacaaagcaagaaagagctacgcacagtcaaggaaggagaagtgaagccagggagtctgaattggatggccaagccagtgactggcatgaaggaggctggagaggagggcaagagcatgtgggctttgtgtgccagagaaagtattttacatttttgcataggcaccatggaagtgttttaagcaaggaagtaatgtaattctatttactaggactagatgaagttgaattgaataaaaggttactaagggtgcaaatgccatttttatgggaagagcttatgcactcaccctgagggctggcataaggcaggagtggcattgagtgtccttggctgttcctggctttggtccctgctgtgtgctgcagcctcagtggctgcagattctgcccatctaaagccatggactttcccatgaccagggcccattttgcctttgggtctgagaatccccaggagtgggaatccagaagatgtcagctctgtggcctgaactggaattccaactggatcatttcattccactattgattggaagaggaacagtaaagctgtggtgttagctggagtaaactggagttgagaaactcactgtgtatttttcagaaaaaaaaaataataataattcttaacaatctcaaactactctcaatattgtaagtcaccttgacagcacgaggacttgaatggtttgcctggagggctaacgatcttggctctcccaggtgcctgtccgcattgggagacggcgcaagctaagccagctgtgcatctctcctattatatcatggaccaggggaccatagacattttgaaagggaatgtatctgcctctctcacacttcagcctgcttgtgggatggcttggcccagacagcagcaggcactatgtcttttctaaatgttctgcctcttgatataagcaagcggtccgtgaagagatttatcagaggcccttgtgatggatacatgtcttcttataagctgatagtccaggggagactcctaaacaacaaagggaactgaaggcagactggcagcaattctagtgtcctacaaggctgtggcttgtcctgtgagctggacggcggggtctgaggcaggacgtcaggcagggccatgctgagagcatttcacatttattgaaagcctgctgtcctctgggcactgtgttttcctcttgccattccatttatccctcccagtcatgctccgctttatggatggagcagttgaggctcagaggggttacataaagcacccaaagacatatgggcaggaagtgacacaacctggatttgaatgcaaatctttctggctgtttccatattgtctcacagcctatcccagcatcgtgtgtgtgtgtgtgtggggtggggggggtggggggggatagggggtgggggctggtggtatttagggatgccctcttcttaaggatgtgtcctggggctaagtcattgttcttgggggtgcagggaagggacaatggatcggaagggtctcagtttgcctctggcctgtcagtgggccaccctcctctcctctgtgatgcaggggcagtgtggctgccttgccagcctgccctcctccagcctgctgggagcctcgcgtgagacaaccgatctggaagccccttagggaggacacagcgcaggagaggcagctgaggctctaaggacagctgctatcaactgccagcagccactgagggagaccctgggcctggcatggctacaaatgggctcagctccaagggaacagagaattgggccacatttgtctgggctgggtcagaaatggcagttcctgagcccatatcaccagctcccatttgcaaggctgaggaggtgcctgggcttgctgtgtgctgccttgctttcgttcccgctttttaaggcacatatcagcctgggcagctcttgacccacaaggtggactcttctgggccagccacgggcagtggccaccctgtcctgccaggccgcagaaaggccctgggccactcccaactggagccagtgctcctggagagagcagtgacctggaccagcagacctatggatcccctcttgctcctgcactcgcctgctccttgcagtgactcggcagtgggagtgggaggtgtcagagcaattaggcggaaactcctttcgtgcacctctaattttcgagctctctgaatctcattagttcccgggcttttctgctctgccctcctgttctttgcttgcagaaaatccagggggcagccagtcaccctgttgctggcggtgatgatgagaccccaggccagtggcacagaggcctcctgggaggaagtccctgtttgggcgcccagcactgttcagggcctcctctagtcttgttctactttaggccttaccttctcatttctgttgctggagcaaaaggctctgaattcagagttgggaattctcaggcctggtctgagatttgtctgccccaatgatgatgatgatgacgatgacgatcatgataatactacactaatagtagttaagagttaccaattgcctattctgtactaggagcaatttagacctcatcacatgtaattctaacaacatccccgcaagacaagcattatagtcctttcatagatgagaacatctgtgcttagagagattaagtaactttcagactcaaacagctggatggtgactgagctgaggtttgtacccatgtcttgatgactaagcccagctgtgcccaccgggacaccttgacctagtacttctgagagccccagggtcactattcagaggctcccagagctgccagtaccccagatcattgcggctccctcatcctggcagtgaggaggctcaggcctccgtgctagtgccccactccttgattctacccgtccctccctccctgtggcctgcagagattccgactgctgctttgtttcacccagagcacctcttctgggctgagtgctgtggaaagggccaggtaggaaaggagatttaaagtagcttgactcagtttctcccctgagtttccctttggagacccgagaaacacatctgggaagtgaatgggaagatgagaagaagtaagcaaaactgggaagagtgaaggccttggaagtgcagaggatgccggtcgtcccaggtgctccggggagtatttctgtttagagtggcatgtggagggagtgctctcctggtacagcaggcgtccaggcagagtgagactctgctagactcaactctttcttcttctctgaaggaatcagagactgaaacaaggatggcttcatcagtttggccatagcctggaaagactgggaaacccagcagctctctggcccctgggctcacagacgacatagttcttggaagctgtcatccctgcctgtgatgactgacctgcctcttgccaggcttccatccttgcttcaaggcctgctaatcatcagctccactgggagatctttgcaggctgccctggaatcatagctccaggcctttgttctagaacatctgttgcattgtattgtacctattgctttatatatttttcttccttttctccaagacaagaatgtgcactcattcaagcctgggatgggctcttcttatgtgcatattcagttccaagaaatatttaaactatcactagtgtaattcagcatccataatgagtttatactcttgtgtattgaaatcagatgactttcctgtctttgtggttcatattattaatattcttcttatcgctttgctctgcttagttctttttttatacatctttgcctctcacccccattttctgccttggcattcgtttgttctttcagcgaatgtccactgggcacctactgtgtgccaggcactgttctaggtgctggggatacagaaatgaacaggaaaattgattggcttatttatttgaaaaacacagaattagggttgactcagggtgaagcttgatccactggctcaacagtgtcacccccagagctcccatctccgtgggcactcaccctgtgggttaactgggtctttggggcgccatttcctggacatgcctcaagacttccctgaatgagtggttcatctggtaatgaatgaggccacacaggctcccttatacttgtccctggcgtgggagctgccttctaaggtttcataatgagaacatgcttttttaggggagcaggtgtgtggtagactctggactcctacgctgctgtcttctgattattcccagagaactgcacctctccgctctggttgggctgaggctgtttttgtcaccccacaggcctgtgttgtttgttcataaagcagagagacatctgtcatcctcactgagcccgacagatgccacattcaaagacccagcacatgcagcagcagcggtggcagcactgtcattgcggcgctcacacacacataccgacacactcgtttcttcttcctggcggacaaaccttcctgcccctccccgccaacacatgcttccacacctatgagattcaaaatagggtaacagcagaactgcaggcctgaagcacttgctggacagtgaggacacctctgggttgaggggacagggttaaatggggtagaacaggaagaatattcctcctcctgggtgtgaacgagtctcctttgatctctgcaggaagtgccttacccaggccctgttacctttaggagcaagaacttgaggaaatggtgtgggcacatgcacaaaacatggggcttacttttagcatgaaggggaaactgaggatgcccagctcattgtgtaagagagtgaaggtttgaccgagggtggcttctaaagcaaaacttagacagatgacgacagggatgaggtggcaggatccgaagacaaagaagaaccaggcacggattcactcgtacttgtaggaggaccttggacatgttttatgtaatacagaacatttcctcttttaggattgtaagtaatatcatggtagatgttactggaaattttatcactcccaccctgtgggtcttagcaggaatcatcctgaatggtgtttgtggacttgttttggagaagtctgtgttgagggcaggggtggtaggactttgtgttcaacttggcaggctcctggagggagagagtggtctgggacaggcgttagagggtcaggccctctgggcttaaaagagaaaaaggaagaggggaatgtcttggagaaggaggggccaatcacttgttaggtcctaggcagtgtcttggtgccatgtattagaagggaggtggagggagtggggaggtatcagcctgtagataacatcctgttctaatgggtgggtgtgagaaggtgggggagatgctttgagacatatttaataatatctactacagataagtcagtgaatcccactctttaccatgtaggcttatcaaagaccactagcagaaaaagactggtctaatcctgagagtttccttggaggacttcctcttagtgtagccccacctaaggctctgggatgttggagaacagccggagagagaggaccagttctgtggctctcagctaggttgcaggagtcttgggggtgggacggaggattctcagctgattttccctgcttttccttaacatcccccactgcttgaaggagctgttccacttgcatctttttcttatattgtgctttggctcaaatatttatctggaaaaagtcctcaagaactaaaacctttctttgtatcttgaatcagatcatttgcaagttccctctgactgtaagctgattttgtgacttggtgttcccgagacccccagtccacttcatctcatctttgatttttaagccattctgtctttcttaagctgacatttgaattcctaggtggttctttctgcatttcaccagcttacagttgtgactcatcctcctcatgttgttttaagtcatgaagagaatctgaatccagcaggaaaactgagagccatcttcataacagtgaaagtttctggaatctataaaacatcaatttgtatgtagaaactgaagtttaagaaagacaagcttttctcttaatttaaattattgcgtctcatgggaaatttaattttttaaataaatcacatattccaatgaagcagaaagctttgctagatacacagtgaagatgtttgctttaaaaattgttctttattcagctagagaggaaccaggggaatacaggaagataaaaagtgctgaatggaatatacaagacaaggttttgaaatcaaggctaaattaatcatctctccctttcagtgggctatatctaagcagaggctggcagatactctctgactgtcagatttgactatgttattctctaccagaggatgctaccagaatgactgtcccagggtccatgggtgccaggatctgttaactgatggcaatcttcacctgaggaactgcatgtatcttcagggatctcttgcatgcaagtgagacaactatggttcaagctgcttaagaaccaaaaaaatggggatgggaatttgatggcttgggtaactgaaaagcttagggttaggcttctcttcaggcttagctgattccaggcaatcaaatgatgttcttcagtctcttgctgtcactggttcactcatttctttttccatctcttacctctgctttcttctgtgttggttttatacttgggcagccttcttttatgtggatttccgtaacagaatcaaatgcatatcatattggcttcttacctttggctttcaatagaaagatagattctcttttatatatagacatacagtagttccagcaaaagtcctagaactcactctcattggatcaggttggttggcatgttgcttctgaaccaatcaccacagccaggaagataggtctcatagtcttactgagcaaacctgggtggatatcactcctggagatggaaggtggaggtgggcgcattcttaaaacagagggattgagagtggggaatagggcataccagaaggggcaatgaatgctagtcaggtaaagataatagctatccactatgatatggtttggttgggtagacttgagggaccagacctggggtgacccatgtttgcccagctgatcccattgggtgatttcttcctgtttgatttcctgcaaggtacctcagttgttggcatgattctcctgccatcttgctcctggatgttgaaaggccacacggtgtctaatttaccaacacagacctgatctagaaggcaaagacaagttctatgcccacacttttccaactgtagagttaagaagttatttctatcctccaggcttaatttttggctatcaatattgagctaaagactattgaagatttacaaaattatgtatcaatttaattttactataattaaacacattttagtgaaattcctgtagcttccgttattgatatttttcacaacaatcctctgacatatacaattagccctattttacaggagagaaaacagggtcagaatggtagagaacttgttaaaggccatgcaacctggagaatccagcatctatgtgcttgtgctgggtttgatgcatttagggatgaataagacattctctgcccttgagctgtatgtaattgctctgtgtttatagttacataaaagaatgagtaatatgcctctatggaagtaaaacagaaggaagtgattaattttacgtaaatgtagtctaggagacagaagggacattagagatgggtcttgatgagtgagtaggagtttcccacgtggatattgtgtacagggggtcgttttttcactgagtaatgcgtgagttttctatgagatggagctgccagtttcaggaaatgtaatgtcacccttgactctgccttctccttttaccagaaggatggccacagagatctacattagtattagttaggtgctttcatttgcaaagactagaactcctaacacaaataggcttaaataataaagggcatgtattgtcttatctaattgaaaagcacagaattagggctgacttaaggccaaacttgatctgttggctcaacaatatcaccaaggatctggcttctttccatctctccgttctgtcttatgctatctttcatatcctttggtgtctttatcaaaggctggcaccttttaggccctaatatgactgaaggagctcctggggctagatgcttccttcatcatgcccaacaggaaggaaatggcatcgtttccaggcactttcagcaagacctgagagtcactctgattggactggcttaggtcacatgcccatccctgaacccatcactgctgccacggaacagagaacattgataaagttgatttccctgaagccacatggatccccaaatggaattttgcagactgatggaaggaggaagtggacaacggatgctatattagtccgttttcacactgctgataaagacatacctgagactgtgaagaaaaagaggttaaattggacttacagttccacatggctggggaggcctcagaatcacagtgggaggtgaaaggcacttctttacctgacagcagcaagataaaaatgaggaggatgcaaaagtggaaacccctgataaaaccatcagatctcatgagatttattcgctaccacgagaacagtatgggggaaaccaccccgtgattcagattatctcccacggaatccctcccacaatacgtgggaattatgggaatacaattcaagatgagatttgggtggggacacagagccaaaccatatcaaatgctcagaaggcatatgttttggtaaggcatcaaagaaatgtttaccagagcactgaagtttccatagtctctcttttttgggcagtaaaggttctatatagctccaagacataatctttgatgctcagtctatgacaactcaaattctaggcctttccttggataattcagccactgaactaccttttgcttccctctgtagtctcttcttagttagtactctggacaaacttgctttgactttgtccaaagacacccattctttattagtatatgacgaattttgtggacagagaagagtgctatgggcatgatggcatacttaccacacagaatgatctagaactttgtagcaactaatgtcctaggccttttccagagctgctttcttcaaatggggcaacagacgtgatgccgcattttctaaagctcttcccaacctccaaaacagcttcttttctttctgctgaggaagctaaatttactttcagtcctcaaatggtgaaaaaaaggggagcctccccagatgtctcacactgataagaggaagaaatatccaaagccattagccagtggtgacaaacagtgtgtgaattgtaacggacgcagggtggctgaagaaaagactgagtggttggagacaggcaggcaggcctgagtttcaaatccttaccctgtcactttcagcactttgggatgctgaggcaggcagatcacgaggtcaagagatcgagaccatcgtgccatcatggccaacatggtgaaaccctgtctctactaaaaatacaaaaattagctgggtgtggtggcacgcatctgtagtcccagctacttgggaggctgaggcaggagaatcgcttgaacccaggaggcggaggttgcagttagccgagattgcaccactcactgaactccagcctgggtgacagaacaagactccatccccacccctccacccccaccacccccccccccaaaaaaagaggcaggatgccatggggttgaagaaaacaggccctgtagccaggctgcctgagtctgaatcctggctctactgttcaccaactgtgcctgcgttcatgtcccagctcttccattgactaagcctggatcaagaaataatccctgagttctaatctgtcattcaggtaattgcgttcttatgtttccttttgtcatttggccttccaacttagttgggatgatggtggctgtcactttatctctttggcctcaattgtttcatctgtaaaatattgatacaagtaatgtccacattataggttgttgtaaggattaatcctcatttaactcatttacaaattttatgcattatatatgtatatattatatataccttcatatatatggaaaacacttgtaacagcatctagtaagcacgaatgatgtggatagatagacatatcttatagggttgctgtaagccctagagactttgcatatatattgtctggcaatagcagacactgaataaatcttagctattattaataattattatgttgattgaactgtttaataataatgtgattcatctaaatagagctttatagtttctggagttcttgctgccaatatgatccttcttgagccctacaaccactcagtgatggggctcctattcctctgtccagtggctctcagggaagggttggatgcctctccagggtctcctggccaggtggtcattagcaggaccagggtgtgaatcatagtgaggagcttcccagtccagggcttgttccacatcctctcttcccccattctaaaggcctcccagccatttgtcacagcctcatttgaaatgcctgtgcttctcatctgtaatatcctgattgtcccattaatctcctttaagcttcatgaaaaatacaaggggctggatcaggaaatagccaccaagttctaattttgcattcaggggattgtcttccatggacgtgaagagactgatgtttcccatttggcctttgcctttccaactaagtcggggagagctgtcattttctgaattatcaaccagtttacaaggtggcatctatattttgcctctaatgtgtctgtacttttgttgcttctctatcttcatatcatcctctccctagtagatgttctacagtactgcccagagggagtggtaagaaatgtcttttgataaaaccttaaaagcttaaaacttccagtcactttcttttgcatattccttagaccctggccataggccagtgctcactacagaaggagcagtgtttgttttgttaacacacacacacaaacacacacacacacacacacacacacaccctgtactgcaagatcctaaattttagacttagttcactgttttatatggtagccactagacacgagtggttgtttaagtttaaatgaaattacaggttcagtttctctttgcattagccaccttttgagtactcaatagccatgtgtggttagtggctaccatattgggcagcacagatagagaacatttccatcaatcacaaagtcatatgggacaacatttaccataaaggggaaagggaacgggaatgggcacatgagtgtagtgttcagttaagtagcatcacgggacaacagatgtgaagtagtcctcttaactctctgcatgtatttcctctgtgatttccaaaggaccactaaccaggagaaataagaaactgttgttttctgacccaacaccagcatgcaatgaaagtaggatatttttcattctatagagaaccgtcaatgtgtattttgttatctgatttgaaccctgcacgcggacagcacatttcacgtgttttagcccatttgtggctggcacaggtgtggccagaaagccagcataggatcttgtttgtgtttaagagagaagttcagggagactattcaggcacattgtctggcaagtctagcactggtcaaaccctcataaatattcctgtccaatctgaacttgaaatgttcttgttgtggacacctttggtgagccagtctacttgaggacaatccagtctactagtttagcttcaaaaagcatgcactagaaacaattagaagaacagggttgcttttaaagctatcaggatggtgtttgctgttgttttgttgttaaatatcaatgggttactcaatggtaatagatctaaagagatgaacattgttacatgaatattgcaagaaatttgtggatctcttggggaccctccagacctagttttgagaatgactcatataaacaatttgcagagtctaattcatatactcagactagggttctgaattcttttccccctgggaggaaggaaaaacagaggataacattggttatctggggtaataagaaagcaaggggcagactacagctgccctaagatctgagatctgagtgacagagcctagttcagggaggggctgacatgctgctgaaatgggcttatccagccacactcagagctctagtgagtatcagggtcattgtgttctaaatcatctgtggccagcttaccaaataggctggagtctggcagagaatatctatagaattttccacaaatcagaaattctggtttccagaaggataaacttccccaaatatcctggtggtcttgagttaattgtggcttcctgggagtttctgtcgttggtaagggtcacattttcattgtcccttgacctttagtcttctcagagttgactggtaacattaaaatgagcatgtcttcacttctgtcacttacaaagctcttaaaaaatttataatactttaaacatatcacagtaataaaagcaatcgtatctctttacattgttgcagtcttttggataaagtcccctgaaagcattgtcctggtggttttcaaacttttttctttgatctttcagaatctttgttcaaatgacatcttggctagactccaacatatagcacagataaaaatggagttgggactgcagggagagaaagggtggagcccagctcactggacctctgcctccacccccaaaccaccctctagcctttgagtcaaccactgagtcaccggtgagcaatccctgtggttgcccagagcatcatcccactaagtcctcataatcaccaggcatgattgtgaggtcatcacagtgaattggtgcacccctggaggtaggaaggcagctgaagaggggagagagacaccctccccacccccatatgaggatggtctgtgatgatatgcatgcaggggaagggacttatccaaggtccctgatagatagggactggaattttggcagtgtcttttctagagtagaacaaatttatcagttgaatttgctgtagttctctgaaggtttctttggccacattagaatttttgagccctggcatccaagtaggccaacttcaaaatggctgtgtgctccactcagagattctgctgtgaagactggcaggagattttttagcctattctgaactccaactgttccagttcctcttgctttccagaggtgtgagcacctggaagcccctgctctggtctacaccccaggctcaagattcatcctgctcactcagccactcatgctgtcaccagtgataaaactgtaagtgtcagcagttgcatttgattcttgcacaagaaatagttaccctctaaagacttgttcattcttgtgcctgtaaagtgtggtgtgccctatgcatcagtattcttgcctatgaaatgggcatgtaggctgggcacagtggatcatgcttataatcccagcactttgggaggccgtggctggtggatcacctgaggtgaggagtttgtgactggcctggccaacatggtgaaaccccatctctattaaaaatacaaaaattagccgggtgtggtggcaggcgcctgtagtcccagctactcgggaggctgaagcaggagaatcgcttgagcctgggaggcagaggttgcggtgagccaagccgagatcgtaccactatactccaggctgggtgacagagcgagactctgtctcaaaaaataaaagaagaaatgggcatataaatagatctacataagactcactggaagtttagagctctttaaaaaaatggacaacaaaaagtttttccaaataaatgttgattctgggcctggaaagtttgagtggctggcttctcagagacagttactaccatccatgctctttaaagttccattgctcttattctaaccttgaaatcaaagaaaccaaagctgtggtttcttgtctgaccttggctaatgattttctgattgactctacatgcaaaagaactgctgataagtttcttataggggagaaaagatgatggggagaaaaggaactgagttcatttcctaacctcagtttccctgcttactcacccagtgggttgggagccacttgctgggtctgagtttccataatcaccatagaaatggaagtaatattatccttttgcccagtcgatgggaggatggaggaatgtcttagtctgtttggcctgctgtaacaagataccataaacttggggggctgataagcacatttatttctcacagttctggaggctggaaagttcaaggtcaagacaccagcagatttggtgtctggtgagggcccgctgtctggttcatagatggcactttcttgctgtgtcctcacatggtggaaggggcaaggcagctctctggaggctcttttataagggcatgaatctcattcatgagagctctgtctccatgacgttatcacctcccaaaggcttcatctcttaatataattacattggtgatgaggtttcaacgtatgaattgggggtgggcaggcataaacattcagagcatagcaaggagaattcagggattgcattaagaaagtaagttgctgagcaaagggactcatcttcaaagtccaatacaatctttataatcttacaaaaagctttcctggttttagaattagctccaaggaatttggcactagattttagatttgctcagagaaagagtgtgagagagagagggatgtggcttttgtgaggaattccagcaccttcctttgcaaagatatgccctaaagaacagtggcggcctatcctcaggacagaagcacttaattttgtctaattgtgtcaatttctaggagtcattgggaaattcagcagctaatgaagatggccctgttctgtcaggtccctactggaatatttaaaattctgtttttcatacttatcagctaaaagaattacagaaatatatttctggatcctgtggggaataagagcagaaatatacaaagcttcttctttcaagacggatcccagcagcccaagctaatgtcacagttgtgttaaagactattgattccagcaggttctgggctgggtctcagcttcccaggactgttccaggctgacctcctttccctggttccatctttttttgggacttctgtgggccttcattcagcatgtggcttgcgggtgtccaggtctgcaggcatacacacctctcctgatctgaatcagagaacaaaagataaaggatcgaggacaatggcctcttcacttttgctttctctcttctttgggttttactttgtgtttccaacagccaatggaaggctgttctatttagggtaaatgactcagacttggtacatctcgaatcgtatgtcagagcacactgttgcccctcaaagctcaggaaaggctgcatactctatctccctcttgatggtttcctcgtatttacaagttaaagaccatagatgtcctgtagtaaaggggttagcttgcctctgtttatcccggtgattctagtgaaactaaaatgcttgtttctatggggcacagtccagatgtgttgttcacttggattgaccaatcctttcaataaagttttgatgcaaccatgtgaatcccaagttttcagcacttagttttgtgaccttgagcaagtcacctaatcattacatgcctcagtttcctcatctgtaaaaggggataataaaaagcatctacttcacagggttgcattgaggattaagtgctttaattaaggttttagtacagtttctgaaatataatgtattctatatatggtagctattattatgttagtatccattattatttgctggaatcttttaacactgtgctgagtgttggtactgtcttcttatcatgtcatagagcatggggtagtataagaatcctaccttaggtcaaaggtcacaaagccctattgttttattcccaatagtcttacagggaagatgcagttgtccttgtcttatggaggaaggaggtgaagcacacccgagcggtaaagaggcccctggtcacacagcccatacaggagtcaaaccctggcctctggctgcaagcctgccatccccaagcgtctctctaaagcttcttgtcaaccagcctcagacaggggcccacagacacgaacctcatctcagcgttggtaggaggcaccttccacttggattctcttcatgtggttaagagagtcctgagttccaatcctaagttcactcgtctctacctccttgcctttgtgcaggttacttaacttttctgaccatcagtcttctctgttgtaacatagggatggtaacacccatttcttatgcatgcagtgatgcttaatgacataatgtaggtggggttcatgcacaaggcctggtatatgatgagtgctggtaaatcttagctcccaatgacactgtatcaggctctgtgctagggtgctttacgaaaatgatctcatgtaatcctcacaacacatcaggatattggtactcttcattttacagatggggaaactgaggctctgtgggattaagggactcacccaaggtcataaagccagattgtgacattgagattcaaatcttggcaaccttactttctggaaacactttcccccttcctcttctttagacccacatgcaggctgcttgcagactctgtgcttggccatgtttcttggtcagcagggcagtcgggcaatgggcattttaatcatgtttatgctggacagggctgtcccttgggcttgaggacaatgttcttgaaccagaagaatatggcagaagtataatgccatttcaccaggacagatgcatcaaattccatcttgggtctggtaattctgccacagatggtggcccattgatatgtgcatgcttggctggggtgagagtctgtgccaatgtcacaggacacagcaaccccaatgagtctgtttacttatttaacagtcaaggtgaccagaagagacactttccaacaggacacaatgaggaggtacccagcaagtcttctagctgattgggggaagaaacccagtgtattacaggaaaatgagagagtgcatttgaatttgtttctaatctgaattttccatataaactctagttagcagtttcaaaactgtggacgcacttcagcctaagggacaaaaacaaaacaaatgacccaaggtaccagctgcaagatgctggaataggagggagggagggaaggccagtgagagggcaagattattaatatgcttttcttactaaattggctttcagaatcaaggggaagaaccaaggtgggttgttaagggagtactgatttagatgtgctgagcagttgaaatgtttttgtttctcaaacatgaaagcacttggctttgcatgactgggttttaaattgctcagcaaagcatcacttggggctaacctgagtctgtgaagttccacaattcaggaatgatggttactgcagcactcttgtgtttcaaggttcgtcatgaagactagcatagattccactgttcaattaaagcaacgtttaccatgatattcctattttccatgatgcagggtcctgggaagcatctctttcaggaagggagtatgtattcaaggtcagtcagtatatgaatgtgtctgagacttggatggctcaaggggatagagctaggtgttatctggcagtcgcaaaagtgagagatgatgacaaggccaaggtaggtaggagaatggggatccctcattcatttatcccatcattatttattgagcaccaactgtgtcccaggcattgttcaaggttcaagcacaaagccgtgttcaatgggttcaggtagaaacatgcacagttacatcacaacagagtaaaccatgggaactgcatggtgcagagtagggggtatttgcatggcagttgaagacctgtgtcggacgctgatgcttctataataacccaacttggttcctctccacttttagagccaattaattaggaaaaacactttcttccttccctctctgtcattctatgttggcatttgtcccccttgggttgatgggcagacacaggtatgaaacccataacttcatctctctgggattcagtttctgggcagagtgggcaagggaggccagggtcttctagactcactaagtcagaagcatctcctcctgatctttggtttaatttttcttttgaaggtactcagtccatgatttcagattagggaggcaccacctggcaaagggggagcctgacaatgcagggcagttctaagtaccaggcttgggaccgattctatggagatatggtagatgggactaccctcaactgaataatgtgtgaagagaatttaagaccatgcctgatacatagagggtccagtgaaagttgaaggcaaataaccctggtaaagaaggcaggaaacacaaggaagccattcatttatttattattcattcaatcaacaaatatttcttaaatatttataccaacaaagcatggaacctctagccaaactctctggtttcaaatcctggctgttttacaatatctgtataaccttgagcaagttacttaattattctctgtgcctccatttcttcatttgtaacatgggaataatcaaaaagaataaatgaagattgttatgaagactaacacatgattgttattattatctttttgttcatttatttagctgtgtccttagtctgttgcttgattggtgtggtgttggggatgtggccaacggagacaggaaaggtctccgtctttacccaccttatattacaatagaagagtcagattataaaaaaataataaatcaataaataatactttaaggtagtgatgagtgatgcaggaaacaagagaagatgattgtggagtgagtgattactacgggtgaggtccaatgatagagaggactagtgaagagggaagacagtcagtctacacaaagatcatcctgttgaaaaatatgaaatatgcaagtctttggaatttacccaaaaaaaaaaatagagaaagcatttcttgagtttccaagagaggcaagcaggatgagccaccaaaaataagtacggttaaataaagattgattctgggaccaaataagcttcaagataattatttctcatggtagtgaatcagtatgtctcacaaatgcattcatcttttcatgttttcagtacccaaggtccttgatggatggattaatcctccttttcaccttgcttccttcacctgatccctcacctctcaatgaattgaaattaaggaccgttcatttggaaaaacctattaactccctgcttgtcgatggcttactttctactcagcctggctgggttccacctcttagctcgtgagccctcacgcaactctgctgtctccattagtgtcccttgtgggctggtggccgaggcagttaggcttatgaatattccagttgctcctgtaaatttccagcatccactgttaggcaggacatgaggcactaagggatgtgcatcacttctgggctggggcaggggatgcctgtgtgtggtggtgcagttgctgtcttccctgatggcactgaagagactgtggcttccagggttgcagtgcaagatggcggagcttctgatgcctaggcccatgagtgggcaggtggagcagagcccaggctgcctttgtcttcataggtctctaacttcttgacttctcaatagcctcaatgactggttccttcctgtatttggtaggtgattgaaaacctcttaacacatgaattattcagtcttggctaggccttctcctaaacagttgtctctggttcttaaagttaccttttcctcctctctaaaataacttacttaccttttcctgccacggacactatgacctcttggttttattttcttgattgtatttggcattctctgaaattgtcttatttgtacatttatatgggatttgtgtctcctcgctagaatataactcttatctatttatactccactgtatcctcagtgcctacagcagtatctggttgaaaggggtgcctgataaaaatgtgaatgaaatgaatgccaacagccaggaaggcacctcatccccctcccctctgccaccccctttatcagggctgggctgtgtcagctcattgaggcagtagggagtatggttaggatgatggactgcccgggctcaaacacaacttcccacctgtgtgatcttagataaattcacctctctgtgcctcaatttctttatctatacaatcaggacaatggcaatacctatcacatggattgtttttcagtttaaatgagttaatatacataaagtcctcagaaaattatctgattcatagtaggggccatggaggtattaccattgtcaacagttactggggaagcaaagggcctgtcctctctctggtaaccccccgacccccttcagtctcttgagaacccggcctcaatgctcacctggggtcccctgggatccattcagcaagaaggttcagccacaccaagccctgttccttaagcccaggagacataaatccacaaagcctacaggagagatccctgaggaaagtggctattctggatggggccagaaggttctttctcaaggtcaaagctctcggagacctgatgaggccctgcccctcaagcttctgtcctttccacagccctgcagcattatttccataatgttattaaaaaccaatgtgtgctggccagatgagtgacacttcccagtgatggggctcggctctgctcctccaggcatggagaacttgttcaattatgtgccaccccgtgatgggcccaatcacagtacacacattagcttctgattatacccttgttgagtttctcttgacaggaaggaaatgaatttacctcgtgtcacctctgtagtttgcaagcaggcatggcttctgataatagcacctttcatgttttgtaagaccaaggagaagcattcgtgtggtggccagtccttggtgaccctttgtctcagcctggaggtgagcttgagctgattcttcatgggagtgtttactcctggggcttgtaggaatctggctgggggttgggtggtcagctgtcccataagattgtgggccttggccactgcagcatgcacatccctgaatccacactcttatggtatcgaggccttgggcaaatgactgaatttcccttgaccttcccttccacctgtaaaatggggacaatgatagtagttatctcacagggtaggcgtcagatttaatgagctaatagatgcaaagcccttgcatgtgcctggcatataataaatgctacattgtgtttttatcattaaaattatcttaatattattttgctgttgctgttattattgctgttgttattgcttagattggaacatgtctttgctatttataactgtgtgaccttgaacatatcacttagcccccatgtgccatgacatttgtaaaatggggaaagaggagtctgttccttggtgcagctgcaaggatgtcagtaggttggcacaggaaaggcctttgaagcagcatcagtgcagggcaagtgttgtgggttattattggtgacttgctcccctcaccagaggggtcttttgggtgctgtggagccagaggggtctgtccatggtgggttaggattatgcacttaggtcttgctttccatttgggacagtaagcatctgagagaagagtttgtccctgactataccaaattccaagttctgccaaggaatcctggggtaggccagaaagggaggcaggaatggagccagtggtggacccagcgtttccttccaaagcttttagactcagctgctaaagccagtcatgaagtggacgtgattcctgaggcagggcagcaggcccctctctcactacccccttcaccagccccaaccttcagcaacttttcctggcaggagaccacatcaccatcccctccccttcccatcacaggcatttcagaacacaaggggatctgggggacccacgtctaaggaactgtgactgagagcctgggaagggctttctcttgacctgggagagggaaaattaggcaaattgctgtgtttctccactgtaaacctgaatgggaatgagggaggagggagaaaaagccagacaaaaatggagacacatgcagagagatggagaaacagagaaaggagaaggaaagagctacagagataaggaaatgagaaaacactgagaaataattgggaaatgagacagacaagctcatagaaggacttagacccagaaagggaaagtggaaaattatcttgacagctaacacgtattgagaagacagtatgtgccaggcactgagattagtgtgtgatatatctcatttaatctttgcaacaattctatgagataagtgctgttgtcaacttcattctacagtgaaaacaacggacatacagaacggtgaggtgtctaagatcacacagcttttgtggaggagttaggactagaatccaggtcaatttgagtgcaaagcccatgtgcttaaccccctgcagagaggccatgaccctgggacctaaagcatggcagagcatctctgagtctccctgcactctggacattgagaagcactagtcattctgttttgtagtacagatgtgtttataaagagactccagggaagtcagatgggtaaggattatgcctgtcactcttttttttttttttggcattttttaaattatactttaagttctagggtacatgtgcacaacatgcaggtttgttacatatgtatacatgtgccgtgttggtgtgctgcacccattaactcatcatttacattaggtatatctcctaatgctatccctgccccctccccccgaccccacgacaggccccagtgtgtgatgttccctttcctgtgtccaagtgttctcattgttcaattcccacctatgagtgagaacatgcagtgtttggtttttgtccttgcgatagtttgctgagaatgacggtttccagcttcatccatgtccctacaaaggacatgaactcatcctttttttatggctgcatagtgttccatggtgtatatgtgcacattttcttaatccagtctatcattgatggacgtttgggttggttccaagtccgtgctattgtgattagtgccacaataaacatacatgtgcatgtgtcttaatagcagcataatttataatcctttgggtatatatacagtaatgggatggctgggtcaaatggtatttctagttctagatgcttgaagaattgccacactgtcttccacaatggttgaactagtttacagtcccaccaacagtgtaaaagtgttcctatttctccacatcctctccagcacctgttgtttcctgacttttgaatgatcaccattctaactggtgtgagatggtatctcattgtggttttgatttgcatttctctgatggccagtgatgatgagcattttttcatgtgtctgtgcctgtcactcttgacttctgtgttagttaggattccttgggcttcatgtaacagagagaaaagcagtttttcctacaagtagaagtctagatgtaggggtttctggcactagtgctgctgctacatcatgtcaagatagtgtctgtaggatgtcaggattcccttggcttttcactcatggctgcaagagagatggagagcttcagactttgggtccatttcaaggtagaaagaaaagggggaagggcaatatcaggttaagctgttccctcctgctttttatcagacatcttcccctgcagaatatgtggcgtggccacctatagctgcaagggaggctggaaggtgattattcagctttccatcttcgaggacaggcaaggttggactccaccttgggtgagccaaactgcagtgtcagccaccttccaacaaaccagcctaagcccaaacccaccagtaaccctcccctagtggagggaaacatttagttctcttgggagttgcaggcaggtctttgacttgaggcaccattctgagtcaagctgggtggtggggaggtggggtgaggcaggagtgcctagctctgcttccccatggtgttgctgggggtagatacaaacacagtcacatctgctatgtctggaaaaccaagactggagtctctcagctctccagtgcctgctttccctgtagccaattgcaaggctgacatcccaggaaaggcagcagattagatgagcacaggagcagagaggctgggaaggcggtggaggagggagaaatgtgggtttggcagaattttctaaaatatcactttattgatttggaagagacacaagagaggaaatataagagacaagtgataagaggctcagctgagatgggcatggaagagcctgccttttttttttcctttattgcatacctatggagcttttctaagcattaaaaaaacacttccttaccccctccccatgagattttaataccacagatacactgtatatctgtgtgtgtactctgtatgtatctgtgtttatacataaaggttgttttttcacttttcaatgtctgccttcctggaggagactttgcccccattgagaatacatgcatgagacacatctctagagacgcatctgggcttactgtgggaggagaagagctggtcccactttgtcaaactgtcttgtagacaaagggaattgagaagagtcttacatttcttgagcacctgttaggtatttggcaccaagacaggggctttagatctgacaactcacctgatgcccaatggcagttctgagtggtcagagcaggggcctcatttcacaaatgacatcatcaagatttaggggttcctccctcctttgaagagatccaacctgcccagatgaacaagctagcactattctgatgacagggcatggttgagtgtcagatgggttcaaagctcgtaggatgagcacagaataggctggagtctgtagtggtcctccctggaggagatggggtgtgaactgagctctgcaggacagacagatgcagagatgagaaggggaggcagcacctgctggagaagagcaggagcagaggcttagggtctgtaagggcctctggctgcaggggaggattttcgctgagagctgagagagatggaggcagagccatcccgggcaaagagaaaaagccccaccctggcatgtttattcctcagtctctggttgtgatgtagtaattgagccagggatccaacccagctatacttagcaccatttccagaaggcatgagggcgggagatgggtatataaaaggcaggagtctggggctcctcactcagaggcttctgaaacctgagtggcattttcagtgtatccctgtggaggaaatctccgaaagaaggtagctgagtctgtgaccaaagagaggcttgagtcctgtttccttttcactctcaagagccttcaggctcactcaccccttcccttacagatactttgctggagctcctcctgacatgattgtattagtaaagagaggcgccaataacaaatggcccccaaatctcagtcggattctgcaacaaaggtgtatttcttgcttgtccttcatgttctgtataggttgtactgaaacccctgcttctggagccattttcccccaagattcttcattttaacatgtccttccatttgccatactgcaggaagaaaacatggagaactgcacagctcctaaagtttctgccaaaatgggacatatgccacttctgctgatgtttcattggccagtgtaggacccatggcttagcctaacttcagagggtgcagggtaatgtaatcctgctgcatgcctaggatgtgaagagcaggaaatatttgtcaacagcattaaacatgaccacagtgattataataaatgatttttcaatatccagttgaaatgatttttctgtttcttttctttttttgacacagagtctcactctgtcacccaggctggagtgcagtggtgcaatcttggctcactacaacctccgcctctcgggctcaagcgagtctcctgcctcaacctcccgagtagctgggatttcaggtgtgcagcaccacacccagctaatttttgtattttttagtagagaaggggtttcactatgttgcccatgcaggtctggaactcgacctcaaatgacccgcctgccttagccttggcattgggcctctcaaagtgctgggattacaggcatgagccaccatgcccggcctagtgtttcttcttcctctgtaatgctctgatggtctctgcatcagtacttatattatgcttggtaaatatttgtcttcccatctaaagtcaaaacattagggacaagatcctgttgaatgagggaactacaaatacttattgaggatccactcactgtataccaggcacagtgctaggtacacagagcaaactcccagtcctacaaggtggtggatctaatgacgtgacagatgacttgtctccgagttctggaacatcctgagcatgttctcatcccagcactgactagtccaactacttgttgattctctaagttagaattgggagatgtgggaagcttccagaaagaggtgacctgtgacctagcacaggctctacccacagcgggagcacaatgcattcttgaccttcacaatgcttttgacaatggttcattcaccctccatcacacttgttcctttcagtagggcagatattgttagtcccattttacagatgggaaaacagattctaagaggtccatcagcctggtctgcttagttctttgaggatgagtattcatctctctggctgtgtcagctgagctggacctgccgaattcaatcttcccatcactcagctcccaatgccatcagtcaagtgttatcaaattggtggagcttaaaaatgacagccatttgaaattgagtagaatttggtattattaaaatagcattctaaattttaatcttgtgcatcgactttttaatagcttctactttcactaaaaattgtgggccatgctcacagacattcaatttaaatactgtcaggcaagactgatttctcttccaacattgccagatttttcttttttttttctttctttgcattcatcttcttttttttttttaagcattgagttaatttttcactacttggaaatttcacagtgtatgaaacctcagaaaaagaacatatctttgtgtacagctcttttattctttgtcttctgttctgtagccttctttctagcctatctgttggttagggcaggatcctctgtggaagctaggtaatggttaattttctgggacaccttttctcatcacttcttccttgtcatgatgccaaacaagtctcgtagtcaatatcagcaccctcccctgcatgtgtcctttcaacacttaatctatctagcacttaaaaaaatatctgggagatgctggccatctatgaaggaggtttctcccttgctgctgtgtccattactatttttttcccaacttccccctgcatctgctgtatgcattactattttttcccaacctgtccctgcatcttacctagttttcttcatcctctcattcccatcccagtttctcaccttgaaccaagattggtggagtggaaatggagggcaaggttgatgaagaggagggacaaggggtgatatgaagtgaggagcatgggtcttggagtcagacctgaccgggcttgagtttcttcctttcccagttgctaactgtgtgaccctggaaaagttgcttaacctcctagagccttggttttctcacttgcaaaatgaggttagtggtacctgtcacacagggttatcatatggatccaacgagaaagggtacataaagtgatgctgagtgctgtggttaatggcatcatagccaactggccactctttcctctcctccactctgcaatttctgcaccccagcccagcagttctcaggtctagttacacattagaatcacctaggagcctttaaaaaaggtgcaaacatccctaggcctcactctagaccaattaaatcagaatctgggagtgtatacttgtggcatctttacttttaaaattttctctaggtgagtctgatggatgctagggttgagaacaactctaagtccccagggttgcctaaagtccaaaaacacttttcttttaagatcagaggaatcttattttagtgcttgtgggcagatctctcattagtgatggaatgggatttaaccttccttggctgtgcctaggagaaagagaagaagaggcagtgtggaacagggactctcagtgggtaagcccaaggtttccctttgttttcatcttgggacacctatttacccctgcaactataccgcttgtgcttccataaggatgaggacgggaggaggaggaagatggggaaggaaagagcaggaaaaggagggaaggggagaggcttttctcatgggaccttctccacactcctgtgcctgctgagatgtgtcccctcctctgtactctgaaaatcctttagtctaaccctgagggtccaatatgtggccagtagccacatatggctgttagacacttgaatatggctagcctgaattgagatgtgctgtgtcatacatgttccaaaactaagtaagaaaaataatctcattaataaaactttaaaaatattggatacatgttgaaattataatatattacatatattgggttatgcaaaatagtatcaaaattaactttacttgtttatttttcattttttaatatgagtaatagacaaatttaaattagctatatagctctcattattatatttctgtcagacagaactggttcaacccgttgtttgacactgagtgtatgtttcatgtgtaaatatgtctcaacgcttgcattagatgggcagtttgagaacagagacctcagcatcccattcattttctggcccccaaacacctattttcaaaatgccttgtactcagcaggcagttggtaaatgttttctgtaattgtgaatgataacagtgatggtagtgatgattgtggtaatgaagaagatgatgtaataaagctcaaatggtatgttggggccaaattacaaagatttttgtaagaaaacagtgcaaggtggaatggttacatttttaagaccaagcgccctcaaatacaccttaatttttgattaatttacatatataaagacccttgatacacagaacaaaaacatcttccatcatttctgtttagagatagagtgattcttaaagagtcttacaatgaactcccccacaaaatgctcagtgaactcttgctagggaccagttctaggtggtgggagtagagcggtgagcgaatgagataaaaatccatgccctttggactttacacagcatgtgaaaataaacacatttccaagtaaagtgcttacatgtccgatagtataataagcagcctggtggaaaatcaaacaaggcaaaggaaaggaggtgtggttggggcaggcagggggcatgtgaagaaggtgaacaaatctatgtgggcttacttgatcttattgtttcaataattcagctaatatgtttctttattcatttattcactcaacaattgcatatactgaaatcctattatgtcattcaagccatggtgagacaaggaagtgggtttcacctcccaaggagcgcacagcttactctcagaagcaggaaaacgtgccaattacccatcacactcacatcgtttctaaagtagatcctcaattaggcaacacttcagcagctgcggagtcactccgtagtagtctgaggcaacacaagtgcatctcatctgaaatatcctctaatgcaggatatactggagctgttgcctagggagatactgctcaaggaatatgggttccacaagcaaatgctatgaagttctagttattattttgagcccagaatgagttgaggcctaaaaatgttgccattccattaaaatgtgttagtttgaatttaggcacaaatgttatttttgaattataagcatgcgactcgtttatagtaatgtagctttgagaggactttgggttatttgccaggccattctttttccttttcttttcttttcttctcttttcttttcttctctttcttttcttttcttttcttttctttctttctttctttctctctttctttcttttttcttttttttttttttggtagacatgggtctctctatgttgcacaggctggtctcaaactcctgggttcaatcctcccaaagtactggacttacaggcatgtgccaggccattcttgatataagctgtttctcacccatttggtccaaaaatagaggagacaataggccctctgtccagggcaatccaaggtataggactcacatcctgctctatgccatctataccattgctatttgccttctcgaatgggctggcagaaccgagaccttccttgaccagatgaggccattctggagctccaagcaggaagcagaatgaaaacatgtgtttgttttactaaatagctgttgcatgtgttggatgtaagagtcccccttgcttaaagagaaaataacctaagaacttgctcttcgtgcatttcacctttagaactagaaaagctgtctaattagattaacacacaggtgcatgtatgtgtgtgttagagtatagatactgctaaataagcccagtgtttctctgcatttgtctgaattttggaaaatgggatgaggctgattaagtggctttcatctgagagctgtgtacttctgtggttctgtttttctcctttgaatccctatcctatctcatttggcctccttgctgtgatcccatggatgtgttcaagtgtactgctagttccctaccactgcaaaaccctcctagctctgcctggtgaccccataaatccccagtgttccatgcctggtgctctggggagggaagcagatggcagggctgtccattctgccacccagtgaggcaggaggtcaactagggtaacagcagcaggtggggaggtggggtttctggtctgtgcatgcaggggacaacagatcatcaatgatccatgggcagaacagccctcatggaactaacactgctggcagaaggtggcagcagctggaggctgcttcagctcttgatcaagcacagaataatgttgggtgggtggctgagagttgctgcatttatgaattgtcactcagtggcagcactgaggtccccaagctctgtttacaaatggattttttgctcaaatgtttccttaactcagagcaactctctctcctttttttccctctcatcccctggccaactcctgtgcacgctttaggtctcagctttgggccccaaattcaggaaacatgttcctcctctgtgttcccttacccctgcgtactcagcctatcgtactgtaaatgctatgtaatctgtctcccacaatgggctgtgccctcgtaacaacaggggttgtgtcttgttcctcattgcattttcatggcctcaaaatgtatatctagtgctgtcaatatttgtagacttgagtggatctcatctatgtgcatggtctaatttcattaattatagacaaaaaggaagtagcagcttgggtaaccaaacaagcagataatccccaatgtatttctttaaggctttgcagtgctccccagggcaatttgggacaggggacaggttacctattttatatatatatacatatattagagatgaggtctggctctgttgcccaggctggagtatagaggtgcaatcatagctccctgcagcctcgacctcccggactcaagggatcttcacatctcagcatcccaagcagctggaaccacaggcatgcaccaccatacccagctgattttttttttttttttaaaggttttgtagagacaggcccatgctggtcttgaactcctgggctcaagtgatcttcctgccttggccttccaaagttctgggattacaggtgtgagccactgtgcctggcccattgtcatatttattaagtaaatatgaggacttaagtggtatttgaatattgatatttataaaataccctccactgccttcctcttcagcatcatttcatccttactggctctacctactcaaaacaggaatggttgtttatggaagtggatatgtttaatggaaattcatatgtttcactgacccatggttgccatcatgccatatatcataaagcacttttgtataaattaaatataaggataagcaagttattgctcagattagatactgtattcctcatgctcagacctgctgccagtgtcagaggcctgagagtatgccagctggggtgggtcaggccagcgtgggatttaaaagttctctagataagccacatgtgatgattgagctctctctctgctgttcaggcatgtggctggcaggtacatggggggcagggagaaagacactggacttagactggagccagtgtgttttatggcctccttagtttagattccgtgtggctctgtacgttggagagggaatggggctcccctaaccatagtaataataacaataggaccctcctatttaatcccatctctgtgccaaacacttggctcagtgctctcccacattattgcatgccccagcatcctgaatggaaaatactattttcattttacatgtgaggaaactgagtcctcacaggttaagtgactttattgaggtcatataggtaataagtgttaagattcaagttctcccttgaacttgagttctccctggctgcttttcccactaaactttgctgcctgaagagccatcctgggctgttctgattttgccattcactgatagctgtgtgaattttagcaagtcatgtcaatctctaggcctcagctacctttctgtataatcgggagatcactaaccgcctgctttggagggatgttaagaagattgaaggaaccaaggtgcatagcagtatttacgaaattattgtgagttccagataaggaggggtcattgccattgtttgtatttcatcctgactcctggaggctttaggttgtgggctgggaacactgaactaatattgaacattcttccaaggagcaaggcaatggagatactaaccttggtgatctgcacagcttgtgtgagccccgtgggctcctctaaaattgacagaatgatgaggaagtgagtaggagtggccccaagcatggctgggtaagggagtggagagtggctctgttgtgatgtggactgagggtgtataagctctctgcagctttttgggaattgtggccattatgtttttactatctcccattgtaagaaatttctgaattctttttatggtgaactcagtgggtgggtgggtgagtgaacaaactttcttcagatcttacgtgatatgtccacagttttctcaggcagaggatagaaggggttagatattagaaacagtacaaagaaagggcacctgtgcaaaccaatatgtggttacgtctaatttggaacaacaacaataataataacaataaaactaattataatattaacatttatccttactggggttgtacaatgtggcaagcactttttaagctattcgggtgcattatctcatttaatttttataataaccttatgaactaagtattatttttgttatcatttttatagatgaataaactgagggacaaagaggtgaagcaatttgcccaaggtcttatcctgattagtgatggatttaggactggaatcagaggttaggattgaaatctcagagccttgctcctactaaatattttctgtcatgtctttgcaataaatgagggaatagaagaattaaattattttcaggataggacattcgtgttgttcaatttcttattatccagaccaacagaggggaggtgttttagttcatttgagctgctgtaacaaaaatacctagactgtgtggttgacacaaaaacactttttacagttctgaaaactgggcaatccaagatcaaggtgctaactgatgccatgcctggtgatggcctgctttctggttcatagatggcagtcctctgactgtgtcctcacctggcagaagaaacaagagggccctctggaatctcttttttaaagacagtagtctcattcatgagagatccttctcatgacctagttagcttccaaaggctttgcctcctaatatcacattggatgacaggatttcaatatatggattttgaggggacaaaacattcagaccatagcagtagccaaagaccacacaagtgatttgtgttatttctggtatgcattatgaagggttttttgatgattttagagtcagggtataagaggtggggaagcccaatgactaaaaatatagatatatattgaccgggcgcagtggctcacacctgtaattccagcactttgggaggccgaggcagggggatcacaaggtcaggagatcgagaccatcctggttaacatggtgaaaccctgtccatactaaaaatacaaaaaattagccgggcatggtggcaggcgcctgtagtcccagctactcgggaggctgaggcaggagaatggcatgaactgaggaggtgaagcttgcagtgagccgagatcatgccactgcactccagcctgggtgacagtgcaagactccatcttaaaaaaacaaaataaaacaaaaacaaaaacaaaaaatatagatatatatttattctcaataattttgtttatttgaacttgatgtcgaagagtctttctgttttctccttggaaatgtctcagaagtcatgacctcccatatatgttttcttctgttatcttttgttgataccatttgcatcagaagaggtcttcaactatttgcaaaagggaaaaagaaaagtcatgaccacccgtcagtctttgtccacttgtctctttcaggaccacggacaggggccaaggtgtctgagtagacaaacattttagttaagctacgcctgtgttcttggctcaggttatcttctttgaggccttttttctgacttttataggatgtcacactagcactgcctgagcacacacctgctgacatcagagtggatgatgctttaaacattttccaaggataatctgcggatgggtaactggtcctgtggcctcgttgggacttgacagtactggccctctgacttgcagtttgacctgcctgcctgagattttagtgtggttggtgccaagatttaaaggaagtgataagcacttacttgttcttcagcatcattaaatgataatgataacatgggtgatgacaattacatatttattgagtgcttactgtgcgccaagtactgttttgcatgtattgttttgtttaattcccaacaacaaatcttggggatatgaatagttttagatgaagaaaatgagacacagacagatatttaaaatgtgcaagacaacccagttatgtcataaacagtggagcagagtcccactttaccttgaggtcacgttgtgtgcactcccacaaggtcctcagggtggaaagggaggggctgacctcttcagagtgcctatttgtgtgctttgtgaatattattatactcaaagcctatttcctggggttgtgttgacataaaaatccccactttatagtagaggaaactgagagagcatttaagtggcttacctaagatcgcacagactatacatagagaagccaggtttgtctgtcttgaaactttttttttttgcagtgggctatttactatttatttcccagatggctctttacaccattgtgggcagtcctaccttacagtggggtctggtttctcaccttataggaggatgtggttgatacttgataagatttgatactggtcaggcgaggtggctcacacctgtaatcctagcactttgagaggctgaggcaggcagatcacctgaggtcaagagttcgagaccagcctggctaatatggtgaaaccccatctctactaaaaatataaaacattagcaggatgtgatggtgggcacctgtaatctcagctacctaggaggctgaggtaggagaatcgcttgaacccaggaggcagaggttgcagtgagctgagattgcaccactgcattccagcctgggtgtgacagagcgagactccatctcaaacaacaacaacaacaataacaacaaaaacagcagcaaagatatggtgctcagtctcctcttctgcttgggattcaagcttgtctagacaagaaggtggtgaagctcttgatgacagggatggcgggtgaacttgtcttaggtgtgcaagtgtggacccagaagcaaaaatgggtatgctgtgcagaagggttaataatcacccccagtctggatcattttgctgtaacatctgctgctaacccactgctaggagggggaatgccaattgtagtgctgctggagtagattttaaaacagaaaacatttgtgtgttgaagtgaggactggcgttctgttggttggatgacataagtcccaatttcttccatttccccatggtgtgcttgcattttggggcccaggtatactggggagggatgacccatatggatggagtgtaggctcactttggtgtggactagtctcactaataaccacgtaattatcattgctagaaaggactacagatcattctggaaaactctggaaaactcatttatttatagctaaggaagctgaggcccaaagtggaaaaacaggactgaaagtctgcatttgactttgaatccaatgctctttccctggtaacgtgattaataccaataacatgaaaatattatcaatagcattaatatggtcagtaaagcttccaccagaaataagcattgggccatatgttttgaagtttgtcaagaccactataagcagtggccctttccctcaaagaaggaattgacattctgggtcttgcaatataaaacagagatatcatcatcattatcactgtcaccaccaccaccaccaccaccacgctcgtcctcaccatcagacaaatctattttcagcacttactgtgtgccagattctgtgctatgtgctttatttatattgcatcataatttaaaatttatggcaaatctattgtgaaccatccttgtagatgaggttcagaggtgtaaagtaactattacaaagcctaccgttatgaagttccacgtgggggatgcagttagagaagacaaaacagtgtagaggcttcatggtggtgagacttgtgggggaacctgagctaagctccagagagtgattaggacagagaaaacagatgagatgaggaagacagtcctgtcaggagcaatctgaaggatttttgcagtgagggaagttgtgggttagactcagggacaatttgtagagaggtctgagtaaggaatgaatggcttccaatcactactgagcacatttcctgttccataccccatgtaaggcacagggtgtgcagaggtaagaggcatggttcctgtccttagaaatgggggggaagaaaccaaaacagtcaacccccatcctggataataagggttgggcaaagggtaaactcaaaggaccatgtgagttcagaggaatggggtcaaactcattcctcagtggcttgctaagggtttggctttacattaaaagccagagggagctacagaagtattctgagttaaggagtgacctggccagatcatctaactggggagactctgcagatactgtggagaatggtatggcgacaaggagacctgttggggcagcagaggcaagcacagcaaagccccccagcaacaacagtgtcaatgtcaatgcagagataaggcagaaagaagcgatcatgagaagttagaatggatagggacttggtggagggaggaatggggatgggcccagtgggcatccatgggaaatgcatttggagcctgttggtaactggccttgaaggtcatcctccctccttgcctacctgttcttggcttgtgagtaagtacacggagaacatgtgttagtgccatcccctggcttagtcagctacccaagctgtagcccaaagcccagagctccccaaagtcagagcttgaggctgtcccaggatatcactccatgcaaaggctgattccactttgcggttggactggttgtgtttgcatttactgtgccagccacacctgctctcctcgacgcccagtgctgagcctaggtggctggtgaagggcagacttccaggagcctggactcactgtggcagggaaggaggggagaggcacagctggtgccaagaggatattaacctgacatttagcaaaagggtgaatctgtttattgttctgtaacaatgaggcatttgcatcctgagtcgccttctgttttcctattgtctttgctcctcagtggtcaggccaggctgcagtcttgacagtttaaatcagcatggtaatgaaggggtggcacctagtcagttcaaaataaaaaatcaatctcactctctttctctgacacacacacacacacacacacacacacacacacacacacagagagagagagagagagagagagagagagagtctagagctatactgagtgtccagaagttcctctctccagctccttccttgatactcttaaaattgtagtatcccaacccagataacttggaggtttggaaaggggacccctgtattccttctgttgcctccaccatagcctggctttccagctaccaacagaacccacttgtaggcaagaagaagcatgaattgaagtcctgatgcatgcatctaggaatgctgagaacgtgacagaaaagctcttacacaagctgggcatggtggcacccagctactctggaggctaaggttggagaattatgggagtttgagtccagtctgggcagcatagtgataccctgtctctatacagaagaaaaaaatcagacattcaggttgaaaatttaaaaaaatattctctatagcttcataaatattttagcattgacagggcttgtgtgcttttatcatctcacagtggtatagtaagctgggtgggagaggtgtcatgctaggtgaagaagctaagacctaggctcttggatgtttataatgtaccaggcttggtactgggtactttaatggcatgacatcatgtaattctcactaggatacaatgggacaggtctggttttcccattttacaggacactggaaaagtttaagaatgttttcagctgggaattggcagagctgggaaggaagccatatctacctgaccctggagtggccactccactactgtgggttgcatggacaggtctggagagtgggcacagtgttcagttggtgccatgctgtctgctctccatctactccagtagcccacagtggcttgcaatgaagccagatgttctggagaaggaggaaacactcttttgcttctgtgcccatccttaccaccagaatccccacagaagatataacttcttaccctcttctttttcccaaattagatctggtaagtcagcatctgcataccgacctcaggatcatttagaagctcacagaatgttctgtctagaaattgcctccaggcaggatttacctatgacagccttggccagtggatggttctatatctttatgcccagttcaaactctggaacactgtcatccctgaatccctccccatctcccaggtccctccctctatggcaggaaaaagatccaacaggcctgacatggaacttgactgctagggtttatagtgatacaggaggcaggagagagaagtagaaaatgcatataaatacatctcatatacaatgtaacttatcttcagttactaaattagcactctttgctctccctaactatatgcacattgatatcactcctcttgcagctcaataggtatgtggtgaacctcttgccataaaattatgctcctgcaaagtgatgggcctgagcacagttgggatggggacagaggaaatctcacaggtccaaagctaagtcctgctccttcagactctcaactgggttcccaagctggcatggatagaaagggcacagtttaccattggtaaaggctttactctttagaatttgccccccacttcaaactcactcttccatgcctgtaaatattcttccatggacttccacttgtcactaaaggaaagattcaactcttgagtcttggtgtacaaatgaggggacctattgcttctttaatgtaccagtctgtcctcaacatggagaccagtttcatctcctttgccttccatcagatgtggatgggagccctgtattctgctgagctaatagaatgcctgtgtccctactggaaggtgacagggaagtatgcatccagcaatctatgggaatatcaaggccacattcccttttttaaaatgaggatggcagtgtgttagaatagaaagagttgacatgaggaacagctgtgaggttatgaattctgatcttggtttggtcccagtcaattacgtggtcttagttcccatttaaatgctgaataagtcaatcctcaggggtaaattctttcaaaatgctcataaattgtgaaatcctagtgttggtggggaccttggatattcctttagtgcaatgactgcaaaatatgactgtgcattggattgcccagggatgcttgctaatatgtcaatagccaggctctagcatagagtatttaggctccagcatgggtattttttttttaacagtcggtcctccttccagtgtttgggaacaatgatctggtttatctgccagctcccaggtagaggaaaatttgcaatgaaatcttcccagcatggctactcttagccagtccttactcccttcccctcattgacaactttcattctgtttctaaggagtagggctcttaccaaaatgtcaatgtgacccacctccagtccactcttttcttcgcagagcgtaagaactagttctgtctggcactcctggaatagtcataggacagagaaaagagaggaaacttttgagttctgataaacacatctgcagcacacatcttgtgagttgctcagtgttctgtatcctcttgtcttttctggtgaggatttgatgatgaagttggagcatggtcttcaagggctgaaatccaagagtttctaagtagagtaacaacatcatgaagtctcttaacatcactatgagataacccgtgtaaagagagatttaataaccatcaaatacttgtggactctcccatgcttccaaggccccttgttgttgagtggattgtgcacagaaataatatatgtccctcctagtccgagtcagtaaaatgcctctacctgcttctccatgctctcccttggcctttcatggtgattgcagaggccatgcattgagattgtagaccacaagatacaatcagcttgaatccctgagtcatctctttaaaggaagctgtgttggagagtcaccagacccaaagtgacttttcctgagtgagaagtaaatgtttaagtgttatgcctttggaattttaggttttagttgttactgcagcataaccttgtctatcctgattaatgcagttggtatcatcctgaagcgtactcccttgtggataaagcttctagttcttggcgtgtttgggttgcttttcctcctaaaaactgaatggaactagaactttctaggaaccctttcaagctgcagtaatgatttactgaagcagaaagaacatggttattttgagtctcagaagaaaaacacaaaacaaaacaaatctaggactgttgtctttccccaagaaaggaattaaaaatagactcatatggacaggggaaaaaaaaaccgacactgcctgatctggtgtggacatgttcttcgaaagtattaattgcacactcatgccatttaaaaatattaatttaaatgcacacagcttgtaaatctcttcttgttctgtctgctggatgacttgggacaaagcaagctgagaattaattgattaataacaagctgtgacctgtgtgtgtggttttactgacaatatcctcaggacttgggcttcttggagccatgcttctgtcagtgggaaaagtgctttcatctttagagaatgttaccactaagcagagttacctaatctgatgctttctcctctgggtatggcagaagtcgcttacttgagaatggatactgatatgttatttttggagctgtatttaggggatttatttggcacatgtggtatatattatagaatggcatgtagggtgaagccacggactccacaaagagccttctgtccattatgatctgttgcatactgaaaatttccactctgagtaatgcatatctttacactaaacatacatcattcccagaagttgtttgattaaatataaacatcttgcctagggaaggcaaaatattaagctgctagagtacatttggaattttcttagaaaggccctgaaagaataggatacaagtcagacatattttgatgggggatgtgaatgagggagatgaaccactgaggacagagtcttgaatgagcagaacattgtagtggaggagccgtcagctcaacagcacagattcctggaggtggacaatgacgtaggttccagggataaaagatttggatttgttcaggacaggccgtgagtgcctgccttggtgtgttataaagatcctatgtggttggtttctttaacattcaacacaggattctcgaatattttagaaatgtgcttgggtttttttctgtaactcctaggctagagttacatcatatcatatttagttcaatgtgtctgctgttctcaagtgtggtggtgctggcaggtaacaacgaggaagaagtgaggcagggctcaaattggggaatacatacctgtgtgcatcctggcccagggagtgggctgaaaggagggcaggagtggactggcctgctcaggctcccacacctgtgtggcaagaagggtttgacccagagaagcagagcaccgagagccacagaagctccctcttccttctttgagtgtgcctagggtctcagcctcagctttggcacccagagccacattccaattaggttcttaggggagtagccccttccttccttgcagagaaacctgcatgaaagtttgggggacttcactttcttcttgaagacatcttatgtccaaattaatgctactatttcctgtgtctccactgttttgacacttacctttttcatgcacttcccagagcatatttcttttgtgccagacactctttccccagaattctttccccagaattcttctccaccattttgtttagaaaaaatatgttgatgagtctcatggagtaaggggtaagacctcaaggaaaatgctccaccatcaaaagatgccataactttccatccacagagtgtagattgtgttacctggagaatcttttgtttggtgagtgcccaccttggtttagtgtgaaagtctgactgtaggtcagagcaaagcagaattgttctgcttcgaagagggcagtatcagtcaagtgaggccatgctctgctacagtaacagacagcccccacagtggcataacacaagaaaggtttatttcttgctcaatacagtatatatcagtcatgaaggtaggaggccagtaggagggtggaggctgttcatcagagtcactcagcaaaccagattgatggaaacttcctcttggtctttgcttccagcaccgtcttggcaggaggcagtggtgaactgctctggctaagagcttccatccagaagtgtcacgcatcatgtggctcatgttacattggctagagcaaaccactcagcactcagccacacttaactttaggaaactagaaagtgcaatcctacaattgcccagaaagaggacgtaataggagtatttgtgaatatccttaatgacatctacaaggggtgaagactgctctagtgaaaaggtgaggcttttggagggcgagtgaaggacttgggcttcttggagccacctttctacctcaaggaactctgtgggaaaaggtcagggaaggaaatccttggttgtgctttggcctggaaggaactaaggcaaactcaaaatctgttagagcatttgccatgagatatgtgatttaaattccttttctgccttacctgtgaaatcttcaacagtctgtgttgttcctttttgcttgtatctggagcaatggcatggggtggtgatggggtgggatgagggacaagagggagaagctcaaaaaagtgtaaccttcaggatgaaagttattcagggcaaaacaagatgctgtatacatgggcctaggcactggagaagccagagacagctgacacctgagttaatgtacctgttatttttcctcctagcttataaattcctcaaggtcaaggatggtttcttatttatatgtatgttctccgcagagcccaaaactactctggcctcagtaggtgctcaattgcttgaggcatgtttgtgggtgaatgaataaacaaatgcacttctgcctccttctcttgtgtgccaaggcttgcagcgggccagcagccaggggaggatgtggggtgggccagcactctctttgctcagaaaagcaacttgcctagttctgcatccaatcttgacttctaagccaaggaacgaagtctccaactgctctcagagtaggatacaaaaaccttcctcaactcttctcacctgtgcttagggacatttggcccttggtgaataggtccaccaagataccaagaggtggacagcagcataggagactaatttcaactgtcctttcacaaatcttctaggacgtgagtagggactgaccatcaattcatttatttatcaaacattgaaagggtgcctaccaggtgcttggttctatgtcaagagctggggctgcacccttctgtaagcttgcctatgagtgcaagctgctttcatactagaaggtaggatgataggtgaaccgccttctacaagtggagacccatggggccctctggttgtgcctccacagtagagtccatggtggtgtgagccgtaacaagcacagtccatggcggcatgagcttcagaatccaacacacatggattccatcactggctatgcatcttgagtctgatcttgagcctcacgtttaacctctctaagcctctattttcaactctgtaaattggcgatcacagtgcttaattgataacttgttgtgcaaatgaaaagtgaaaatgcaggtaaaatcctaagctcagtcacatagaaagcacttagtgtcagtcaatattgcaatatgatgatgccaatattgttaatgataacctttctaagttggagtgacctcacctaaaaatagtacctccatcactgagcctatggtaattacacgagatagtatgagacacttagcactttctgggtacaaaacaatagtgagtaacatttacccaagactttattttgtaaatgcctctcttccatcactactgcctcacttggggcacctgggagtatccaggttgaagatgcgggctcaacccaggagtcaagcaaacaatttctagtttttgggatgccttaaacaaaaccgtgaatctctaagctcctcaggctggaaatggctcactgctggtggaatcattaagagtgccagccagatctgattgctgcattcagaggtttattaatatcacctcgaatttatcttccctgatgaggaaattttgccagcatctgacaaaaatgaaatgtacagcggccttgtgccaacaagcatcctctccctgccatcggctgttagcagaaagccagtgcagtgggctgctatggggctaataaaaatataagatgaaaatgggcttcgcatcttcaattaggaatttgggcttccaaccctcctcctgaggctcccttccccacaaccaggctatgataataaatttcagaacctcatctccctctgcgagtgtggattctctccccaactaatcctccaatactcatctgagcataacactcccgatgaaaccacacttgtcccttctaaacacttcaatgaattcccttatcttccagtctggaatgtaaccacaaaagaatatcaatgagaggcatgagtggagctggctacaaatgaaacgtgaacaaaatcttggtggagtgcaatagggtttcagcaagaaggatcccaggttgcacttcccaggtggaagtgggttccttagactacattcggtgagtcaggtggtcacctgtggccaagtggaaagacccttcaaggccaaggaaccagacaatgtcttcaaggcagtcttgagttatcctgctggggcctggcagttggcagtctaagtggtagggggtgattgggaaggcactacaggtacgtgacgctgtgtgatagagtcaggagcaaggagctttggaagcttctagcgccaaggcaccttcagtccattatagaatgtccagtgtccccattttatgaatgagggcatgacccagaaagaagtcacttgtccagggtcacacagcaagtcagggtcgcagggctagagctagaatgcatatctggcttctctgaccagcagtctttcccccagaccatatccctactttcctttatgtggttaactttaattaagctctttctacctaccaagcacacccctaagcagtgggtgtcctcctttgaccttcataacaatctcgtgagaaagatcctcttggtgctttggtttgacacttgcatcttggggatgggaaagtttaaatgacttgcctaaaattattggctgaggtggtgggttcagggttccagcatagatagccagctctagagccttgcttgtaataagcaggctaaaccaatgcttctcaaagtggggtgcctggaggagcagcgttacctggatcttagaggtgcagattcctgaatcagaaactctgagggtgaagccaaccctctgtgcttgaacaatccctccaggagagtcccgtgcaggctcaagctcaagtttgagttggtctaaactacttaagctggtaaatcttctgtattttacaacgagtcttccttttcatgctttgtaaaccaaattgctgacttcccaaacctgaggacatttccaaggtcatcgttacctctcagcagcccattttcaggtggcctcttttaactgtgggattctttaggaagactgagattggcacaggttccctgctgcccagcagggctcctgagcttgaagacagcaaaattggtgttgttgaaccttctgttggccagaggggattttgagagtcctgtctgctatcacgtggacttggaaaatttggtccagtcaagtggaaaattaataaaccagaaaggaaagggacacagtattcaagacactaaatgctcattgcaaccagggagcctccaggtttctaagcattgctcttctgaatcccacactggagatattttcctcttaattcaatagatgtttatcttgcgcccaccaatgctgagtactttgcttagcactgggaatataaagatgaagggatgtggtccctgcccacagagaacccacagtctagaatgattatgtggtgatgggatcctccactggggaaaatgcagtggcttttacttgatgcagtttatgatgtttggttaatagaatgtcacataaaaacaaatcccctgattatcccactgccaatgggtggcactgcattctaataaaggcagcacttctttggtggtgtgggggaaaagaattgcagcccagtgcaggagagcctgatgaagactttattatttaatgaaccatgtcatatgaacagctgtggtgtaaaccagccaggacaattatgcaagttggattatgtctccagtaaattgatgctactttatttgattaggttggttctccaaagacaaattcttccaagttgggttgggggaaaaaaatcaccattctaactttgcttctgactttcaatcttcagattgcttttgctttctaatcctaagaggaaacaaacacaagatggcagctatgttgttatcatcaacagaaccgagaataatcacgtatctgtaatagttatcagcatgctctgtacgagactcacactgtcttttctcaatgagcttgcctggggggcaataagagacaggcaggaaactgtgaccattcctttgtgagtccccaaaacagcctggctgcagctcactaagccattgtcttcctttacacacaaccaaacgtaggcacatggctaaataaacataatgaaaagaaatgggcttggtgtgaaattcttcccagatgcccttccctgccttttcagattattaggtactatctagttcagtgtcactgtgggtcatggtccatcagtagcttgtgaaatctatttaatgggtcatcaccaacatcataagaaatgaagcagaatagaataaaacatcatagtacatcccattatatatagtaaaggtaaacattgcttcgtgtgtgtgtgtgtgtgtgtgtgtgtgtgtgtgtgtgtgtgtgttgggggtgtggtggtgtcttctgaaccatgttgtaaagtacatttcttcctgagggttgtggtcaaaaacatttgaaaaatactattagttcaagctgtttattcacagacgagagggcagggatgatgaaattaccctgctaggtggatgcaggcttttgaacagataatgtgagagcttttaggaagagagttggtgagcaccaggagctaacatgggttcacctcagccatcacccagacaagcttcagaccagactcaaatgtgatggtcttcatgccacacaccaggggtcatgaatgggctggaacttacataaacacaatcaagatggataacgagcaggtacaaagcaacatcttaggagcaattgttaggataactagaactattcctgctcttctccaagccattcagcaggggcgcaattgacattctaaaatctttgaatgtttgtcatgtggaaaatggaatcgatctcatctctatggccccagcacttagatgggtgttttgatctaggaaacattttctttttctttctataacatctctgatttgccctaattcctgcagccagacagtctgtaagtgaaacaggctgcttctggatgaaattcatttcctgtaacaagaggggatcaaaaaggaaaattatttgtccctgatgtggcctctgagggcagtgaaaatcactggatgaatggttagattcatcagtggcttttggccttaagacactgtacacccaatagacacacactcatgccctgcaagtacaagcctaattttcctgtactcacctttactacatgtgatgtactttgatagtttctattctggaatattctattatttcctgctagttccatctcattccatcccactccactccacttcatttcattccattctcatttcatttataaaatgacggtcaggactcatgaaactgatctcatggtccactaataggttgcaacctgtgattttaaaaataccagattgggttatattcaaattccctttaacccccaaatcctgtgagtccaatgtaaattgctactacagtattagggtacaaaattctgtgcacagcaggctcacagataaagtttttgacaaactgaaaaccatgtgttattaattcacttactcattgattcacttcctcatccatcccgttcattacttaccatgtgccaggtactgtgctaggccacattgatataaggtaaataagacacagcccctgttctcaaagagctcttggttacagggacactgattaggtttcctggggttgccaggatcctagcatctgctttccctgagtttccttggaaggaaggtcccatgcatgacacatcctgttcgctgttcttgggtgacgtatgtagccctaaagtcttggcccagtagcagagaatttcacatccttcagtaaataaaaaccaaagtcaaaatgaacatatgctagaaaacagagactggcagtgctgtgaaggccctgtcccctcatggactctgtcgtgagtggcttaaggggaagagaagtgctcctcttaccggcatcaggagccctaattactgttgtatattgattcctttcttccgcagaccgctaatcctgcagagcaacttgcagggcataataattgggattgcccaatgctgggagctaatcagatttcttatgtgtagaccagctttatgctagcgtttaaggaagctcctgattcaagcacagaaatgaactgtttaaccatttccgagccagagatgagccatcacagaccaacgcggagtctgataggttaggggtgaattgcgctggagaggctgaacgtttcttaaagtccactggcaacaggaagtcctcagaagtccaatttgttgttgttcctccctgaacttctggatttctgaggatggttgtgagagtggccgtgtgtcaatttttaaatcatgtggtaatttgtccatgattgtttattttgtcccccagcaagattgtatactccagaaaaggggtagctgacctactaggtgaaatcatgctgtagttctgagttgctgcttcttcatgcatacaatggaaacaagtacacccccaccaggctcatgtggagggctcagtgactaacctggccctcagctatcccctgctactcccataaaagctagcactgggcatgtggcttgtacttccaacaatgagtactcccttttctcccctaaatccagccctggaagcattgccgtgtttttatgcctcttggcattctttattttttgagacagaatctcgctctgttgcccaaactggagtgcagtgtcacgatttcagctcactacaatctccgtctcccaagttcaagcagtcctcctctctcagcctcccaagtagctgggattacaaatgtgcatcaccattcccagttattttttgtatctttagtagagatggggtttcaccatgttggccaggctggtctcgaactcctgacctcaggtgatccgcctgccttggcctcccaaagtgctgggattacgggcatgagccaccgcggccggccatctcctggaattctttgtccacttttctgtccttcctctcttcccttctctcatgctacactcctctttccacttttggtcaatcagccaaaattacaagtacttttccaaaccttggggtattggagtccatggctcctggctgctgtgcatggtttccccttttcctgggaagcttctgtcccactccctgcccctcacctcaccctagcactcttcataccaaacaaaatgacctttctgggtgttctccctggagttccttcgcttgcgcagtcatagcaggctagcgcctagtgggctgtgtgcatctgaattgcaggttgaatccaacaacatcagtgaggtgggaggcaagtggctgggtgcggtgccatgacattctggctcacctgtcatgttggatggcttgtgtgagccccaggaaacccgtgcacccttaggaaagcatgggatagatctcctgagatgatttcagagaaatgacagcagaccattgtgagggaggcagcatgactgggggaatggataaggcttaggtccctgagaggcagatccactccagccttgcggaatgtcatgctcctgcagagggctgcaagaagaggtgaacccattcccaatcactggccaggttagacaaatcattggattctgggacatcagagctgaaatagctttattggatcatctctggcccagctcgcttgctctctctctcaatctcttgatcttttttatttatttatttttttaaatgataaaaacaaagttcagagctggggcataacttgtccaaggtcactgagagctgtaaccatcaacatgtggggcagcagctgcctgggtttcaaagaaaggggacttgctgccattcctcctccccctagttgccactgtcttctcatgggtttccttgtccttccctggtgccgagaagcagggaggagggagcatctgttgccatggaaacaagcctatagtatgagttcgctctccccaactggctgtggtttctctgacaggggctgctactggtcctgctgttgggccctaatggggactcagggaccaccactgtatttgccaggggagaaagctggaggagcagcagacatcccctaacatgagttgtgcaggcttggtaatgtggagtgggcatgcattgtggtgattcttcttgcttttttaaaccaatttctcctctgctggagactcttcacagaatttaagagtctttctcagaaggtgatcagccttggacagactttggtcttcagaccccagagccaaacttttgaactgacagcagctgtggccaaaaatggtgtttgtcagacctgcaggaagaaaatctgcaatgaagagttggagtggtaggaaaagaggaaaaagagggaacttgttttgccttcagacatatttaagtctcctaagtacttcaggagttaaaatggggctttgaaaataaatagacttttctgttcatgtggggctgaagtgttccagggttggaaagggttttattaggtcatttcatctctccctctgtctctgggcctattctaacccctcttacttataaaaatcgcagaagagggtgatttcataagctgccacgacaacttgttccgctaacaattcatgatcttaaaacaatctccatagcagggagaaattcctcctatttcctccaaagctcgtctgtctgcgggccaaggctgctcagaggcagctggggttttaagaagtgagctctggacttggatttaatggtctttgttcaaatactgttattgcatccttgaacaagtcacataactgctccaagcctcagttccttaatctgaagaggttagtgtgaaggggagaaaaagtaacatatgttaatgtgcctaagatggtatctggcacacaggaatgcttgttagatgtgtggtgtggctttgggctgactaggatcaccatggtatgggcaccttttggatcgagatctcagaaattaaccctttggttgttggatcatggggttgggatgggggataggcactgcagcagcaggggcagctgagggggcactcctaagtcaaggccattggctgtttaccagccggtacaaaaggtttcaatatttgagagactggtttagttgtactagtgcacgctgtctaaattatcatccctagtggttccttcaaagacgctaagcacattcctgactccacttctttgtttatgccactcatgtccccccatgccttcaatgcctttacaaatcctcccaacccatgaaaatccaactcaaattctgcctcatacatgatgcaattcagcaccaaacccataaatctcatgccccacaagctttatccaggctggaagagagaagaggagaggttgtttctgtgtggctgattgagctgttggctgactcaagcaatcacagagcctcaggtatcattcaacctgcaaattatagatgaggaactgagaccagagaggctgtgggactcatcccaggccatcttagtcatcaacaacaggtctagagccttggtctcctgactctctgcctatacttcttgtccatgactgaggctgttccttgagcctggaatgagaacagagtcgtcccccaccctaccagcactcctcctacccagcacttgcttgctgagtcacacggagggaggtgggtagggggaaaatatatatttgcctggagaacacaccagtctggaaaagtgaagccagccaggttcagtgtgggtggagtctcccaccagggatcccaccctagcactaaccagggttgaggtgctggggaaaatgaaaagcattggtgtctttctgacccacctaggtgagtgaccaactttaagccatgtgtcacaacgtggcggttttactgtttattagaaccttgcttggcttagcttttgtagaacttggcttttaaatagaaattccttatactaacttgttctgctgtcagggagatgctggccagcctcgaagcacctggtatatagagacatctggagagcgtacttcaggctgggaggctttgaagtagatggttgtgggctcgtgtgtacatgtatgtctatgatcccctttgctggctgcaaattctgtcatcacatcatggaaaaattcttcttaaggaaagttgcaggtgcaaagatgctgatgttggatcaaccgaggaaatacagttttggtcacaaaagtggtatttatgcactctgccggcacgtggttggcccagatggcgaaaatactgttgagatggccgggctcctttgggtaagggaaatacagggctttaagagcagtagggaacagtgaaggatagagaagcttgatgctttggagctcacaggatcagagttcaaatcctgacttggcggccattttagctgtgtggccttaagcaattctccagcaccttgagcatgctttatgggtaggggctcagtgttaatttgggattctttctcatgaggatctcaaagataactgtagctgggtatctcaggggaatatggcccacagttttgagtcctccagcctcagacatcagagtagactcagggcaggtaatgtatgtgtgatggtggacacacattatctgcatggcggtggagaaacctgcacatgagtgatccctcatgctgccattttggtcatgtctcagtgttaggaaacttacagctgctttgcttcatttcctgacaaggcggcagctggaattgtcgactttgctgttatctggaacagctgctgggatttaatagtgcacttagaggaattacctggaatcacagcaggcattatgaaatgggaatgcatttctgtaagcccatctaatgtttgagggcaagagagcaggggctttccctccatagtgagtgagacataaaagggactggtttgtctgggatgttgccctcaagatgagcaatcatttcatctgggctatgctcagcatggcactcagcttgggcagtgtgtgaacttcagtgacaaggtctgcttaggggacctattttcagatcaattgctcaagaaagccaccatctctgggcacctggggagtgacagccatcttggctaggactcaagggcaactctagatagttcagtgctgagcctgtcctcccactcactcctctctgttggtctggcatcaccagactggcattttcctctcttctgggcccagtcaattcacttctttctctgatatttagtaggtgctcatctacagcaccttgtcgctgggtatgctgtgcttatcttaaggtggcttaaagtctttttggaaaacaggttaatgaacatgcaattattagacaacaatggcagcctaagttgtgattccaaattgaatctaagcaaggtagaatgagatgcttctcaacgtacaatggtgttacatcctgatagcccatcataagttgaaaatatcataagttaaaaatgtgtttaggccgggtgcagtggctcatgcctgtaatcccagccctttgggaggccgaggagggtggatcacgaggtcaggagatcgagaccatcctggctaacacggtgaaaccccgtctctactaaaaaaatacaaaaaaattagctgggcgtggtggtgcgcgcctgtagtcccagctacttgggaggctgaggcaggagaatggcctgaacctgggaggtggagcttgcagtgagccaagatcgcgccactgcactccagcctgggtgacggaacgagactccatctactgaacatcatggcttagcctagccttaaaccttaaatgtgctcagaacacttacattagctcatagttgggcaaaattatctaacccaacacctattttgtgataagcgttgaacattgcatgtaatttattgaatattgcacttaaagtaggaaacaaaatggtcgtatgggtacttgaagtacagcttcttctgaatacccattgcttttggagtattgtaaactcaaaaaatcataagttgagccattgtaagttggggactgtgtctgcatgtacagggatgatataaatgcccttggagcttggaagagggagaaatttctgaaggccagaagagactggctttggatgagctatgtaaaaccaaaacccttgtagccttgttgggattcagggagccatgccccttctgctgatcttgcaattgatgacctttgaactgaggcagtagtagagcttgggttaaattaaaggaaagggattctacctcatgtgttcttttgcaagttgagagtgtcaactggtctggggatgacttgagctgcgtgtgctatgttgcactggtgaggtggtcacttgacctcgtaccaatactggcttctgagtggcttccaggtattgaccttggctaatgagattggattcaaagcatttgcaagtgccagtaggtcagtgatcaccattatctactgtgcacctcctaaatgccctgccctttttgcgtaagctgggtctgacagccctaatcggtcctacctcctagatagcactgtggcccatttattcttacctagttcaggccaccatcacttcttgtgtagacaactgcaatagtgtcctacaaatctgctgacattccctcctaaacaccccctctctgtcaaatccattcttctaactgcggctggtagaatctttctaagatggttttctgatcatgttaattcttttcttaaaactcttcatttatttctattgcacttggaagaaaacctaatcttattatatcctatatgtgttgtctgacccagaatttttgtcattctttatttgatactcatgtggctcaactgcaacagcagcaaacagctgggctctacccatgtggatccctctacttggaatgtctctcctcttctccctttccccaccttttgcttagcctccacttactcatccttcttgggcatcacccctaccagatcaggttagctgctcctgttccacagctcatagcttgctgtactttccctttgcattccctaatgaacccccatgtgttatccatgtagttttctgtttagtgtctgtctcctctttccctttcagggacccttgcaaggtccctgagggcagagaccacccccattttgttggctactgctcaagacctagcacagaagcctgcagctcagcaggctctcagggcatgtttgtagaggcagtggctgctttggggtttccagagcttccttgggaggtttcttctgtgtgtcccattgaccagagcaccactgggggtgaagtgagccccagacatctttaggtttccatctttaggtgagctttatgcccaggcacgtagcagaagaaactgtttctactcataaaccaagcaaatttatagtggaaatcagtgggagaaaataaatatgaatccccatgatgtcattttatgggctgctttatagattgtaatcacccatttagagtttgcaggctattaattttgtttgcgcagagcctcaggactcttggggacagaatttacagggctgtggtgtcagacacgtggttctaggtcttaaacccctgaaaggttttggaaagagaatgacaggtagcctatggagcagctggggcttagggctctttcctctagctttcctcctggacatagttttaaaatatttgttcactgttttatcatcttaattttaccctagtcttcaggcctgtcctttccgtaagctaggtgactatgtgggtcttgcattaaacctttggtagagagagctcccctctgagaacctgaagagatgtaaagaggaacagcacaaggtcagagagaactgggtagaatccagctctactccttggcttgtgatctagagccaattttcattgttgttgttacttttttcaaccttcgtttctttctctataagttgagacccatgccctcaacctcaaagggtgattataaagataaagaagaggaaataggaaaagcatttggtactcaaaatgagttatagttcataaaatgactatgacgattgctgttttaaggtaagctgatagagtgggaacacagtggaaactaggagtcagggcacctggtcccaaccctgtcactgatgtgctgggtgattttggacatactagttagcctctctggtcccaaattcttcattggtgaaataaaatgtttggctcaaaagattttcagacatggtgcttctcagtgtggtccatcgaccaccatcccctggagacttgttagaaatgtagattctcaggttcagccccagctctcttggcccagcagtcaaaattttaacaagctctccaggtctctggtgggcatagtgaagtctgggaagcattaccttggttctagcactcatgtccgatattgacttcccaagcagcagtcacctctggagccttcctctttggggtcttggaccgcaatggcctttggcaaggagtctctgctggatctgtgctgcacacggggtgtgggaatctctgggcaaccagaagagcagtagtaacatctttaggtaactgaagtcaatcctgcccactgggcaaatattaattggttgctcagggctgcactgagttcaaatactgagccactcaggggcttcgaacgaccaagatcaggcagttttcaacctgtgatccacttttggtagatttaaggcaaaagcaaatattttttgccattttttcccaaattattttaccattatggcacgtgttgctcctgcctaggagatgcattccccagaaccaagcaaacaagaagaaggtcctccttcagtgggctgtcatcgatcattccccgttccatggccacaggactgactgctgatgaaatctaaaagaccagcttgcagaaggcatggaaatcctggggttaggggcccctctgctatggaggtatgactcacagtgggtcagggaacctgagtgggatcatccctggaactcagaatctctaagacacacttattggctctctataagcaataacagatggcaagataatattattcttctaatcttttgctaaaaacattcagtcatttctcaggggcctccctagtagaggaagacacctgcagggtatctcattctttcttgttctcattttcccttctaccattttccccttagtatatttctggccctatgtgcaggaaatcaggtagctgaggtgtggtttaagggacccattgtggttcttatggcccatcaacacaattccttcgtgttggcctgcagtatccatgtttgttacccttttgggtcaaggcatgaaaacatctgtccacaatgccagtcttacctctgatatcaaagatagtatctgagacgggtgataaacaaatttaatgtgaaaagctgatgatgttttgaagtcagtagaggacggagctgacaatgagcgtcttgcaatgagtctgttctcaatttcattgctgataaagagaaacagtgtagtgtggtggcgaagagcacagaccctgaagcaagaatccatgggctcaaattctgagtctttaagtctgtggcccaagaattcacatttctaactgacttcctgggtatgctgatgctgctggtctgcaggtcacactcagggtggcaaggtcaggcaaggtcagagcacagcatgggagggactgtgctgcctgtagtacacagtggaaggtggaggaagcccaggggtgacatggcttacttatatcatctatgagttttttgtttcctttaggaaatttactgaaacattcttcattgcaaagtataaaaacaaatataaaatattcaatgggtattagaaaatcaggtatactctgtttacctatgggtttttctagaatggggttaagggtgggaaagtgatgggagacttaagtagtagaagtctatcagaggccccttcagattaggaaatgccctcaatgggcttcagtatcctttatgagataatgcataagtgagtggaccctgaggagaggagagaagaacaagaccttcccctaaggactatacaagacatgtacccatggaaagatggatgccatgatacagtgaccctgtgagacagtactggtggagtcaatatgaataatgggagaaggaacattcacttctgtccactcttctaaatgccatcgtaaatgagctcatttagtgttcagagcagagtaggtattattatttccacctcaaacatggagaaactgaggccagagaggttagtaattttcccaaggctacacagctggcaagtggtagaatggggatttgaactcagtgatacagcaggaggtagacaaatccctaggcaaacacaggtgagtccccagtgaaacccccccctgcaaaccaaagccagtttaaagtctgaaagccaagctacaagtcttggataaatccacagactggattgagaacctctcttcccatttggcatgctttcctctgattaacccccacctcttcacctatacccacccttccccaattggtttttacactgttgcctttttttgcatactcacagaccaatcagtatccatcccctttctgagcccataaaaaccctggactcagccacactgggacacagagactacctgactttgggtggtagacaattctcacgtcccctctctgctgacagctgtttcatcagttaataaaacttttcaccttgctcacccactggctggcagcataacctcattctttttgaatgtgggacaagaaattgggaccctggagaatgtgggggctgaacaaacagtcatggtagctgtgagatctgcaccggagtagtcagggtgtctcctacagtgggcctggacccgagcaatgcttgtagggggaattggcagctgcaagtctgtggcccacagagtgaccaagaaaaactgcatcatcaggactggccacaggacaccattaattaagtgcttaaggagcagtatgggggtgggcagcaacccagggatgcaaaaaagagaggattctcaaccaatagctcctggagctcagagaagcagcccctttcccaggtctggatccatggattgggagcaagttactccaccatttggtggaaggaagcttggaaatcagagggaccagggctaagtcctaggtctgctgtttactatctttgtgaccttatgcgagcctgattctaatctctgtctccccacttactgtgagaaggaagttaaaggagatggcatgtgtaaagggcccatccaacatgtaggacatggcgcacccctaatatttggcagcttgtctccactttgcccattcctactcccaagccttggagtctgagatgagaggtcactccacctggctttagttgggtttgttttgagtccccataggctctctgggactctgctttctgatgggttgaaaacattaggctgttgtgagatgcttccattactgtgatctaaaagcatctaggatgcctagcgtagctttctcactggattgccaatttctcagagaattaaacatttagtgcccaatcagatatttttctatctgcatacatgtggaaatgtatgcttacccacctccggggcgtcaattgaagtgcagttgaagccaactcactaattctccagtgcatggtagaatcttcgtggttggtgaaatgagtcatgtgtatgatttgatggactgtatctatgaaagtagaagatggagaggaaacaaggtctgccataaagaaaagagcttggtatggatgcaagaggaaaaagaagggggaaatataatccttcaaaagtccatcaagtttacctagaaacagatttacttaaaagttttgagaaatttatttctgatgatgatccttatgagtcactatttcttatggaatcaagccagcataaaagttatcttgcattctcagcatagctagtttagagaattaggtcatttgtaagtcaaaagatttctacaaagttcaaaataaataaattccaggtatctgagcttaagatggctgggaagaaggactccatttgaggcaggttttctcatttcccagcttagaattgccttcaaggtctttttctttatctcagaacaacaaagacactgcctgaggaagaacctctgctttattatggtgttctgcaacctaagtcagtgaagttttgattctcctggaagaggctggccagctactcattagctgcagggattgaggggatttcaggcatcagatggaggtggggacagactggagccagagttcttgattccactgcatgttacaaccatctggggagcttttaaaaatgctgatgcccgggcctcacttccattaatggaatcagaacctgtggggccagcgagtgccctaggatttctgtgagcagctcgggctcagaaccacttgttggatgctccctaaggatctggcaaggattttatgagtttaggtttgagagcacctgaaggagtccagaggggctggagaagaaaggagatggtggcttggtaggcacctacatccccaggggtgctggtagagactatgctgcaaaattacccaggaagaagtgagtctttaacattgcagccattactatgcatgaaatggtaattaaaagaccatattttcttaactcaaatacgttgatgagaaagatgcaccattgatttaatacctgctgttttggaggatgcggtgggagaaaactctattaagtatgtattaacatatggactgattataagatctcagtttcacaaatcattttatgttggaaaatgtgcttcttgaaactgatctaacaacataatgatagagtgccttatatggattactctgcctagtcctcacaacaactctacctgtgagatagatgctaacatcctccccattgtatgggggagggagttgaggcacagattgaatagcttattcaaagtcacaggtagtccagagctggtcagtgatgggactggaattcaaagtgtggttttcagaagtagcccacaaaatgtagtgagatccaaggctgttgctttctcaggtctcttaccttccccagagccagggaggtggctttcccttaatcagggtaccgaatctcccaagtgcaggggcgtcctgtccactggctctcatgccctgcacagggtacctggcttaggaagtgaatgggaatgaaatctggcttgaagtcccttagcaggccctgaggccaagggattattttttctaatgccacagaggctcagcatgagctgatggagcccagcccagggagagaagccacactgactgggctgaacagtggacacagcctccctaccacgcctggtggttctttcacctttctgagcacagcatgttagagaatcactctattgggtttgtctgatgatacgggaccagggagaaggaattggagagccttgtagctctggggaccttgatgctatgcctttaggacaaaagcccctacttcccatgccagtttgccccaacagcatggcagaaatggaaaaggggagtgtaggctgaacaggacctttggaaaacaccaggttctgatttccagaccctcggtcttcttgtgcaggctttccccctctttgtttttcccttttctcaaattccttgacgtggtggcaagctgaacctcttagagctgcgttccagaacaacctgggtaatggaaagtacaaaaacaacttaaacttgtttccaaagcttgataggttacaccgacttctcagaaagtgtccatttggacccaaaatgtgaaataacattttgaggcacgttggaggggggccagagggttacgcagctgcaggcgtgggccagatgggaaatccagatgctggcctagggagcaaggtcccttctgctgctcatgcaggctgtcaaagcagcagcctccttaggaccctcactgcaagctttaaaatgttactccttagggagaatttcagatgggagggaaggcttaatcaatacatgcaacgtttaactggcattagaatgatgttttgttttgtttcttttaatgggagatgatgggtggtagtagtaagtcagggagggcgttgcagggtgtggtcttcaactttccccatctttatcacatgccaaaagttgctccatttcagcatgcaaatctaaatttaaatagtcttctggcttttaagaaagccccctagctcacctgtgcagtacgactgaactactatgaaaccagcactggtgaacatatatgtgtggaaacacaacaacaacaaaatcagttgttcaaaagacatatttattattccttcagcagagaggcccatctgatgctctggggcgcaggtcccatgaatgttcagggcagtctctgcccaggccagctccttccccgattgtccacagtgatgatctcttacagactgtcctgcctgccctgcacacaatgggagccagtctggaggaaggtttggtggccatcactctggcgggcactggaaagaactctgctggatgccgagggccatttctctctggacttgctggtgttcagtgtggaagtgggagggaaatcaaatgaggggacctttgggaggtcacctaatgtggtaggacctaaactcagctgggtattggaatcatctggagatttttttttcagttagggtgccccctcctgccttatcaccatagatctgcagtgcagcccagacatccatttaaaataagctgcaagtttgggcacggtggctcacacctgtaatcccagcactttgggaggccaagttgggtggatcacctgaggtcaggagttcgagacgagcctggccaacatgacgaaaccctgtctctgctaaaagtacaaagattagctgagcgtggtggtgaatgcctgtagcccagctactcgggacgctgaggcaggagaatcgcttgagcccaggaggtggaggttgcagtgagccgagatcacaccactgcactccagcctgggcgttgagagtgaacctctgtctcaaaataaataaataaataaaataagctccccaggtatttctgaaggttcaggtagcctttctcattagcccgttccccaggattcttctctcagtcctttttgttgacaagctctctctggtttagcaggggacacaaggttcaattattgttccattcttacgatacaattcttggatctggtttggatataaatgtctaggttgccagtttcttgacaacttcaagggccttgaagttgactggtgaggaaaaggcaaagtaaatgcctgagggatggataccaattgctgtccccaggtttagtcagcaacttttgctgttgctcctgggtctactgtgtgcactcctttgagggccagttatcacacaggtctccctttgggtctccatcttggaatccaggcaggagaaattaaccaggaaattaaagacatcttcccttctccactcctgtcatgtttagatcttgggagtaaggagaggaatgggagagcaaacatagcttggctggagaaggaggtggttttgatcttttcttctccccttcctttcataggtagaggtcgtctcctttataccatctgtcttggggagtagtcacattaattatgcgtgtatttagagctttacaagccttgccaccagacgtgtgtagtgccttacagtttaccaaataggttcacatactaatctcttttgacttagtgagatgatgactcagctggttataaatcatcaaagcagcaccatggaccatgcatgacaaccatggagctagggcaaagctgttacttgaatgaaggaaaatgataaaagcttatgttccctgagccgcaaaagaaaatagccgtaaaatttccattgaggctttttctgttatatctttagctctttaaaaatctcatattgaagatacctaagaagtttggcaacaatgtcctgtagatgaaatgtgggtggagccaattgattgggcttcaagttgcataatgttgggtatggtgaggctatttggtttggctctactcttgggacaagagacagtgggaatgtgtccttgttttgtagttctctggaagccagaggaaggttatgattataaatttaatctctcagttttctctgtgtctcagccttcttcacagggggtaggacctccgtcctcacaagttacgggggtggtctcagcttctggagcaatgaggcaagtctgcaccctgttggatgtcttgggtacaaccagattaatgattcaaaggctgggggaagtccaggctcacaaacggctttcccaaagctccagaaggaactttgttcttctctacattcccccaccgcccccccgcccacacacccaggcattcctcttagattttataatctctttggagcagatcggcaggtaggacctctcatctgtttttttcataccgccatgtcatcagcttgataaatgagacagacacatgctagagtggagatagcattctgtgaagagcatagtgatgaggccagatggctgccaagctcaccccagtgtgggtctgggatggcagttctatccaggagactgctaccatcagaccaactaagggagatgtttttcatacatcagctttcattggaactgatagtgttatggaaaatctgtcctgtccccagcagaatgatcaatcaagggtgatgagcctccacttgggtaagcatggctgatggtcccccttctgacacatgaattagttggttttaaaaggtttacctccatattagttccctgttgctgctgtaacaaattaccacaaacttagtggctgcaacaatataaatttattgtcttacagatttggggggtcagaatcccaaatcatctcactgggctaaagtcaaagtgtcagcaggactggaggctggctctgggaagactctgcttcctttccttttctagcctctagagactgcctacactttttggtccatggccccttcctcacatcacttcttacttttgcttctgttggcacatcttcttctctgattctgaccctctacctcccttttataaagacctagtgattacagtgggcccacctggataatcaaggacaatctccccatttcaagatccttaacttaatcacaccagcaaaccccttttgccatgtaaggtcacatattcatgggttcttgggattaagatactggcatctttgagggtcattattttatctaccacaacttccagtcagtgatttctcggtttatttaccagagcctcagggagcactgcattttgcccttttacaaaattacttttaaagagattaagtatgtacttgtaaaaataaaaaaaagttaatttgtttgaaatcatatactttaaaatatctcttcatccccagtttctaatgccccatttttccttcccagagctgaaaactgttttttttttttttttttttttttttttttgagacggagtctcgctctgtcgcccaggccggactgtggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccagaatggtctcgatctcctgacctcatgatccacccgcctcggcctcccaaagtgctgggattacaggcgtgagccaccgcgcccggcctgaaaactgtttattaacaatctctagtgtacactttcagtgagaatctatgcacatacaagcgtatgtgcacacatatatgcgtgtctatgtataattttcccatttaaaaaatgatggtgcactttcacactactctcttttttttttttgagaccgagtttcactcttgttgtccaggctagagtgcagtggcatgatctcggctcactgcaacctctgcctccgggattcaagtgattctcctgcttcagcctctggagtagctgggattataggcatgcaccaccttgctggctaatttttgtatttttagtagagacagggtttcaccatgttggccaggctggtcttgaactcctgtcctcaggtgatctgcccaccttggcttcccaaagtgctgggattacagtcctgagccaccacacccggcctcacactatttcttaatgatctattcacatcagacctatatacctgcctttaaaaacagctacaacatatttttactttgcattggtgtatccaaatatatgtaattgggagccccttatcaatagattgtttcttttcttttttttgagacagagtcttgctctgttgtccaggctggagtgcagtggcacaatctcggctgactgcaacctccacctcctgggttcaagagattctcctgcttcagcctcccaagtagaggggattacaggcgtgtggcaccaggcctggctagtttttgtatttttagtagagacaaggtttcaccatgttggcaagcctggcctcgaactcctgacctcagatgacccgcccacctcagccttccaaagtgctgggattacaggcgtgagtcactgtgcctggccctgattgtaacattgtttctaatcttgtgctgtaataaacaatgtaacagcaaatgcattcttacattggtctttgcacacatgtgccagtgtatctatggggtaaactcctatgaatggcatttttgggtcccaggttatgtgcaccttaaataatgatagttgttgctgcattgccttccaagatgtatatatgaacatatgcttagagaccatggcacctgggcctggtcaaacaccatgctcagcagggctctgccatgttattcactaatagctctggggacatctcattatagttctgcctctgacaaggtccaccctccaggaaatagctcactagttgggggttaagtcaaggatgataagtacacccattgggtgagccactgcaaacctgggcccagagttgaagccaggacaaacatgttcactagaaaggctattcattaaacatcatattccaagctattctgtcaaattctagggacacagcactatgtcttcttgaaaacctctgatttcttttgtctgtccacgttgctggagctagacagtgtcgagactttgatttgagtaccgcagtggcgggctattctgggaggaacagacctgaaagaggcagcacatttagcagagactgcagccacaccggctggggccagggtgcttggatgtgacacagctattgtttgtgaaagagatttgatgcttcattagagaaaaactgtgtacagaaacccggcagagatttcttaatggcattctgattaaaggagcaaacaacctaaatgccagattagtcgcattttgggaaagaatgcatgatggggactgcatttctatttccttctttccctcagccttgcttggcagcatacatttgtcactttgaggacatgagaaaggggctctctgatgtagcagagaaagagctggaaagcagaggcatggaaactttcagctttctggcaggccaaggggaaggttggaggttctgatacagtgtctgcaactcccagggtccagagataaaagtctagacggtccagtggatcaccttggaatgcaaggctatgtggatgtgcatcagtcctttcaccaggaaccttccagaatggttaagaaaggaacccacaatgccccttagagtcagggctgtcatgcacatgaatggttacctcttctgtaccatggcctcagaacatggtagagctgatatcaagggaaccaccgtttctccctcagaaccatgctttaggagctatggttgtcccccccattcttgttgtgcaaactcattaggaggggtagctctctcttagaccttcaagatggggatatgcctggacagggtgaggcattaagggtctctctttataaacaatgaggaaaattccctatacattggccaaagtgatctttttaaatgtaaatgaaatcaattgtaagttccaaactccttcccatggcattggcccctgacacatcccccattgctcagatgcattggccacattggcttctggaggctcttgaagcacaccaagctagttcttcctgggagacctttgacctactgttccctctgcctgccatgctcttctcctggcctttcaaaggtagatccattgcgttcttcagatctcagcagagatatccccttaccagctgatatagctctccatccccaaatcctgccacctcgatgctaatttccttcataatcctaacatgatcaggaactgttcttattcatgtatttgaatgcttacttgcttattgtattcctgcccactggaatgtaagttctaagagggcagggatctggttagtcagattcaatgcttgtagaggtcagaacccagccaggaaaacaaagtggctcaagagagtatatttaatgtagggaactattaccctagcatcagaagagtggaatggctaagtaggtcactgtagggcaacccggaggttgacaagagaaaggagctggggcctggaaggacaaaaagaggaggtggtatcatggaggagacctaatcatggctgaagaacagacaggagagggacaggttccaacttctcccttccttccgccctctgggctttgcccagtgcttccactggccaaatccagtatgatccagttggcaacagtgccagaaaacatagtgggggccgcccctgtgattaagaatagagcaggcaataggtggggaattcatctgaaaacactgaaatgactggtgccttgctctatctccagctgtcttgacacatactaggtcctcagcaagcaattgttggatggatgaattaatggaacgcaccactccaaaggagtcagctttcaggtcaactctaatggagtggatccctaagagggaagggctttgcaggctgggtttaacagtggagacttcctgaggcccggcggggtctcagccggctgtgccttctatctctgctgccctgcccagaggaggatgaaggattcttatctctggaaataaccctctttcatgagccctttaatctgagcctgctgacacttttatatgtgcagggttatgttacttgaggaattcctttgaagacaattttaaactttcatcccttagttcaattttaaagtttgtaacatttgggacccttctcagagccctgaatttactcctggcatcaagatgttcagggcagagctgagctggaggggaattccgcattcctagtgatccttaactggtgcccctggggaatttatctaacatactggagcctccactggtctgtaaggcagaattaagaacaccttgaaagaacatgaaaaaatgaaataaacagcccaagtaaagcaccagcacatatgaggcacttgaaaatgttcactccttttcccccagacgctgggaaatagttcagatgccccctatcccaggacccatgaagcagctcaccgcagcctctctatgttgatttttagatttccttctgttgattattctccacggaaggcgactggagcaaaagaggtggttggccacccattaatacatctccttcttattgggacatttcgccctgctaaaggagtaatcatggattttctgtgaattttcctttaagcgttttctgtgttaaaaaaaattgtagtctgcctaaactgatttatgtgggtaatttatggagtacctgtttttcttttttctctcttcctttttcttcttgctgaggtggtacctttgctgcctcatccctggagttttgcatgagagttgaattttgagctgcaacagtttttcccatttaagtgttagagttgactggtactttatcaaagttccgtaagtacatttcatacaagaaatctcagcaggttagaatccggggactttttatttaaacctctaatgacagtgatactggcctgtaattaaggcatttctggaagttacttcaattgacttgcagaaaggaaggcagaaacccttggaggctggtactaaattcatggggaagagaggcacgggaagctgtggtttgggaggagggctcatgtgtagcgtggggcatatgtgtgtgctaactttcctgggtttctgtctgaattgctaatatgacattaggtgaaaggcatcttgtcaagaatgctgcatgtctggtggacttcctgaatatcaaatctccgagccttctttccaactgcccctcctggccagcctcatgagacactgatgagaaaaatgccacagctttcaaaacagttaacctctcctttggcaattcacagcactgggtttattcaagcttacgatgacacagaattttcctccctttgaaaagtactggttaagtctttctgtctcctgcccttcaaaagcagtcattgtgtttgtttttttcagaggtaccatcagggttgtcagaaagtggaatttcccgccagatcagaatttcttcagccttcattcatgacctgagtacttttggttttgagggacaaacttgctctattttgagcactgaaggaaaacatctaactcccaattatgggtctgtgcacgtgaataattgggtaatgggattaaagtgcttgaagatacaacccttcctcaggtgccccttttcacacataaggaaagtggagtacgaagggcactggctcacgggaaggagtggtggggaccccaggccttcagtccctcatttaacaaggttgtaaagtctgatctgacttcttactgcaagcaccgctacttctatgacatcctccatgccctttttatttcaaaagcagtttaatatgttatttcatttaatctccactgcaactatttccatttaaaattttgttagataatcaatagtgctctaaatatgaaccaatttggaagaaatatgaagaaaagtcatcttttagagacaacccaattcatgggccttgtaaacatttttattttttaggtaatcataaaataaaattgactttttaaaaaaatttggtgtgtaggtctatgaattttcacaaatgtatggaggcgtgtaaccaccactataatcagtggaactgtgcctttaccgcatcgaaccgcctccttccatctctaacccctggcagccagggatctgtttttcatcaccatagctttatcttttcaagaatgtcaaataaggagaatccacaggatgtggccttttgaaactggtttctcttatgggcttactttttttttctcagttagaacttttatttaaaatcaacaatcaattgaacttgcctatttgccgaacaatatctacaggtagaaatttgcaagaataactctggataagcatagtaggccatctatttcatcatgaaggaaatttttgatgtactattttgaagactctatttacagtcccttatatttaaactatatctattaaattagtgttatattgaaatagccattaaaacaaaacaaaacaaaagtcttacatggaccaggcacttgtgaagtactctattatttcatttaagcaaatatacatcctttatgggtcatctgtgtcattttgttatttactcctcttgtacaagcttggcagggtttgagtggttctttaaaagagaagttggtgatagggagggaacttcatttctgtcccagatgctgacaccttgtgggcccttggtaacttccgctgctgtccatttccctcatgtaagggcagatggcatttgcatacctggagggacgccggctggagttacagatgcctgctgatgattggaatgttagggacttagtgacatgtgctgtagtcatggggtcctctcagacacttagggcatgcaggccttaggggagccctgtgcctttggggctggctgatgctggggagtgggactgtctgctgggttcaaggtggaaagggaactgctcctgtgtggtttgcctgccaaggagctaattaggagaatgggtttggtgatcttgatctgacagccaatgggagacttcctggggagctggaggagataagcctgtcaagaggctcccagctgtgttagggccaggattgtcattgctgctaggcagggctttggtcctcccaaaatgagagtgagcagattgcagcattctttctcatagcaccaaggaatcatagactccatggctaagtgaggtggaaccaaccacattgtgtggtcagccagtgccaacctttcttcttgcctggccttgtggatggtgttcacttttgagatgcaaactccaggttatgttatgaaactccacttctttgtctctcaaaaaaagcttgttaaaatgcgagtatcagtagccttttatttcaagcctcagatctcctctaatcaggccatcaattggccatactgatagctattattaaccattattgagaggcactagattatgaagagttgagtagttaaaagcagcatttctggagacagaccacatgattcctagtctcacctctgcacctggctggctgggtgacccttgcatgttgtcagcctttctgagccttggttaccccactggtaaaatagggatgataatagtacctccttcacaggtttattgtgaagattaaattagtcaatacatgtaaagctactgacagataccagcctttggttgtaagttaattttgaggattctatattcggccacctctgctactctgtcatcacattcagattgagaactgctgatcagtctaagtctcacagggaataaagctgaggtctacaaaggctcagtgatgtacacaggcagaaccagaactaggagtgtccctggacccttaatctcttcacactgcaaagcagaaagctggtgatctgaataaactgtttgctcttggggactttgctaactagaaatctttattaacttggactctgattttattgtcaaggcaagaataagcaatttttagatcaacaactccaagtcactggagtcacttcagcagagtttcagtgtttagtgtgatttgctgtgcccatttctctgcataatggccttccatgcatgtatgaggggaagtccatagttaactggaatgcatgcgtaggcagagctttttgtttgccaaccaggagtgataacggagtttattgccacttgatcccctctgccagcccatctgggtcaacttgtttttctctggtgtttgccctttccatcaaattgttccagagactaacaacctggcttagtgatgacaagtgtgttaatagtggagctcaagataaggcagcagtaactctgtttgctctgagagtttgctgcctgcctgctgagtgatccagggacttgtcagccctttgagttaatgtgtgtgaggtgctggatgcagagaagagcacttggtgtgctttcagcttgcacatgtgtcttggtgctcagcactccccatcccatgccaggaaacctctctctctctctttgcaggagatcctcatgccaactcccatctaaaaaatgaatgcttgtgatttggaaatactttttcatagatgctcagaaggtgtttagagttttggcttttgcttagttcacaaaccaggtaattcccagttgtccatatgaatgctctatagtcaaatttaggatcccaaattggcttctttcatcactgagcaagcttctggactagacagtctcttctgtaataaaattgctaaagtgaatgcaacaggaaggagaggaggaatttgcaatgacctctttgtgtaggtagatagtctgtgctttcctgatgcaggctcccttaacatgaggattgtgtatggggcagtgacgtactgcttctgaattatccatgcaaaatgtttggctctttgagtgtgaagcagcagcagttgcttgtattttcagacaagggtctcagtgcacggagaggactccctccaagtgttgtctttgcatttccattcatcttattagagcagtgcaaaccctgatgcatgaatgaactgggtttgtggctgaatgagtttggatttgctgagcaggctgattcaggaagttgtccttgattcccctgctgtttcccatgtatacacacccttcctaagtgaatgtggcatttgtattggatgaaggccatagctcagtatgaaacgtgattatatgtctactctaatcctcaacaggcaatgctttccacttagggtgttttagaggacatgtgtaccattggacttgcatgatatttgggtcaaaggcatttatggacagagatggaaggtatgatctatcagcttagaaactcaacctcaagagagaggagggtgtataaatgaggatgcataaagtaagaatggaaccccccccccccccccgcacacacacacacaccgtccctagtcaaatttgcaaagacttacggatatgctaataagattgctgctggctaggggaattcacaggtctgcaaattctatgaattctaatgcctcactcagcaattttaaaaatgaatggactggaattaattgggagcctccttccatgggaattttggaagtattcttaggtatcacagaacactgtctgtttatgcataaaactccataaactacaatggaaatcactctagataacaacgtgagagatgggtattaccaggggcatatggcgtaattttaggtggtggcctgacccagcataggatgacacagactccaatgaggagagggttatgttttcttttacattctctttaacacagagagaatgtcttccctaggttctaccaggtctttaacacctctctaaactttggcaatcagcctccgctctcaggctctgagtctttgttggggtgacaagatcgaggtggcgtttaaatgatctgggttttcttttttgctgtatgtttagaattaccttctagttatagcaagtgagatgggctttccatttgtggtagtgaaataaagttcaatttaaaaattgaactttaaagaatgagatttaaagaaaaaaaattacacaattaattgtgtaggtagagtcccattataaatatgttgtcaggacaggacatgagtgatagagataaggaaaccctggcaataggagataatgactactttgattacacagggaggcagtaaggactggttcctccttcatcttgtaaacatggccactgtttccaccaggggaatactgatcgctgtcctttacagaggcactgtgctaagtaagtacttttcacacatctcatctaatcatctgaacaacccatgaggtatgcataataacaaacctcttcctttaaagatgaggaagctggaacttagagatagtaactggcttttccaaaaatacatggccagtaaggggcagaggcagcatttgagcacaggcaatttgactccagagcctggcacctcacccctatgccatgtggtaacacccagtaacagccccagagaaatctaatcagagaaaattccagtcatttcagtttactacctggggcaaattgagtttatggtgggggaaaagaaaaacacattttaaagaagggcaaaacaccatcctaaacttaatgagtcccatatgccatccctatgtaacatcttaattttcacctgtttcagtgtctgttctatttctctcataccactgcctgtagaaaatagatgcatgttcttgaaattcctactttttctcattaaaggttagattttattattctttctctcaaagtttggattgccaaagcttttggatttggaatatatttggcttgcatagatgccaatatttatacattgatacgaagattaaaaaaaaaactttagaggagagatccttttacaactagacttgatttagagtctatcagaaattttcttacatatttagcataagtattgtgagataatgtatgctttctaaaaatatacatgatgttctgctcagtcgaatgcatttatttctttctttaaagttttctgggtaaatttcaagagcatcgggatattacttaacttggtagattttattaaacctccaaagaacataattaactcattttacaaactgttaatgcttacagaaattcatgataaatgagatcacttaagactgtttcgggagaacaggaaaagccagtttgttaatgctggtcctcttctctattataatattgtgagaaatgaaggaatgtttatcactagctgttataaccttaatttgagagttctttaaatggcaattacatatatttacagaagaatgacactggcatttagctcaatattttcagcttaacagagtctcgttgggcgcggtggttcacacctgtaatcctagcactttgggaggccaaggtgggaggatcacctgaggtcaggagttcacgaccagcctggccaatgtggtgaaaccccatctctactaaaaatacaaaaattagctgggtgtgatgccatgtgcctgtaatcccggctacttgggaggttgaggcaagagaatcgcttgaacctgggaggtggaggttgcagtgagtcgagatcgtgccactgcactccagcctgggcaacatagagagacaccatcttgagcaataataataataataataacaacaacagagtctcccctgaaagagggattataaaaccagggcaagcctgtcaaagagaaatttgatttggttctgctgttttacattttaatatgcctgtatgatgacctagcccattaaattttttttctttaaattatcaataggctgtctcaacctctgttcaattgaattttactctactctcccagggaacaaaatgacagagcattttgttctaggtaccttagttcttgttgcctattgtggcagctctatttccagtacagagtttcataggaaacctctcttcttctggtcatgcctatcacccagtcacctttcctgaacaattaggaattgactttctcttccccaatgctgcatttcactctcaccctcagtgtccagccctggtcatattgtctttagcccaatttttcaccacgccatagtctttcttgccactgggctttgcatgtgctgttccctctgtttgcacatgctgttctctctttctcctcttcttcccatccctttcccacagcacacgcctttcacccaaatagcacctactcattcttcagatgccagctccagtgcgactttcttgagaaacttcttttcaccttgatcttttgtgagcagctcttctagaattgtgttatgttcttccatgcccttatttcattttgggttcacattcattggggatgattatgaatggatacctgtctcccccattaactgacattgttaagttccctgaaagcagctactatctgttttttgtctcagttctatcccagcacaggatgagcactccattaagtatctgcagtatacataagtggacagaagtgtttgtaaacacccacgttctgccattcttccctcaatgccaaaggatccaactctaccacctcatcaaattcagagacagcttctgattttgagccataggggtgtcaacagcacaagtgcctgaagggcccacagaattcctggcatgtgctgtactttatcaagaatctgacagggaatgcggctgtccctatcaagctgttgtgcctgacaggcaccatcttggttagctgtgggaccactggtgtttctcctgaagctgcaggacagccagctgcaatgggctgactgatcttgaaatgaaaccctgcctccttctccctcctcctcgagccagagtgaggtggttttaacttctatctagacagttctgagattggtagaggagaaaatagaaagttcttacttaaattattggtgcagaaagaagaaggtgtatgtgaagaaagaaaatggacatttactgactattctgcaacacagcctgtgcagtgtgttaggatacacacccaacatctcctttaactcatctgttgccgcagactagtcaatgggagcaccaaaaactaggtaaaggctggtagttgaactaagtctgtttggctccaaagcttatgttggcaccacaacttcttcctaagacgaaggttggccttcactggtctgactcaaaagtagagaacatttactctgccagaggcaggaacatattcagctagcttcaggggtcctggtgctacaatcacttgtgtttctttcttttgtttttttatgtcaaaagtaattagcaaagaaattctgttttgattgtttgttttagagatggggtcttgctatgttgccccggctgaatttgaactcctgggctcaaggggatccttgtgagtagctgggactacagagcacaccacccgcccagccacctgtgtttcttatcagagcttctatctctttgttgttgcagattggagcctgggaggctgggggctggggagatagtcaggacccctagaagggcaggaaggatgcacaattattccacagaagaagcctgcctctgtttcccttgatgtcacctagtcaacaaagtcccacagtttatgagtttaacctacagaaattctaatatacctgccctgcacacattctgctatgagagccaagggattaaagatcaacaaaggcttccgagaagaatgcttggcttgagattaggaggaagaataagagtcatccttcatccatgatgaaagaagactggtgggaggagaatgggagagaatgttgcagataggagaaacagaatttgcaaagtccacgtggtggcacagaggaaggttcacctgagtcatggaggaaagtgcagcctggctggggtgtttagggagaggaagcctgatgccagaggtcaaggccatgacaggtaccaaatctgcccccacacattgttctctttccatcctgttgggtaaaacatacagatgtgagagatgggatctaagggatgggaggaaagtgggaaaaagctggggagaaagactaagtgatagttactaaaaataaaatttgctaagagcatgttttaaggatcgtggcagaaccagtcagtaataagggttgaaaaacaaagcatgaaaatgaggttaacctccctgttaacccaaactgaggtctccctggcttttattatcatggttatcgtaacacccagacacatggattggagtgtctggggaaatcccttcagtccgctccccaaccaccgcagctgtaggaaaccactaatctactttgtgtgaacctatttttaggtttctatagatttttctattctgagcatttaatacaaattaactcatacagtatgtaatcctttatgtctggcttttttgtatgcagcataatgattgtaaggttcctccatgttgtagcaggtatcagtagttcattcctttttattaccagtcaggcacttcttgactccctgaaaagggcatcccatcataaggcagtcaccggttcccaggcatggctggagcagggtgccatagagttagtgattttcctcaatcgtattggatctcagtggtctagataaagtcagcccggacacagccctctcagtttctctcatgccctgcttagcagcagctgttctctagctatatatccctgttatggttttgggtcctgggtcatgagtggtccttccattcatggccaccatgtacagttgtataggttgagtactgcacaaaggtgcccagctgaagaaggtacaagaaagcactcaaatgcaacctgtaccccttttgctaagccagaggctccagaatggtgctgtgtcagccagaggggagagtactttttttctaatgcattcaaggcttcctaagggcttcctaagggcagtcctttggatagcatgctgttgtctgtggcacttgccagggctcaggtcctggatccagttaacatgtcttatatttgagttaacaagattgaagtggtaggaagatagaggataaaatcacagatattttctgatttatggatttgttctcataagaaaatcttttccaatttgtgttcggagatctacacccctattttctccatcagtcctcttgtgagttctaacatctcttgctgttcccatctgtgtttctaactttgaggttgagcatttctgagattgaattggtattaaaaattaattttcacaaaagaagaaaatcatgactttcagatatcaaaatgaatatgtgttaaagattttattctactcctattcaatgaggggaccaggcagatgttataaccagttgaggacaggcaggacatggtggctcacacctgtaatcccagcactttgggatgccaaggtgaaaggatcacttgagcccaggaattcgagaccagcctgggcaacatagtaagactctgcctatacctgaaaaaaaaaaaaaaaagccaggcatggtgatgcctgtctgtagtcccagctactcaggaggctgaggtgggaggagcccttgagcctaggaggtagaggctgcagtgagccatgattgtgccactgcactccagtctgggcaacaaagggcaacaaagcaagaccctgtcttgaagaaacaaagacacaaacataaacaaaaaagaaaagaacagacacttacaggtcagtaatatttaaatgaatgtggaaacagaggcaaaactgtttttttccacaaaggcaggagagaagtcaatggaacttctcttggacaggacagaattttcatgtccatggacaggaattatttgcattgctgtcacttatgtacaatttacagaattataaaataacttctatatggtcagaatcagcttaccaagagtggcgttctctggagtctgtcaatgcatcccttgtagcagcatacttcattttcccctgcattggtaatttgtggtgtttctagcgcattgatgaacctaggtaagtttttaccattccacttgagatttcaagataagcacaccatttctttcatgtctgaagtagtctttggtatgttggtgttctctattagaggaggaaggatctggaagttttcaaaggaaactggtttatggaaagagcaaatggtggggatgtactgtgggttcgaagggaggcatgtgttagtctgttttcttgctgctgataaagatataactgagactgggaaatttataaagaaaaagaggtttaacagactcacagttccatgtggctggggaggcctcacaatcatgacagaaagcaaaaggcaagtcttatatggcagcaggcaagaaagaacttgtgcagggaaacccctccttataaaaccatcagatctcatgagacttattccttatcatgagaacagcatgggaaagacctgccccatgatttaattacctcccattgggttcctcccatgacatgtgggaattgtgggagctgcaattcaagatgagatctgggtggggatatagccaaaccatatcaagacacctggtaggccaccaactgggaaataaggtctggattttattcttaaaatcatcacacccttgctgtgtgacgtttgggcttggcatttatctccctgcttctgtgagacaggaaaataagtgttatttgtaaagtgtgttgaggttccctgatgaaagttaccagttaaccacaaagtagtgttatgaatctgccctttgtccgcttgctgggattggatgccctgggtacatttgtcttccacatctttcatctcttctcaccattcacttccgctgcagcaagtgggcaccctgccatgggcttacgtgttttcagcagctgcatttggatttttctatttacccttgaaacaatctgttataaaaagccttaaacatctcccagtttctttcctttcctctaaaatgtttaagtaaatagttgatggaataattattctaaatgtagtagagttcacattgtcttaaaagactggctaaaaataaaaaattggtcttgtcgaagcttaatgagattcttcagctttgctgtcccagtgctgcaggtggtgaagaggaaaatgctggagcttccaacaacaacacaccccccaaaaacctaaaaacaaaaaaaagtgtggaaacacttccaaaatctactcatctaaaatggactattcctattcatcatgaggggatcttcaggtgtattttcagtctatgaggaaaaagccacttttacaggaatgtctgtaacaaatttgtgatgtaatacagtgtctactccagtagcttcacttcatgaaactgaatagcagagggatggataatagtagctgaaagacttatttttccttttagctgtgacgctttaatgactttgctatccctcaactgtccccttgggtggaggttatattctttaacgaatcgtcatgtgattcttcacttttaccataccaaatcctatatactttgctttaatttttgctttgcttttggtgaccgcatatggcagagaaaatattttttgtcttcactgccattacaaatttccatagtcctgggttgaggctggatttcggagaccaccttgtttttttccaaatgcaggagagaggaaagtagtattagcagcagttcaatccagtgcacgaaatatttgttgcctgttgggatgcaatactacaactcatttacacttcacacatttatcacttttcttacttttgatagattatcttcccagccattctagccaaactgatcatctgcttctgaattcccaaggtgtttaatatctttcctactgatatttccatttaaccatatggaaatggttaaatggtctgatatggttgtttgtctatctgttgggcatttattttgtctctccatcagaaaaaatacattccttaaaggagagaatcatattttatatttctgttttgtcctctatagcacctatcaggtggccagagtcatagtagggtctgagaaaattcttttccatttgcttaaatgcaaatgacattgggtaaacttgtactaagtgacacagattgtcacaaaggtctacaacagagcatgctgattatatacatatcatcagaggacagacttgagaaactcagcatgctcatttttggatttgagctgcatgaacagctcttggtattgattaatggaaagatacaagcctttagttgtttggatggaaagaaaacatctctagcattcttttttctttgaactcttagaaactgaaaagtcccaacagtccatgtccaaaggcgtaactgcagacttcccaggcagctttggagatcatccttctccaattgtggtacttggggtcaagtgtagaagcagggagaccacttaggaggttattgtaataatctggtgaaagaccatgacactttgcatccaggttggggcagtgggagtggtgagaaatgtgatctgttgcatcgactttgatgtagagtcagttacatggagaagtgattggtgattccagaagttcagagaataagccccctggggaaggtcattttcagtgaggaggtcattcatgtccctgaaagtcagttgtctgtggcagagcttgggtgctggtgcttttgctgtggtccgtcccagcttctctggcaggttggcatgtggactgggtgttggagaaactgctgaggtcttcctttccctggggaggtagtatcaatgattcggaagttttaaaaatgcatcagcttgctggacagtgccctcaatcctggcccagacccatcgtggaaaagctatcatggtgcagcctctgcattttgcattagttgacctctttatggtaaggggccaagtctgaaccccagggagctgaggcccaggaatgctccttctcattagagtttggcctggaggtatggtcctgaaaactttgcaggtgagccctgttagtggctcctcaccccttcttctcctcccttgaaggagggagagcttcccccaaccatgctgggaaggcaaagctctcttaaggcaacgaccacttgctgagcacatctcagggcagagacaatgaagagaaggcatgaaccacacagccagctgacatctcaggaaggtgtgggagtttgaagaatccccgctgtgtgtcatttactggctacaggacattgggagaattacctaacagccctgggcctcagtttcctcagctataaagtggggataataataatagaactatcttctaaattttttgtggggattaaatggggaaatataagtaaaatatttagaatagtgcctggcacaaaatatgtaccatattttgtttgctattaatattttatagtattattcatttataatatgataggttatgtagtgtgtttggctattataaatatattgtgtgattagtatattctcaagccaggcccagtccccagcctttagaaacccactccctggggatctggttcagggtagttactgggtcaatctgtgtatgaacaaacctcacgcataatacagacatctcgaattgagtacctgctgagcctggatctgtgttggtaacttcacatccatgatccacaaatgtctgacatttattttagaggtgaagaagttgaataccagagggttaagtgacttccgcagggccacacagcaaggttaaaattaggtcccctgacgccaagcccctctctgtgatcaatgagtgtttcctgatgtctgcagtatgccctttgctgtgggaggcactctaggcagttattcctgaactggctcaagattctgagtttgcaagtcagggattaggcctaggcatctacctgttagcaggcccctgcaggaacttccagagcagatggcctcaatggcccaatggagacacaatgctagaaggtagacgaaggatggtctcagctcctgaggagtcttattacagaggtgatcatcaaattacatgaaaatgcccagcaggtgctgattctgtgcgtgtctgtgaggctcactctgagatgcagcagcctggttaagcggagaggactgtggtactcatgttgactcagcttagggaattaagatgccctgtgaatgtggagaggtggggcaagggcaaggaaggggggacaccgtttgaggaaggttcagaggcataaagaacttgacatgggacagggctggtgaggattccctctgggacatttcccccatcttcctagtgaagacccatcctgcaaaatccgtggatggaaagcagcgggcataacctcccagggtggattacataactgggctgggccttggctggggctgggcctcccttgccatccttttctcctggttctcaggtcctgtgctcctctcatctacctctctacctcctgctgagcagtgatggtggagcagggcaacctgctcacaacttcctgcaggagtggatgatgtgcatgtgttttgtggggtctgttgtagtcttatgtcttttgcctgtgagtggttaggccagctgtgccctcactaggggagcaacaattgggactatggcaatggaaggcagaccctgtgggcttttggaacttccttctttttcacccatcctcctaattttgcttctgtccataacacacaatagggcgttggacaagtcaattcctctctgggtcccagttttctcctctaaaatacaggcttacgactaggtgaccttgcttccttctcaaagtaacattcaatgacttttttgaacccaatctttggaacccctcttggtgttctgttcttttggctttgagaaggcttcctcctcctgtattagacagatactggagtaagagcccaggttttctgggtacattttcctttaaacctccaggcaaactggagctagtcaagacatcagaaagagtatcctgaagctcagggttgtgctttcagatcctacctcacaaatattcagttggtataggctctctgaggtctaagctgtccaaataagaaggatctgccttctgtgtggttgatccagttgcccatgaaggagactctgaaaagaaaagcccctccacactcaagataatgattgccaaggttttgcactaaaagcacacatctgcctgggactttatgagtgatggctgtgtgttagctgcaggaggcaacaggaggcaatctgcccgaatggtggacaccatggccagccaaggctgccccatctcggtcttcatcacttcccttctcagtttctctccccacaaaactcaccatgagatggcttctgcggcagtgaggtttaccatccaatagaaagaaaacccatggcagttggctaaccgaccaaacttactccatttcctctgacaatcgatagttattaatcacctacattctccagaaggctgtaaaccgccctcccttctgtgtctctgggatgacaaatggagtcggggttagccagcccggctttgtggcatccaatgtgtttgtgtttgtgctttgggcttgtcagttgcctttgctgggatgaaatagtggggcttccactaggcatggttcagcagctctgctagtgtctgtgctttattgggcaataaattaacagtgagcactgccaaggaaatagataaatggatagggtggcaagcacatttttaacaaggaaaatggcttcgtttctcagtagcatcatttaaatgattagctcagttgtgtagtttccttgattaggggatggggaggagatcttaaataaacatgtctgtaggaagaacattgtgggggcatcctcactgcccttctttggaaggtttagggaaggagaggggatttgtttaggaccctaggtctgggagagtcttgcattttagtcatgtgtgatacatgactaattctgcctgtgggttaagcctataaatagtgtgtgattctggctggccatatctggaggctataatcaggatagtcatacttgaaagagttaggagaaatcttttatggcttgtcatgatccttaactgcatccccatggtaaacagtggcaagagggaagagagggaactctttgtttgcaaggcaaatctccacaaagctaagaggaatgctagccatcagtacaaaggaaaaccttccaggctcaagagaagggcagtagaaaacaaaaacatgaatgcctcctttccatgtatgtacacgtaaacataaaagggtgcctgctttttcataactaatttctagaagtggtgccttccccactagaatatcatctgaataaggggtctttgtcatgtgttctctgtgatagcccctgtgctgggaatggtgcccagcatatagtaagaaatcaacaaatacacgtggaataaatgaacttacaggtggactgctttccaccctccaaattctatccatgattcctttacagcttaattacacttccaccaggtccttccccagccactcctgcctgaaggactgtcctctcctctgctcaccagttatctcttcttttcctttttattggaaattgagaccttgttttggaccatgttttctattgtttcaatttgacattaaaatcttatagtattgatctcttttatatccattccacaaaccttttcaggttgctataaaattttttatctgtgtttctctaggaatagatgagttgcctgaatgtgaattcaattcatcttgcaagtataatagcttatcataataagctcttcatgtaatgtaataagtacttcagaaaataatttagcctttactggattttttttcccttcaaatgattggtttgtatgcttaatcactcaagaactcagctttctggtagaaattgaacttgtatttgcctgtgaccaacctactgatttttgttttagaaaaacagaaacaaagggagaataagagagaggcaggaggaaagaaaatgagagagagaaaaaagatgaatgtatatttacatctatagcttacttcacaataggttttgaggacttatttacagctaccttatagaagatatttacaaaaagtaagtgctataggttttgaaatcagagaaaagggtagatgaatagatgcttctgctttagggaatgtatcttggtaacttctgataaaggaagctttttaagctttctcttctctggcgcttataataggtccatgttttggtagggggtctagaagaaatagcagctctttgccaagggattgcttattggaacaaatcatttgcaatagaaatgtgtttactaagataagtgccattttaaatgtagtgtgctgtacccctggcaaggaatcttaaaggtgactcaaagcctttttgaaacactgccatataattaaagaaaaccaacttaatgatctaacatttagcattattctttacagttttacacttggactggaaaacagttgcaaaaatagcttcatttaattaggatgagaaacataatacacatatatagatgcatgtgtatatatatatatatttacttcattttaaaaattattatttgtagaaatagtctagtatgtgtgaccaagaaaattaatttaagatttgtgctttattcttcccagtcattcatcaacaagtattcattgaggatgcaagaggacctcaggagggatgtacattcaagacataccatcaaaggggcttattgtctagttggggagataagacatatacacaaaaatagttaactgtatgtatcaagtattatggaattgactgccttcaaaatatgaaagatggaaagtgctttggaatatcaagcaaggggaaataggaacctatactttaaggagggtattcattcattcattcaacaattgtatataaagcatgtactgtgttctaggtactcacacctgggtgctagagatacagcaaggactgaacagaccaggtctgtgtccttacagaatttattttcttttgaggttaggcaagcaatagacaagtaagaagtaagtcaacaatgtgatttcagggaatgataagccaatgaaggaaatgaaacagtgtgaggggacaggccagtgctgtgtgcacctaactgcatgtacttgcttgctcacaactcagtcgtgctttagaaaggatagtcaggaaaggccttgtaggaggagctggcctggactcagacctgaataaggagaaataacctggagaagggatggcattctgtcctcaccttggagggtcaggaagatatggtttggaggataggaaagggacagacattctagaacatttcagagtatctgagctttttttttcccccagggtgtggggttgtggtgttttgcatcaggtaaggctcaggtgaatcaatgtataattttggcagccagaaggctgggagctgttcacaatgagagattttttttgcatcttccagtaaggccattctgggatgaaagatgtcagagtgtctggcaaccaactggcagccattgaactggggatttatttagcacttacttctagagagcttgctatgtgccaggcactgttttgagtgttttacaaacatattaacttactcaatccttacacctctttgtggtagatgctcatcttcggctcctctgtcagaggcaggaactgagccttgagagttacctgctctaggccacatctctgggaggtgttctagttatgctgttctagcccttaactcttgtgcttcttttttgtgagacgagagagcacccatgtcactcaggacacttctaagtgtctctagcctggaccagcagaatgagagttgggaccttttctaattatttaagggatctaaggactttccaccctgatggaaacattctcagtctgcccagtatggtacccacttgcaacatgtgcccattgggcacttcagtgtagccagtgcaactgaggaactgagtttttaatttgtgtttaactttaattaacaaaaatataaacctaaaaactgaaggaatataaaatgtttgtctgttaaacaatactttgttgttttggtaggactaattttcacaagatgcaacaattgttgcaacacatgaaacactgttatatttcagtgggggtgtcaggtgcatgaagtatttctagtatctcattaggaatttttaatattaatgacatgttgaagtaaaaatattctggatatattgggttaaatatgaaacactttacacactaatattatatgtttcttttttttgaaatgtggctaactgggacattcaaaattacaaatgtggcttgaatctttgaatatttctattagagggagctgggatgaagtttaccctcaagcctctaaaaagagcgcttgggccaggcacggtgcctcaacgcctgtaatcccagcactttgggaggccgaggcaggccaatcacttagtgaaaccccaactctactgaaaaaaaaaaaaaattagctaggtgtggtggtgtgcacctgtagtcccagctacttgagtggctgtggcatgagaaccgctggaacccaggaggcagaggttgcagtgagctgacattgcactaccgcactctagcctgggcaacagagcaagaccctggaaaaaaaaaaaagaaagagagagagagagaaaagaaaagaaaagaaagaaaggaaagaaaggaaagaaagagagcttgaacaaagaggaaataacggctgtgttttgggtggacattgagccatcatcctaagcaccagttctcccggacttctgggctcttgctgagctcactccagttcccagttccccgggaccaacatgcaccactatttcttgggttttgcagatggaattgccacatggatagagattggtgggaactcatacatgaacacaacccccattttgctcaaaaatggtgtggatttagttggagttagagagtctctcaaccatatgtgacttctgccttctgcccttgcctgttccttgacaaggaatgaggcctgcattgccactggcaggaagcagctatccacccagcacaatgcttgagggccaaatcctgcacctggtcccagaggtgcccaaaagcaggaggtgagagggctgtgcttgcttgagggaccccacagagccagggaacagcctgccaaagcaactcaggctactgaaatccaagtggcagcaaatggccaatcattgtctgggtctggctctgtcccagcctctacttacctgtatctcctcagaggtacagcttggggcagcctccctatcaccgtggtttcaaggagaggtgtgggtttgtataggggagatggggctcctccataactgagtcaactgaagactcctccagggtcactcaagtggggacattgaagaccaggtagctgcccacttcgccagtgcagagacctgagtcccaggcagcccagatccctggagatagtcacatgttccatttgctctgctgtgttagcattaagatcccacccattggctgttcaggtggccacggccctgactgcacactggaattacttggggagctttctttttctaatacatcagaaaaatactgatacctggtcttccccacagagatgctgatgtaattgctctggggtgtaacctgacaatccaggttttaaaaactctgaatgaagttatctttccctgagaggatatggtgcattgaaatgaactttctcaaagtgcttcagaattacagcagatgggggtgcagggtgcctgttgaaaatgcagagttctaagctgttcatcagacctttggaatcagaatatttggaaatgcacttgtaacctacagcccaagtggatattcagtaggctgccatttcaacatcaccctgtgaaatcattaacaactcagtatggatttgctccttattccttgtgctttttaagaagtccaagaaagagagttaaggtaaaattgaaaggaagtaatctctaatggtgaaatttcaggctcttagatagagaatacttttcggggaaagggggtcttctagaagcccctgaaatgaagacaaggagtgaccaccaactccttgagccagaactggggcagttcttcacttggggactctgcccttgtgcagtgggaaagcagcttatatcaaggcttggccaggcctcctttggtcccaggctggggactgctgggacttctgccacaagatgcttggattgtgtttctttgcattggtgcagcgtctcctggagactgcttttgttcagtcactactgaggcgtgtattcattaaatcactgtgcgcactaaggtagcagtgcagagacaccctctctgtcaaaattgagccagcccatcctgcatggtcttaagttttcctgagaaaagtagccataagcgatgggctcccactactccctgctttattacttgaggtacagagagcatatgacacattcgaaccccatgtgagttagagttcagtatgggatcagaggctggtttactcttttcaccgggaagcgatcttgagaagcctgcggatgccacttcccatgacctgaggggctgtgttttatggactgcttttgatctgaaatctagagatccctgttttcatccttgtaagcctccagtaactcaatcacagtagagcagtccccatcatctccagcaatttattaatcatgttcaatgccagacaaggccttaaaaaaacaacacttactcatcagcagaccactagcagcatggaaatgctactggcttctctcggagaatctcctatactctgcgaacagcatgagtgtctgtgtgtgtgtgttttagtgtgtgtgtgcctgtgtgtaggcacagaactatggaggttttagacattgtcgttcgcctgctggtatatcaggttactaaacagagaactagaaactctcctagagtggctacaggagcactgcagattctcaactgtgcttccccatcttctcctggatgtttggcagccagtgtgtcaggatgtattaggcctctctccaaggacccaagtgcaacttaaattggatgaccatattctttggcatctactcagggcacttgtgagagtggaaaggaggtgctcttaataattattccaggacatcaagcaaactgggaagtagagtctccttaggcatattcacttggcagggtctactgtcaagaagcgtctattcttggcttattaaaatgccatcagaaatcagtcagcattctgatataacagggaattccttttatggtattcttggcaggtgatctcctgtgtcaacttaaatgtccccagggactgaaagctcagtgccacatgcagcagccattctattgttggatgattgtcacattagattgggactcattagaagacttttctgatatgagattggaaaatatgctaataatatgtacagtgatgcaggcaacttaaaattttcttggagagaaagagagggttgctatggtttgggaaaatgagtggggccgatgcttaccctttgtgaacccatttttggagggtgcagccatcacagcgatccaagaaaaatcttcctgccttggatgctctttcaccaaataactctggaaagctgatgagatgaaacagagtttcacaagggaaagtggagaagaagtttctgagagacaggaggatttatacccaccaattcaggaaggagctttggagtcatggattaaaagaacaaaggcagggagtccgacctggatttgagactaagctctgcctcttatacagggcatttaagctctctgggcctcagttgctccacctttagaatggagatgcctcttcctttttgaagacagtgggtcctccctcaattgaattcagtgggacttcatcgcttgctccacacagagctcctccccagtctgtcacattgagtgcaaaactctgcctaggtccatccagtcactcaacaagcatccatgggggaagcattaaggagctttagatgcactgggttctgtgagagcaatgttagtcttcatcttcttcactccttctcatcctccttccatggaacacccctagactccacagcctgcaaagctcattgccccttctctggagagtcctcctaattcatgtgcaaattttactcactagtggggtcatttgttgagtgtctgtccctacttcagactgtaaggttcatgagggcaagggctgtggctctttggtcctctgctgcatattcaggcttagcacaaagcttggtatacagcagtcatttaataaatatacattgattgaataaatgaatgagtgaatggtggggccacagccatgattgataccctttccatcctcaaggaggagatcacagacaagagactcagaagaaaactcatgactacaataaagagtaagaagtgctttgtttaaagcatccttggggtctttcaagaggtcccttgggtgaagtagcagattcagggtaattagggaagcctaagagttgatctttctgtgcctgaatggattgattattcaatagaagaaaagaaaagaaacaacaagacttaaacctattcaactaccctgtgtacttgaaatgtcatttaaagtaaaatctagcatggcaacttcaaataacaaacataggtaatgctggagagggtgcgccaagctggccagcattcttacgaagtttggctggcacagagcacacaagagaagtcatattattgccaaaaagttcttgcagtgggtggaacctggacaaagggagctgttctctcccctctaagtcttagatatagctgggaaaaacagacagagtcatgaccctgggttcctttgtttttggaagtcatgtggacattcttcttttttagcactgtttctttctaatgataaaggaaacagtatattgatgaactcctatttttcatttgtggtgctttctgaatgctttctttggaacccaaagtctcctcagccacacctttacaagttttatggttctgggtggaagcatgttttcagaaatctaagcctacgaggtattttttttttttttggcaggttttcactctcattgcccaggttggagtgcagtggtgctatctcagctcactgcaacctccgcctcccaggctcaagggattctcttgcctcagcctcctgaatagcagggattacaggtgcccaccactgcacctggctaatttttgtattttttatagaaatgggatttcaccatgttgcccaggctggtcttgaactcctgagctcaagtgaactgcccatctcggcctcccaaagtgctgggattataggcatgagccacagcacccagcctaagcctatgtatttttgttttgttttgttttgttttgtttttagcagccatggcatcatggttaaattcatgaggtacctttcaatggagatgatatttcaactttaattaaaaaccaaacaccttgctggcattgtccagcccaatgaactagactctgaaaatgattttgaacaataattcaagataaagagctccagccggttttctcccctttggaagccttcaaagtatatttttatagatatattaaagagattttgtccaaatggcacatacctaaacagtttaaaatgtttttatacccatgttcaaagaaaaagaatatcttgaaagaataaactttttatcttttataaataaggttaaaagcagtaattctcaaaatgtggtctctgaaccagcagcatcagcatcacctgaaacttattagaaatgcacattctggcagggtgcagtggctcacgcctgtaatcccagcactttgggagaccaaggcggttggatcatttgaggtcaggagtttgagaccagcttggccaacatggtgaaaccccgtctctacttaaaatacaaaacttagctgggcgtggtggtgcacacctgtaatcccaggtacttgggaggctgagacaggagaatcacttgaacctgggaggcagaagttgcagtgagatgagattgtgccactgcactctagcctgggcaatagagtgaaaccctgtctcaggaaaaaaaaaaaagagtcttttgatgctatgaacatcatctggcttctggcatcctgctttgcccgagaatgaaaattccagttccagttccagaaaaaaagggcattcttcagttttgtgtcccctgccaggtcaactctgaacctgtagtggatactcagcaactttgtgcactgaatgaatgaatgaatgacttgtaggctggtgtgggaggttaagagaaatttattctagcacataaagatcttctgatggagtggatgagggatggaaattggtgatcaggctggggctgtgctgaaatatgcaggcgggttatgacagcaagagaccgtaaaccctgaaaggatgaaggttctcctcacatataaatttgacacatggaaaaaccatgcagtaagcttaagggagcccacctcaattctgatttcttcctgataactatgtcaaagctcttaaaactgtgcaatgaaagatctccacgcattttctggcccttgtcttgccaattctttcactgtgtacctggtgtgcctggtctgctgaactatgaagcatactcgaacatcatacacatgatcttcctttttaaaaatgaccttgagaagataacaagtgacattctacagacagactccatttcttctcttttgtttgcaaaagtgtgaggctgaaggaggaaggaaagcttgggttacctgaccacattctcatccacccaccctcaaacaaatgccccacacatgtagaggatgtggttttctgactgtttatctccagtgagccagagctctaggtcccctgtgctagagggggcacagaggcattattatcacccagtcctcactgggtgagagggagaatggtgagaccattgtaggaagcaaggtggaatcaggggctgtgggccaggctttcgaaacttgcgcgaatacacatgcagaggtttatgctgctgactctgccttccaactttccaggctgtaggagtgggaatttattgagcatgagggatgctatcttgtgaaactttctacttcattcgggaagggtagtttgtctgtaagaattcaattgtaaatacaaaaataccatttatttctgaggtgagggcaggaaggagagatgtcagaagtagacaggttagggctttctctttggagacctggatttcaacccactgaaagtcttaacaaagaggcatgctagtatcattcttagcaagcccagtccattgttatggtcagattcgattctgcagaggagaaaatggagtgtgacatgtttggtgccaggaatgtgagcatgcacctgcacagccgatgttggtgtcatatcgtcagctgaatggtcatttagcaattttggccaactcccttgacactatagggcttagatggcattgctttctgggatgcactgataagccttttacataagccttttacaaagtaagaccttggtgccaaaatccttgctgtagaagatgaaaattttatgttatttctaggggtgctttcaatgttccattaagccactgaggagctacaaccaagcttgaccttgaggtttagtcttagggaccagatgccctctgtgtgtttcattatcttccagaggaaattgttgagtgtttgtaaagtggttataggatgaagggaacactcttttaaagttcctaattatatcttggactttagctacagttaccgaaagacaaaataaggtctctaaaaaaatcatagccaactttgggcattggttgtagactagagtgcagtgcaagggaaaggcgggacacacataacatctctgtggctacatggggatagattctggaaatgaaaggagaaattccagcatcctagggggtaagatcaatgctctagagagggaagagtcacttgcatgtaatacaagtttcttggagatacccactgccattgaattgagagatgtcagtattcctgtgggagggttatgatgtttgagtttttaaatatacatatgcttctgaattctacttgtgggttctcagaattttccttccattttgtaaattgcagtaaaatatgcataagatttaccatttcagccatttgtaagggtacaattcagtggcttttagtacattcacattgtgcaatcatcatcactatctgtactagttatttgcattgccataaaggaatacctgaagatgggtaatttataaagaaaagagatttatcttggttcatggttctgcaggctgtacaagcatggcacccacttctgcttggcttctggtaaggacttcaggaagcttacaatcatggcggaaggcaaagggagagctggtgtatcacatggcaagagagggagcaggagcaaggggacaagaaagaagtgcagaggtcccagactcttttaaacaatcatatctctcactaactcattaccactggaaggacaccaagccattcatgagggatccacccccatgaccaaaacgcctcccatcaggcctcacctccaacactgggggtcatgtttcaacaggatatttggaggagggaagacatccaaaccatatcaccatccatatccagaactgttttcatcttacaaaacagaaactctgtacccattaaacaataattccccacttctccctctctcccacttccaaggaaccatcattctacttcctgtctcaatgaatgtgactactctagttacctcctttaggtagattcacacaatatttgtccttttatgtatagcttatttcacttagcataatgtcttcaagggtcattcacgtcgtagtatggaccagaatttccttctttattaacactgaatagtattccattgtatggagagatctcatcttgtttatccattcatctgtccatggacactttgggttgcttctaccttttggctgcaacaaacatgggcatataagtatttgtttgagtcccagctttaaattccagttttgcctttaatgtaatttaacaactggcagggtttgagaagtagggcaaagatagccacaaatttagtccttggtgacagtgagtggcaacttctgacctgactacgctacagaagatttctcatctcataaacctaattaaattaaaaatccagttggccaaacccacatgcacttaagtcagacaatttcttaaaaagctcattagctgcaaacttgagcgctccaccagcagatggaactttttcccctaggtttttcaatacttggacaggaaaggtcttccaactttagacctcaaatggaagattttatcatgcttgccagtgcatcggttttaatgtcattggtaaaattatgcaaaaagcaaccttttaagttttatgatgcaatgatgtaagatttcagtgtcattaaacctcggcttgcaggaaggacacaggttttagggaaagttttctgacttcctgttacaactgctttccctcatttcagttataataaattaagccctaggaggaatatattgaacttttctgtatttttaatttgggcaaaatgagatgaacatcatcaacaaaatccaggatgtaggacaacactcctgcgatgtttggggaacacgaacctgcagaagttcacataactctggccctatagttatgtcacaggcctcagaagggaagagattgggcaattggcttgtagtaatcatgtcccagattcttctttggggagcattaaaaaatgagaattcagacactgtgtctatctgcatgagtcaagttttcttctgccctctcaaaaaaaagtccatgattgcagttaactttgtctatatactgatggatgcatgatttatagtaaacttatagtaagagggaaccctgttgtttcccagggtttcgtatgtatttatagtcactttgaagtgacctgatttgaaaatggacagagacaaactgctggggggcatgcaggtggttaataaatactgatagagacccccaggtggttaataaatactgacagagacccggtctttctgattagaggaatcacagtttgtctctgtgccccttgcagcgtgtttgtgtgcatacaaatacacacaaatatattcacttattattggaacgttggcatttccattattttatgcctctccatctcactttcttatgacatctgttttcacagattcctagtcctgattcaaatctgaattctctgcttcttcacgtaatgctccctatatctgccacctcagttgaatctgtttttcctagagacatagttgtttccctcactcctctctctggaggttgctgtttctgtttttgtttgttttttgtttgtttgtttgttttttgagatggagtctcgctctgttgcccaggctggagtacagtggtatgatctcagctcactgcaacctccaccactggggttcaagcaattttcatgcctcagcctccccagtagctgggaatagaggtgcacagcaccacgcccaactaatttttgtacttttagtagagatgggttttcaccatgttgcccaggctggtcttgaactcctgacctcaggtgacccacctgcctccacctcccaaagtactgggattacagacatgagccaccatgccgggccatctttgtaacccaggagtgctggacactctggcccttcattgcccttctgttcttgtagaaacctgttttctccaggctcctgccatccgaccaaatccttcctctctctgtccttcctgatgctgtcacccatctaagtccaggcccctccccctattcagggatggccctgtcctcttctattctcaacctcagctccccccatcccctttgagtctgtgtgcaggactgtccttgctatccctgtgtgtgtctcagaccctcgacctctaccaccgcggtgctcttcttcctgctccactttcaccagggatcccctggatgctgccattacctggaactgcatctcacctttattccgggttataaacttcagggtctcactcagtgagggtaatccatgtttctcccacctctcttttgcttccactacactcagtcttcaaactaattctccagccttttctccacatatttatttatttaacaaatactgattgagacactttgctactttcttggaatttcgtgataactaaaaatggacacacacccggccttcatagaacttgccatccagcaaaggaaagaggagagcaattgatcaaaatgattgcacaaagacatgtaaaattgctgctttgctaactgctacacaaaacagaatacctgtgggcagggaagtgacagcagagctgatttctgaaggatgggcatcccatgtgagcaggtgaggcttctgggaggaggaaagtgcttgtgcgaaggctctgtggtggttggggtgggaggaggcaaatggagaatgagaataactgcaagttagattcctggagtctagatgtggaagcatgtgaaataaagccagagaggaggaaaagaccagagctttcagggccttgtggactctgtcaaggattttttttttcttcataccaaaagttatggaggacatttgaggtgatttaaggagggattctctccgatttacatgtgtgtcctaagaattcagtccattgcacacagagtatggcttcatagtattgcacttttggaagcaccagatcctaatgcctgtaaaatcatagagatttttactaggtttccttacatgtgaacaaatcagttttactcttatctggcaatcccatgcattttattttaatgctataatcccaaataccaactacaaagcccctctttcttcttcctttctttcatcttgaatacatctctacttaatccgttgtttggagtcttggtttccagtgaatcaatttacagcatttttgtgcatgtgcttccataagtcaaatgtgatgtttcatagtgctagcttggtaatttaggggacctatggatgattaaatggctctgcagaaatattacagatatttttaaatgtatgataacaaaaatccttttttggtggcaagattatatattatatatatatttttttgagacagagtctcgctctgttgcccaggctgcagtgcagtggcgttatctcggcttgctgaaacctccgtttcctgggttcaagcaattctcctgcctcagcctcctgagtagctgggattacaggtgtgtgccaccacacccagctaatttctgtatttttagtagagatggggtttcaccgtattggccaggctggtcttgagctcctgatctcaagtaatccacccgcctcagcctcccaaagtgttgggattataggcatgagccaccgcacctggcctatatcttcttctattgagaaccattcatgacttaggaatgacaagaacatatcaactatacttgctaaacagtaaagagaaaaaaatcattttctttttcccttaggaaaacactgagactcagtctgagcttctggaaggctaaagcctgcaaaaacatgggcttttcaaagctcacagaggcaaggagagggaggcgatgggtcagaccaccactcaattttctgtagtgatggcagagctgagacccagactcaggagaaagctgatccatggcccttctatgtcttgtgttagttttgtgggatgacattctgcatgagcaattgattgtgctgctggaaacacaaactatgaatctgagtgtctatggagtttattcttgtgatcttatgaaacaagtctcctgcatacagatttagggacaggcatattgtcagcatgttgaatcagacttatgtatacatggtttacagttagcataagtgagggctaccttttcaagccaaaagtttttagttcctaccaaggtcccatctcataatcatctgtttcaatctcattatttcacagattgggaaacttagacccagagagattaggtgacgtgcttaagagcatgttgcttataggggcagagtggagattcacacccaggtcttctgtgtcctgtgctcttccttctccacatcactcatcctgtgtgcctggttatattagtccgttttcacactgctgataaagacatacccaatactgtgtaatttataaagaaaaagaggtttaatggactcacagttccacgtggctggggaggcctaacaatcatggcggaaggcaaggaggagcaagtcacatcttacatgttggcagggaagagagagagcttgtgcagggaaactcccctttataaaaccatctgatcttgtgagacttattcactatcacaggaacagcatgggaaagacccgcccccatgattcaattacctcccaccaggtccctcccacaacacgtgggaattgtgagagcgacagttcaagataagatttgggtggggacacagccaaaccatatcactggtgtctgtcctttcctagaacagccaggtggacttggaatgtcaaaaattcttcttcctttttccttggttttccatttctcactttctctccccgttccactttgggagtctgaaatgagggtggtgttgcttctctgcctgatctgatccttcctttatatcctggagatgactgttgatatgtgtagcgcttcttacattcagaagggactcttgagtaatttaaacttctagatcccatgctccctgagggcaaaggccaggccagacttaactgtttcagttttgcatttctctgtctctcactctggcccttgtgcataggtgttcaataaatgtttgttggcattgttattaataaattcaccaggacaaaaacattataatttagatgttggaatgatattatctctcaaaaaacaaaatgtcaccagattgttttgccttgggagttctcacatctatttttttcttttttgtgtgtgtgagacagggtcttgccttgtcacccacgttggagtgtagtggtttgatcacagctcaactgcagcttccacctcccaggctcaagcgatcctcctgactcaccctctggagtagctgggattataggcacatgctatcatgcctggataatttttttaaagttttttttgtagagatatggtctctctatgttgcccaggctggtctcgaactcctgagctcaagcaatcttcctgccttggcctcccaaagtgtattttttaatatagtggattttattatatgtaaattatatacttcaatttaaaaagtcctatgcctttgggatcatatatagaaaattgtccattttctgagaagggtctctgccttcagtaggcagataaaccctgatcaaacatgcagaatcattaattagggtcatttgttctgctgtgagctgagaagaatgtgtaaaacctgctcaggagagaattaattcatcctcctctctgtactttttctagtactcctagcacgattctctaagcctgcaggcctcatacatatgttctaatgggctaattgttaaggcgacatttgtagattaatctctgacttgagctaagtggtttctcctaatggctttaattcagtgactcccattgtcagattcactggaggagcttgttaaaaagaggtgcccagacttcccctcccccagctcatgatttgctggccctagggtgggatgagggcatctctgctttggaaggaaagctcctcaggtgactggattctggtggtagccacctttgtgagccttggctctgaatctgcctcccaaggccgtgaagcctcacacacccgctgaaagcatatgggcctaattgcagcaactccagtccaggttctagaacaggaaatatttctaagagccagctttcccaactcaatcacctctatactcacatcactgaatctgcctttttcctgaagtgctccatcacctgagggggaatagtctatgcttggctgtgctattgtccattttcatgaactttcatgaaccttgtcagacatttgaaagatcttcatggtccaccgggattttcatctagcgagatggctatggacttcccctctctcctccccattttgcaccaggctccttctttgcatcaggtgttagggacagatttttttttttttttttttgagatggagtctcactctgttgcccaggctggagtgcaatggcaccatctcggctaactgcaacctctgcctcccaagttcaagagattcttctgcctcatcctcctgagtagctgggaatacaggtgagcgccaccatgcctggctaactttttatatttttagtagagacagggtttcaccatattggccaggctggtctcgaactcctgacctcgtgatccccccacctcggcctcccaaagtgctgggattacaggtgtgagccaccatgcccagcccacttttatatttttttattttgctttttttggagacagagtctcacttcgttgtccaggctggagtgtagtggcatactcttggctcactgcaacctctgcctccagggttcaagtgattctcctgtttcaacttcccaagtagctgggactacaggtgtgcaccaccacaactgctaatttttgcattttttggtagagccagggtttcactgtgttggacaggctggtctagaactcctggcctcaagtgatccacctgtcatggcctcccaaagtgctgggattacaggcatgagccactgcaccctgcccttaaaaaaaaatacaccgtgtatgtgtgttcctggcattcttttgtgcaaacacatgtcttgtttgatcttggagttttgaaaatagatgactcaaacaccattgttccaatgacatttatcaaattgcttttgtttttaggaatctggcacaccgagtactcaatatctccacacagtatatgggtgttttcagtaaatctgagaaggtgacaattcatactgtccaagatggctgaggtaatttgttgagctcagactatggcaagtttagcaaccaggacaggctctcaagcaagctagcagaagtgccctaagaggcaatgctcaaattatctgtgtatcacactgctgcccccaagcccttgtgtgggacaatgctttgttacatgcttggttattgtcttattctatgactcagctgctgtagggcagggatgctttgctttctggggtactgtgctttccttggcctcattttaccatgtcccttgggcttctgtcctccttgtccctgaaactatagaagcttgcaaaaggattcccaatggcctcagcccttcgtgaagagatattagagtagtggtactatgtagaaaggaaggacattttgggaaaggagaggatattgagataagggccctactttttctatctttacccagttactaatgatccatctaggcaatagttcattttatattggctaaacctgtactatatgatttatcactaattgcataatagcatgggattaatctacagaagaatgactctataaaaaagagtatattttgccaggtgcagtggctcatgcctgtaatcccaacacttggggaggctgagccaggtggttcacttgaggtcaggagtttgagaccagcctggccaacatggtgaaaccccctctctactaaaaatacaaaaaattagccgggtatggtggcaggcacctgtagtcccagctacttgggaggctgaggcaagataattgcttgaacctgggaggcagaggttgcagtgaactgagatcgcgccactgcactccagcctgggcgacagaacgaggatctgtctaaaaaaaaaaaaaaaagagtatatttcatgactccaagtggcctcccatcttctgtttttcttgggccttatgtataggatatgttaaatacttaggtgactatttggggtgctctataataataccattaccatgcagactaaaatgtaatcattttgtgttttcaaacttagagttctcagacaatggggatttgttagagagatagagaaagagagagactaaactgacacttctaaggtggctttgctaggggcctagagaagacaagtctctgatggggattctattttcatggccacatccaaagtattgatgtgttttctgcagcacctggatctgggctgacaatgtgatcaagcctgacacgataaagaggcatttagcaagtttcaagactacgtgcacagttaccttaatactgagaggcagatcatctccccagggagcatttcatcgtacatcatggggcagtttgcctatcctgtatctcattgagaggaggccttccagctgaatacgtggacccaaatgcatgtccattcaacagagtcttcagggccagggagctgtggaggttatttccctcctggatttcttccctctcttaccctatcagagagatgctgatatttgagttttcatcttcagagggtagcaggattcctggcctcctcctgtcactggctgatttgcttaaataaggaatgcattagtccccatcactgactccaagtggaggcagctggagcaaattaggatcagctacattggccatctggatgctgcgaaatcattgccattgcaggggtcttagattttgagttccttacagaatgatgtagatgccatttgcaagggcttctttccagtccttttctgcaacagtggctttgggtggcataggcctatatagccagctctgacagatgctcagcattcacagatacacacacagggagccaaatggacagggattagtcttaaatcagctgtttatgaatggagaagaggcccttctcctgggttctggccacaccccttctctttgcagctttttgagaatgaggtcagggccaggatctaactgcttatgcctcagaaatagcagcacagatcaaaattaatcttaagctttttgttttgctgcctcctttagataatagaggaaaaagcgaaggcctgctcatgtttttgtttgcttgtttttgtgtgtacctttgaaaggaacatatgaatgaatatgtgtgatgggaggggttgaggtgaggcagctaagagggattagtgctgggcgggtgataattactgatagactgcagcattcaattggagcatgttttagttgtttttttttttaaatggcagaatgaaataaacctcagtggtgtattgttttagcacctccctttatatggagattttatcagttgctatgaaactgcatattccttttacagtgtccaattgtttttaatggtcattttctgggctgtgcaagccaccattctgccccaggagctccatgcagttttgcaatgctttaaatgagtatctcatgcagatttcattttctgtcagccactttggcacacataaaaaatacaggagtgtgtgtgtgtgtgggtgggtgtaaaagagagagattctgtctctcatacatacacaggcacacgtgcccgcacacacacacacacacacacacacacacacaaagcttgatcatgcttagtctttacataaattgggattcctctctacccaccagccaaggcctgagagatgtcaatagatggacactgaggagactgacttccaatgcccttcagcctgcagtctcttcagggtattagcatacctggaaaggttgacctagcagccaggcattgtgtgtaatggtggtgcttactttttattctcaggcttaattgttggctgaaagcatcttctttatttctgactatcctttatttgcattaatagtctcctctgtgaaagattaaagaaagtagaatgtgtactgaggacagaagtgtcagtgtcagcctaatctgctacatattcattctatggaccttagcatgacaggtatccactgaaggagatgccaaaactgtcttccatccatggagattaattttgagtgaagagtgtaaagtaggacaaggattgtcacataactggcctaatggattgcctaattgacttcctgaactggaactactttcctaaatatttcagaagtgttctaatcatatagatcatacatgcagtgaatatatctttatgtatgtccacacatacacacacggacatttgtacgagcaaatttgtgatcttcaaattggtatctcttatgtagtgacagaaagtagattagtgtggtctggggcttggaaatgggaaaggggattgatttaacaggcatgagggatcttactgggatgatgaaaatgttctgaaactggattacagtgatgattgcataacttagtagatttactaaagtcattgatgaattgtactttttaaatgggtgaatattgtggtatgtaaattatgcctcaatgaagctgttaaagttgatattcctctattggagttcctgcagatcctagactacatataatattaaaaattgtatcaccctaaattttcacctgcttttttcccactgaagtttatcaactacaattgcagagaagctggacttcgagataacagggtcagataaaaacccagtgccctgagacataaaaggctaccctgacccctattggcaaggagcgaggttgctgcccattgctgtatgaagagccaaacctgaagcagtaatggggggctggggatgagggtgagatttccaagcaggtccccaagggcaatgggcaccgtatttcaaagctgcttcggtatgtgtcaaaaaacccaaacatcctgaggtccaactcttaagtgatggcattctcctcttcttttacaggttgtcttagtctttgctctcagcatcggtgcacttgtaatatacttcatagattcatcaaagtgagtattcaaatatactttcttgccctcgtttcataaacaatcatgagcctttacattgatccatttatttaccttgacaccaacctttgcaagaccttctgagtgcagaagattttggaggaagctagtgctgtactgtactgattttctaaatgggaaagaaagttctcagaaggaaggctattttgagtctgctggcataggagggtgaggtatatgaggtcaagtcttcttgctgggtattacttatttttaaagagctgtttcctaatgatgtatttgcactgaagatgtcaagtagttaagatgacttgatgggaatttgcaacttctgggagggtgacagtttcccacagatgagggtctgagccattcttgctatggttgtaggatccttttctcaattgggtttccaatgctttgatcttactggaggtcagattagaaagcatgatgctatcctttcacctgccaatcgggtattcagctgaagcattgcacgctggtgcttcttgacttgtgaaggtaaggagatggatggaggagttcatcatgacccccagaggtggaggccctggccatttgaggacttctagagtggacactcatgcagactccttgggtgccagccgaatggactggtgctccagagtgagcctgggtgacagatgataaagaccttgcagaaggatgaagagggcacagactagaactgcaatgttgcagccagttctgccctgattcctgcaggtgccaaccctgaggaaataatttgttccaactatactattgcaaatcatgaagttgatggcatctgggaaacaagctggagtctaactcattttctgttgtggcgtgaacttggcaactctggtgacaatggccttgagcttgttgcctttattgtccactgtgtgagtgttttgaactttaaactctatccctggcatggttggctactagactttgatactaggaaacctgcttggtgtgcctgttggctcagactctggtgtgcctgaattctgagcttagtgctcctttcctgtggcttgggatggtggtaatttcatgcacagctaaactcagaatttctcagagccatctggtcaccggccaaggattttgtgcatttgggtggagaggccaaaatgtcagtcagggaaaacaaagcaaatatctcctttaataacctgtctctgggaatcagccaagtttaagcctatcagaggtccttcagcccaccccacatgcgaggctgggctgccctcacccatctcagatggagagtcctttaaacgctgtcaggagacaagattccacatgctccctccatcagctctcccgagccaagaaagagaagagcttgtttaagtttggaagactcccattggcatgtcattgaaggtaagcccccttttaaatatttactgttaatgattctggatcctatttgtattgaactgaagatcctctaaagcccctggtcttatttctccaatctctctccaggggtgttcttacatgtcgtggggtgcagaccctgccaacttccatgctgagactcaggaaagaggtttgggcttgaagcttgtatgtcccagagaaagaaaaccctaatgtggaggtgagtgtgttgatgggttagaagtccagatgcctcagccagcaccttccttcccttttcgtttttttattttttttatttttttaaccttttgtccctctgtatttctcagaaataaaatgctctttagatggatttggattgtgtctttttttacagtctactatgaggcagtcttttgttctgtagatcctggtgttctctgtttccgtgtgagaagatgaaaaggaatgaaattccccaatgcaccctcttcccctaatgtcctacaccatctcaatgtcctttggctttaattgtgatccttctaggccttggcgaagatggcactgggagtcctctctgattctggtttcttttatgaacttgcaaatagtctatcccaaggatggaacttcagtcctgtcctcaccttttcctggcaaaaatgcccataaggttagaaacaaggctattcccattctgcctgaggactgtcgtagcctcatcccagctttagcctttcttctctgttgctaaactgtgtgatttggcatagcaaggctttgtttataagaagaccttctggttatttatatagaaacttttcattttcatgacttcattttgttctgagagcatatccgaagattctgtccggtggcaggcccaatcagtggattcagcacaagggagttttccatcttccttgggaaagacggcaagcaagctcagttttagtttgggagagaattagtgtagaatctctaaagccatctctatggtaagtccatagatttccaggaataaaacacagtgaaacctattaaaaaattataatcgagcttagtgaatgagaaaaaaaaatgaagttctatccacatataagatgcaaatggaaagaaagtgagaaagtagaatgtacattcttaaaatccatgtctttcattcaaaactgttaccagttttacacattcatggtttggctggccatctgggtattttggaaagacagctttaaacttctcgtggaagttatactaaatcatcaccctggaaaaaaagcacccagaattctccagatgaattgtagctagtatttacacccttcaaataaatgaatcaggggacagtctataggctttcccacaagtgaatctaaaccaacagacatgcgtgaaatggcttgtctcagtgaattttagccagagctgcccctcccctccagaatgctgaggactatcctgtagcacaagtttgagattccaggctctctgcacccagccctttgaaaagtgcaaggaatgccgattaatgtataaaacaggctccctaggtctgctggaccagctatgtctcgaggcaggccagctccagttgtgcaagtggacaagcaggctaggtagttattttacttctgtccattagcaatacagctcagagaaaggtcatcattggtggtttatgatctttttaaccttttaaagctctttttactatccagaggtgatggataagtcacttccaaagacagctgcacacctttcatttttggccattaggcaaagacagatcccagcatagggcgttttctttgggtctgatcttaatgaacctagggtggttgtgagggaagactcatttgtgtagctgcaagtgattactatctggctaagacagattgtcctcagagctcctggaattgaaaaccaaagataattacgttaaaccttactaaaattatgctttatcatcccagcagtagactctctagaaacacccaagcagaggaagatgcctctggactgagtctttggtcagacatcatgttagtgccttaacaagcacagacaagcattgagccctccacacaccatctccccaaagatctccaattagccacacgaggtggattgtgtacaaaaagctccctttcttttgcattctttttaaaaggactcctgcccaatttatgtcacacgtcactttagttcctaattctgatgtctcccgacaccaacgccaaccctgtcctcccacatattctgatccttgtgaagcaaagattttttagaaattgtacaaccaagtcaagagtgcctgcagacgccctgtgggtgctaatgtcaccattgctgcttccatccttgtctatttcctccctttgacacaagaacagcaattcttatctaacagataaggaaaaaaaacaaagacccaccagtgtcagcatgagagcgagattcatggattgcataatgcagcagtccctgtagctttcagaatttcaagagaaagttggaagagacagaggcccagagctctgggtatttgcattttcaccaggggcattctgggaaaggatgactcacatgtgtgaagatatttattcctttgattcatgtttaaacgctgctacttcttatgctacggttacgcggattatgaatatttaatgtggcgtatactgaaaatgaaggtcaagtcctgctcactggtgacttcaatgcaggctcttgtctctgaaagggaagctacctgctgtttgcagagtaaagctgaaaggttatacgttgttaaatgtttccttaatgactttatctgctccaaaatggctggcacacaatgggggcacttgctgattttgccagtctttgctcttggcttctggtatcagcactgctgttttggggatatggacgttaggaaggagcaggaaatggcagcacaaattttgtagagcatctcatccaagggcacaattgccaaggcaacagtggggttacgattggaaaatggcctctccccagtcttttaaaatgttacttttgcatccactcacccatttattcattttgtattcatttattagtttgtaacatcttcaaatgtgataatgctgaatattttccaggcagtaaaattgcttatggttaaggaaaactatctttaagattgcgatagaaattgaccagattgttttcatagtctctgaaaataaaactggcaccattgatgtattggggatgtccagagctttagcagaactggtttagttgcccagtagtttctccctcccctgtcttcacatagcctggtctctcatcccttggcctagaaattctgtttcaaaagggaagagagggcaagtcgttggagggaactaacattcactgattatgtactgtctgtgagctacagagctaggcactttaccaaaaatagcacatgcaacctcattgaattcccctaacaacttcttaggataggtattactattcccacttacagatgaggaggctgaagctgcaggcatagcccaagctatgtagctagtaagcagtagagccaggattagattccagcatggctcattctaaagccatctctcttctaagtgtcaagaagtaaatttccagattgtgtaagtaactgatggggtttaatgagatgttgcaagaatgggaagttgcatcacctcatcctgccaatgcactggtcttgttttctcttttgttctccctttctccatttctcaccctgagaaccaagtgtgcagttgtgggtacgtaggaggctcctatcacaggccttccatgtaagacactgccctgggtcaggtgctgtctgatgtctgtttgggccttgattcagttcttcctaataatggcttgatgagaccagcttctctgttatctcagtggagtggcagcattttgcaatgagataggatcaaatgaacaaaaaacaaggagagctgattgttcctcattagcttccaccacctaggggtgtctttccaagtagaaagactctttggccttcctatccttacctaatctgtccttgtgatttggcatactgaaatagatatgagaaatgctgtttccccatgagatacattcttttatctcttttagagagttacagaattagttgatttgttatagttttgcattatgttatgcaatgtttatatgcccagagagttggtattatcaaactaatggacttcaggaaaatttggccccaaagaatggagccacataggatggaggtctttgaaatgtcataaagtatctggcttccttctccagccttgttcaaactgactaggcacaggtgtagacccactgcctctcctgtgctcagccccaagacaggcacctgggagagctgtgaggacagcacagatcccatcccattcatgacagcgcattttaaactgtaaaggactgtgtataccagctttcactatcccctttagtgtaccccatcctgcagcatgatgagatgggcagcctgtgacatggaaaaggaagctcaccagcctactctgtaaccagttcctttatgaaatacagcctttctaggtagtgttctggaaaattagctccagctgtctgccttcatgcccttttttgagaagtcacggcatgcatttaacctttgttgaagaagtcaacacaaatcactgtgtgcaaagcacctccctgtttttttttttccttttaaaatactccccccagttttctccatccctcactgacatttttattgccaggctttggtttggaaaattatgggtagggaaagttcaagggcaggatgttcagaacggcactgcacatctgtgaagggaacacaacaggagagccagcagctgttgaaagaatggaatgtcagatggtagaggagccgagcccactcagggatggtggaagagaagatgccttcagggcaaagaggctgtaaataactccaatgggaagtcttgtctcccttcagaatgtaccctttaatagcaacacttggtgctctgatatgagagtaactctaactcagccttcctagctcatctgaccttccatattgccatttgttcaggaatcgagtgaaagcctggtagagaagacaggtggagagtatgccaaggaacagagtcaacttctttatatgtccttgtctccatataggtagattttggggacaggatctgttctttggttgtcaaacagattggtttcatttacgtcaaagttcagagcattagcacccttcctccttctcccttccacattggtgaggaaatcttgtcttccttgcttatttgtcattgcacaagtggtacctaggcatcgtaggcaatggcatctagaagcattaagggaactgcttatctttggctttcattggggaaatcagggactatgctaggaaaggacaggaggactgagctgaacctttcaggtctgccacaaaagacaactgtagaatatagtattagagtcaaagaggcattggatcccaactggtgccactgttctctgagcctcagcatcctttcctgaggaatgaggatgagggacctcctcaaggtcatccgaccagccaggggcagagctggagctggaagatagaacttttctctcccagtccttttctacttgatctcctgggttctttctactaaatacagaaatgaacaaagacatgataacctactcattgaatagcaaagtatatattgtctttttatgccaattctggacttctaggcccttatcatgggggaaactttagggccatgggaaagaacaaagataatcccaggtggaaaagatcaaatccagccaggtggctgcgtgggattagtttatttcatcctcactggtgagaggccttgaattccttgattttatgaccctcctactaatctctctctctccctccccactgtctccctctcttttttgtactgtttcagcatggagttggggatgggtaagagttaagagttcagctccactgtggaagggtaacacagggctgaacgcattgaagagctgaacacattgttttggcctgtttggaatttgttatgcataacttttgaggacattttgcccaattgctcacttgtttcccctgtggaaacactatctgataactatgtctatacatccctatctactttgccttccaaaattaggatgaattatttcttcccttctcgccactctccaaaacttaaaaagaatgctttggacaacctggcactctctcagccctctcttattctttttaaaagaataattgtttcagggcaaatgaagaaatgcattccctttcagacccactagcccactagttacttctgtcctctacaacaagcctgagtttataccgcaagagggctgcatctcctccctgtcacatggcactgggcctttccctatagtcacaggctgacatgcattcagagactgctgagagatcaggataggagccagctggagcgaaatgttatagctcagaacagtttaatccaaacacaagggcagtgcttgtgcctaacacaactgtggtaggggtgtggtgtggtgtgtggagtggtggcagcttttacagctttatcatggggttcatgggctggaggagatgtgaactcttccttgtcttttaccccttgtcttttgacctgacagcctgacacatgtagctttggggagaccctggttggtgatgagtcatttgtggcttaaaaatagaactctcaaagcaacaatgcccttgggactttttgatgcatatgtctttgttcatagaatttgggagaaaagagagagagggagagaaagactctgtgtgtgtgtgtgtgtgtgtgtgtgtgtgtgtgtgtgtgtaggaaacaattatgtcctgcctaaaaattaagtggagaagaagagcatgggggaattggccaccaggctcatcacagtagcagagatgaggctgagagctgtctgtgtacctgtggccttaaaggtaccaatcagataatagctctccactgagtacaaactgtgtataaggcattttgctaggtactggggaattttgagtacttatgtataatgctagatcttttccattaagacatttaaattatacatatttttacaaggggcaggaagtccagccatatataaaggaaaaataagataacaaaacaagaacaagtaaggcatcgctaagcaatatatcaatgactaatatgagcattgcacacagtaagtgctgaaggttgaggagttgaaaagatagctggatgctataacatgttttggctgtaggggagattttgagttgaatagacagaaaactcagtctgccctcaactctaggagtccacaagagaagactctcattatggcctgtactcgggctttgtgattttcagtatacgctaaagtcaagcaaaaccttgccttgaaatcagctactgagattagggattgagaatgcttcagggacggcataaaataatcagagaagcggactctatccagtggcagtaatacctgttgtccaatgatagatgattaaaacttttggaaatttttatttggaaatttccagaagcatctgaatggcatccactccatctttttgaaactgaggtcagtgtgcgacgtgctttgcaggggtcttgttacgaacttgccacatacagagcatcacaggggcatgatggggaggagagtctgcagtaaaatgagcttgtgctgctcgcaaacaggccacagtgtgggcatggttgttggcctgaagaccagcatttgcctccagctccgtgctgtgatttccatggactctaggtacgttggctttgttgagccaattcttccataagaatattaaatattatattttgcggctgcattggtataagaatgaatataatccaggctggatttattattgttgttattattactattatttttagagacacggtctcactctgtcacccaggctgaagtgtactgacatgatcatagctcactgtaaccttgacctctttggctcaagtgatccttcagtctcagtctcctgagtagttgggattacaggaatgcaccaccatggctggcaaattttttttttttctttgagacagggtctcactctgtttcccagactggagtgcagtggtgcaatcatggctcacaacaacctctgcctccagggctcaagtaatcttcctgccttagctttccgagtagctgggactacagctgggcaccatcatgcccagctaattaaaaaaaattattgtagagatgggggggtctcactgtgttgcccagactggttttaagctcctgtgctctagcagtcctcccacctcagcttcccaaagtgttggcattgcaggcgtgagccactgtgcccagcctggattcgttgttattattcgtcatttattattatatttattttcttctgattttaaagaagttaaaatttagacttttttgtgtcccataagtacagtggcctcaggcactgtgcctgcactgcctgctggagaaattgactttatttctccctttccaacagccccatccttctggaaattttcacagataagaaaacatgctcagagacagatgccttatactaaaccccttcaatgtggtctaattgtttcaaatgagaaaattaaaataagcattttattttaagccctgtctgataacttggctttgggaaataggaacttcagcaacccagcattcaaaacaatggatacaacaaaaattttaagacaacttaatagtcttgcttttctcccgagttttggaaaaacatgtgccttttccattcttttatctgacaatgagtcttactggtttaagagatctgttcgctgagagtgcaacagtacaaaataacatttttttcatctgatgtttgcaaattcatctggacagggaagggcagacattggaaatgagtgaggcggatctggtgaggactgcaatgagagctgaagcctcacctgaagtggcttcccaggtccagctgattgttcctatgcagaaatgcaggctctagtggccagatcttcctgtgtttcaaagaggagacagaatactgcattttatgttgaatctccaattttaaaatattggcctcaaatccaaaactcttaaagtacttgcaggccaagcaaaacacctctgcaggccagatttgggcctcctgttttcagcctctattctaaactgtctctctttctggtcttgaattggctgtgctccctgagtgccaggaaacgttcttaacccttgctcctccatctgccaaaaaggaccccttctctctctaagatgggaagcctttggtctcagggtgccccgggtcgtttgccatctaacacattttcaaacactgcttaaatttccatttttctcgaggcaaatactgtatgccacaccaataaatcatctacagcttactgtaagccccagagctacatatcactaactctacatcatctctgaaaataacgttgttagaagctcataaacatacactctgtttgtttaagaactgcaagagcttttaaaacatggttgctaagtcacagggcatattttccaggacataaatggaagtgaacatatgccccttaaattgtcagattctttttttataagaagagaggcccaaatctgtctgttctgccaggatattaacttgaccaaagaagagttgattatactaagtgtgtaagtgttagtaattattggaaactatcctctgacttacttagctaaatgggcacattgtatgaaacttgatttagtttctagcatatgtaggtataaggtacaggttgacatggataaatcctggctttagttttcatgaaccctaaagttcacaatttgctgaactttgtatttaatatttactgatgaaattcttacggtgtcgtcccttccaaaacaaaatcggaggcatacttagacttttcccctgagacatggtcccaagtctaggctacaacttcatcactgaccctttttcatggaaatttggcagttagtgataggtagcgtctgagcttatagctcagatattttcaaagtaggaagtagatggccctattaatatcaactgccatttcagtagagctgcctcatcagtctcttttccccgtggaagacactcacaccaccttttacctatcaggacactctcaggaagaaatagtaggtagggctccaggacctctgatggtggaatctactagaatgcagttgtccttaacaaggatacctatctcatgttgctcatcacacccatgcagagacctgccaccttgtaatttgagagctggaatttccatacacccgctaccctcactccatgccagaaaatgcagaaaatgaacccatggcccagtttgagatacaattgatcttgaggccccagagagaactgcagggacagtgtgcagagaaggtgaaaataacgtggatgctattagatgactgtacctagcatgtgcttttcctctagcagtgggaggaagtggcacaggagtgcattaaggagtttgccctcttcataatagcatgagtagaaataataaggcaaggcctttaaagaacagcattaataattgaaaggtgctccaggcagccatgtggtcttccagtgcctttgagtacaatctgttatcaggtacgaggtgaggctgaggagtagacaaggagggtgcatttggcggctgtgtctgtgtgcatgcatgtgcttatgcttggaggaagtatgaataagatttggcagctacagcaagtaaaattatagaaggcaatgtatgtatattaccatgtagactggtggtggttcttttgtgggtcaaacacccatttgggaattggatgaaagctgcaaaaattttgcctgccaggtaccctatagttggtcaatgaaacccaaactaaggatttctattctcttaagatggattcatctgctcattcactcctgtttcttctgccatgaagatcaggtgactgccagagggccatcttcaaacccgaaggttaagcagaggttgactgggaacttttccctgcatgacatacaaaacatgtctaagtgaaagtctctgctgtgttttcccttcttgatcaagtgtcccttaacctgcaatgcattcaaaatctcaacaatgacaggtgatgctaaggaaactctgggagggaggccctgggcttcctacctcttcctccaataacagacaacactaaaaggggtaggtaagacaagatgcatctattaggccaagcctaagagctctttgatttgcttctcttgtgtattgtgggttagcacttgtttgtagaggacaaattcctctttaggcaatgattccaggatgcaaacaatctccagccaaaatcattccacccgagacccactgctgttgcaccaggaactagggaccactgggtacccaaacagatgcaaaagctgccacttctgtacaaggccgtatttctcaccctccattggagaggaagaggtgagtgtagagagtcgccagggatctctatgggctcatccaatcagtcttcagaccagtttgacagaaaacagaagaggagcttcagcacaaggaggcctcatctcatctgaattcccagcttccttcagatttcttcctgacctcacctgcctccaagccagccgactgtgacagtttaattggtgcagggaaggcgaggcagtggggaggcaggcaggggtgcctggcattctggaaggagactctcctgagatgagtgaggggaaccgcaacagacaggcctgagagcgctgccttcgggtagaaggtcacagagctttgcttgaaaagaatgctggctgaagaggaaacattgccaactccctcctctttgagcccactgggccagaattgtatattcatatttgtcatctgtgccctttccactctggggcaaaaaggtctgctgggcagctctggcggggaatgaaaatgggtgggaatgtagctgggcagggtggctcacatgaggtaagaggatcacttgagcccaggagttcaagaccagcctgggcaatgtagtgaggccctggaaaatgttttaaagattagctggtcatggtggtatgtgcctatagtctcagctactcaagagcctgaggtgggagcatggcttcagcacaggagtttgaggcagaagtgagccctggttgcaccactgtgttccagcctgagggacagagtgagaccctgtctttaaaaaaacaattttgcaaaaagaaagtggggaggaaggagcctagtggtgaacaccagggtttggaatcagaccagaccttcttggcttacttggctctactactttgtagctgtcctgggcaagccagttaacctttccaagctatgaagtctttcctttgtcacatggggtgaaagtggtgatgagagatgtcatagtggataatacctacctgatagtagtgtgtggaaacaattagacactgcatggaaaggctcttagtacagtgcccagcttgaacatgaccaaaaaaagtattagatattattggtattgttctttttgaggtctgttttgaaacttttaatcaggtcttgagagagatgagatataaacacagtgaagttaagaaacaaaataagatgtattgtaaggcagtaaagagatcggttatcagaataatggacgagacctgtgcttctgaaaactgcaatctcaactcattcatggtttgtgaaaggaaaaacaagcatttaaaaaagatgacacagctgggcatggtggcttttacctataatcccagctactcaggaggctgagtcaagagtatggcttgaggccaagagtttgagatcagcctgggaaacagagtgggaccttgtctctaaaagtacatacataaataaataaaacatgagattgatcagcccaagatggaaatatagctagagaagttcaatttgattttatgaaacttttgtttccattacatatatagatctatgtactgtataaatgtatatatactgtataaacgtatgtatactgtataaatgtactgatttgtgacgtaaactctgtttcttactgtggaatttgctaaaaagcgtttaagaaacactagcttttagtgtagaagccagcatacttgctggttgcagtaatccagggaactttaaggaaggatggcaggctagagttgggtcccaaggcatgggtagaatttggatgctgcagaagaggggcatggggtgagcagtccccaagaccatcctccctctgacatcaactgcaggtttggcacgttccccaagtcaccttcaggttcgataatgcataggactgcagagctcactgaaggctattatactcacggttacaatttattacagggaaaagatacagattaaaatcaaccaaaggacaaagtacataggccagagtctgggaaagatccaaatatggtgctttcattatctcctccatgtggagtcatggatcgtgttacctcccagcatcaatgtgtgactacacgcaaggagtactgtcaatcgagaaagttcgcccgggcctcggagttcaaagtttttactgggactggatcatgtaaacttgaatgactgccctcatggccagcctcagtcccctgctcccctggaggtggatggataccatgtaacccaaagcctccatcataaatgacattgttagactttctggcatggtcagcccctacccaaaataacactgttactatctggccagcccaagacccctggaaaagacacttttatcaggcatgacactccaagggcttagacattgcctcccagaagctcaggacaaggccaggcctctctttgggcaaagttaatgtctttacaaaaatagtcagtgaagggactttgttggctggaggagaggcctctcttgaggaaggctggaagtgggtcctttgatcacttgcatgaatagcagaggagaggaaaatgctactccatgaagtggatgcttccagattctactaatgtcaacaaaatccctgttgaaaacgaagcgatttattccttcccttggctcctctgcatacccgggctgaataacctgttagccagtaaggggaaaatgaggcacaggaaagaggaaaggggtcagcctggatgtatgcttgccatgtgggtgagtgaccttgggcataatggacctttggttagatctcatttgctgccacctccgggtgaccaggacttttcctgtgccttgtttctttgcagacctgatgaatggtcctctgtgtgcccgtgacaactttagtaaggagaatatctgtctccctgctccaatttaacttcctttctgtaaaacttgatgaggtcaaagccagaaagcactgaaacttcaagctggggatcaaaagcatgtcatccagccatgctgcccccttgcaacctggcaaatgagacaacctccagccagggacagtttataattgtgcaatcaaattaacttggatttcagcctaatgaagtccttaatgccctgaatgaggccaagccctaatatttagagaagcagactggaccccaggaaagaaaagaacaggcttcagttaatgcctgctagtattaattatgcttcttccaaaattcatcttctcgtaggaggcaacctgatagcacccagttctgctaaggggttttcctgctgtggctcataaggagaacagtggaaagaacattttattggaaatctctgctgaactctgcgttctgggccacatttcttaacttcacaggatcttagctttctcagttgaacaggaagaaaattcctcctctcttagaagtgttttattgtagttaaaaatcaatactctgaaggcaggtaggcttggttgcaaatcccaactctgtcatttgttagctatgtgaacttgagtgagaaattaacctctctgaggcttagttcccttaactgtaagtatggttaatgatattcttggttgttagtatggagaatagtgaatgagatactgtgcatcaagcacttaatacagcacataggacatgctggcatttattaaatctaatgatgatgatggcataaatgtaaaataattttcagtatggattacatgtcactaatttggtatcagtagtctttattttcattaagccaatgatttagctcttgtttagaaaattgctgctgattccgtaattaactcaataaatatttattgaatggctattatgtgcctgacactattttaagccctaagcacttacattccagtatcagaaagagacagaccgtaaacaagttgacaagtaaataagataaattcagttgatgccatgtgctgggaagaaaataaaactggtaatggaaaaagcagggtttcttaaatgttttgtgctgaggacttctttggcagtctggtgaagactatgacccctttctcagaaaaatattatttataaaggcataatataaaaacattggattataagaaaatagattatgttaaaatcagttatcagattataaaaaacaaattatgataaagtctgcttgcttcttgattagggcatttttatgaagatccagcaataattctaatataccaccatcattttaaagtaggattaatataagtaatactttgagatacctgtaacaattgtaatcttatatgtaaatatctgagatttctgttgctaaaaaaagttacaagtgtcattaatactgttctaatttattgtagaacacctgattctgtcactgttcggggtgccacttgtaacctgccatgatccctggtggactgaacaaagtggggctaactggggaataaaagtcaaagacaagagagtatatttggaagaaggggttgggggcacctcgcctctagtggacaagggccctgagctgtttcggtcctccgaatttattaggtaaaagagataacgagaaaggggcaggtggttgtcggccagcagtttgaatcacagcaggcttgcaagactgcattcttcaaacaataggcactagatttcccagtagataactttaaggagcccagcaaacctcctggcccttagcaaacctcctggaggcatgcgcagtcctgagtttgctcacattctgcattcacgataaacagtttgctgtttgatcatatagcctccagtggaatgctgagttggtcatgtcccatgggcctttggctccctacagtttattgctatattcataattaaaggaaatgccaaatttgaattagaggttaataaaaataaagatgtaatttttttggtccaaatcatggactccctgagtactgcacaaggacctcttggaagtatatggccccaagtgaagaatccttgggatagagaatgacttgtattgggcattaggctattactttagaaagagtaataatgcaatttccacttttaaacagtcattctggacatatagatcagtggaatagaattgagagtccagaaatacatccagtttttatagtcaactaatttttgagaataataccaagaccatttaatgaggaaagaatagtttttccaattaatgatgctgtccagtgtgggcaacatagtgagactctgtctctacaaatttcttttttaaacattagccaggtatggtggcacacgcttgtgaacccagctacttgagaggctgagatgagaggatcacttgagcctgagaggtggaggctgcagtgagttgtgattgtgccactgcactccagtctgggtgacagagtgagaccctgtctcaaaaaaaaaaaaaaaaaatggtgctgggataactagataggcacatgcaaaataataaaattggactcttcacatcaattaactcaaaatagatcaaagatctacatgtgagagcaaaaacatttaaacttttaggagagaagacggggtagacctttgtgacattggatttagccatgaattcttaaatatgataccaaacacaaaagcaacaaaagaaaaagtagataaattggacctcatcaaaattaaaaacatttgtgtttcaatggaaggacattacaaagaaagtgaaatgacagcccagtttaaaaatggtcagtttatgaatacatctctctctaaagaagatatacaaatagtcaagaagcacatgaaaagatgttcaacaccttagtcatcagagaaatgcaaatcaaaaccatggtgagataccactttacacccatttggatggctatacttgaaaagacagatcataacaagtgttgacaaggatatggataaattgcaacccttgtggctgctcgtggggatgatgtagaatggtgctgtagctttggaaaacagcctggcaattcctgaaaaactgaaagacagagctaccatgacatgtacattccactcctaggtatttacccaacagaaatgaaaatacatgtccacacaaaacttgcgcttgaacattcataacagcgaaacaatctaaatgcccatcaacagatgactggattaacaaaatgtgatgtgcttatgcagtggaataccatttggctataaaaaggaatggagaactgaaacatgccacaacatatgtgtaccttgaaagcattatgctaagtggaagaaactagtcacaaaagatcacacagtatatgacttcacttgtgtaaaatgtcaagaataggcaaatatatagagtcagagaatagattactgactccttgcttgtggggagattgggggttgatagctgaaggctacagggcttctttttgaggtgatgaaagtgttttaaaattgattgtcccattgaattttaaacctcaaatgggtgaattgtatggtgtagaaactagaactcaataaagccattagcaaataatgactgtgatgtggagaatagagttcagggaaagacaaaagcaaggaaaatatttgggaggcagttttcttaggtctcaactgagaggatgctgccttgggagaggtccgaggccattggggtgtgagcacatgctggaggcgtcacagacagagcagctgtttagttgaaaatggagaggaatcaagagtgactcttaggttgttgaccataacaggtattttcctcctagaaaagctgagcttcagttacaatctgcagaaatgctgggaggattagtggcaaacctaaaaaaaagaaaaacactagaagcttatcggagagttggtttgcaaagtttcactatcaatttcattgtaccttttagcagggaaaaatattcatcatacatgcacacaaatttacacacaacttcacatcttgaaaagcaacaatataaaactcacacgctttagaaagccaagccagggaagaaagaatgaaccccctgccttgtgacttctcatgctgatactcaatttgttcagtggaaacggatcagtgagtagagcaagtaggaaagaatctcttcaagaacttatgtatcttcgacatgtccatcacacataattttctcctagtcacatgtacaaatgataaaggagaggaaaatgtcatttcagggccttgagtatcacaggattttgataatgttagcaaaataatgggtaaaataactgatttctcaattaaagcccaagctaagtaacttgtcagcccaggtgtgttaaaatctgagttactctaggtccttctctagagacagtgtggcttcggtaatgagcaagctctggaaattaaagaagtaatcagatgttgattgaggttatctgcttcacttcaagcagaagcaaatcaagtggacttcccttgaagacagaaatttctctattgatagagctaagggtgtttcatgatgctgaattctttgtggctccttttcacataaaagtaggaagccattttccctggagtggaagggaggatgacttcccaggaatatgagctttgagccaaagaggcaggaactgggaggctctcagttacacttgagaaagaattatttctctcaatattgttcttcttttcctccagagccccagtgtgagcctgggtgcaagctctgataaattaattgacagagggttgacttctaaccccaacttcaccggcaaactttagctatgtaattccgcactggacagactgacagctcattttcctcatccacaaagaatgcagtgcaatagagaacttgtgaaatatcttctaactttaccactcttttgttttcttaatcctggcaaaattcacagagcataaaagtaactattagccattttaatgtgtacgatacagtggtgattcgtaccttcacaatgttatgcaaccatcacttctatttagtcaagacatttctgtaaacccaaaaggaaaccccatactcatcagagtcactccccattcctctgtcctcctaggccctgacaaccactgatctgctttctgtctctatggatttacctcttctagatgtttcatctaaatggaatcatatatttgcgacctttgtgtctggcttccttcattgacataatgctttcaaggttcatccacgttgtagcacgtatcagtacttaattccctttgatggctgaataatattccattttatgtctgccacacattttgtttatccattcatttgtcaatgaacatgtagattgtttctaccttttggctattgtgaataatgctccaataaacagttgtgcacaagtatctgtttgaattcctgttttcaattcttatatgcataggagtggaattgcagggtcatttaggaattcaatgtttagctttttgatgaatcactaaactattttccacaatggctgtaccattttacatttccaccaacaacatgcgggggttgcaatttgtccacatcctcgccaacttattttgtttttgtttgtttgctttgtgtgtgtgtacatatatatatatatatagccactactcccttggttcgtctcagggagtatgctccacctacagcggcagcttcagggatggccagcagcacaatgtgggaagagcacaggctttggactcagaccgaggtggggttcaaatccagatctccctcttcccaggaaggtagccttgggcaggtgataatctctgcaaatcttggtttctccatccatacaacagcaataatatactggggtgaagagatgagtgaagctcctggcacatgcctggcagacagtaggctgaacaaatgctcttcctcctcaattatggatagaaacagagaggaagagatggattttaaacaatctgcttttaaattattgttactactatttttggtattggacctcattatagaaagttttttttttttttttttttgccatgggcttctctgcaaaatcatgcctgattaaattaatacccaaattgcaatatgtttattctttagcccagtttatggggttaagggagatggatctgcatggtaaattgggaagatttactgagctaaccattgaactagagattcccaggtggatgacccacctttgcttttccatcgtgtccatatttcagggtggacttgaagtagtcattgttcctcaagttccttcaagaacatggacttcttattcatcctagaaaacaaaaacctcttggccacaaactgctttgttagttttgtatacactgtgttacttgtgatggaagcacacattccctatgtaaaacttcagccacatctttcaaataacactaacaagttccagtgatgtcgtattcatgctgaattattcttttcttggtcccaagcaaagtaggttttcacgtagtgagtgctgaggatacctccccttagggttggcgcccatggtagtgagggctttggaccaatgccacatgactacaggtggctcaagctggaatttctgttcactgaatgtggtgaataatgagggagggaaagagcaaagcagtagccgggagagtgtttacactcagtgccccagttagctcagagcatggtaggccaagaagacacttgggcaggctcataattttatgtgccttcaaattgatatttgttatgtaagtattcaatatttatttagcagagaaactaacctttgtgttggggaagcggaggaggaagaaaactgttgtagaggtggctcagggaccctggcaagcctctttagcagttcagagactctttgtttatctctgatcttgtccttatgggagctttacctcctcacacctggctttttatagtgctcttctcgatcatgtatagtgagtgctcaccctgaaaatctcatttttccatcttgttacttttccagtgatctcctggggactttatagattggctaccaggaaaccgagtggttggcttaccccctaattcatctctggctgagagttttctaaaagatattttaaattaggccgggtgtggtggctcacgcctgtaatcccagcactttgggaggccgaggcaagtggatcacctgaggtcaggagttcgaaaccagcctggccaacatggtgaaaccccgtctctacgaaaaatataaaaattagccaggcgtggtggcacgtgcctgtaatcccagctactcaggaggctgaagcaggagaatcacttgaaccctggaggtggaggttccagtgagccaagattgcgccactgcactccagtctgggcgacaagaacaaaactccgtctcaaaaaaaaaaaaaaaaattaaattaaatgcttgctttttggcaggcgctgtggcccttgtaagtatcacctcatttaatcctcataacatcttacagggtaggtagcagtattacccccttcttacagatgagaagaccaaggcacagagaggctaaagtatcttgcttaaagtgacagctgggaagtggcagaagtactcccaaatggctaatagaaattagccattttatgtgaacaattcagttcaaatggagcattttatcccagaactttaccgttaatgcctgcatttggcttgggcaaaatagcataacacttctttccaaaatagtcaggatttcagacccctgataatgacagagaaatgaaagcagtttgaggacagttttatcttaaagcatcatatgtgctaaacctggtgatttatttctgagttaagattggtataataatgaagtactaatgaagtactaatatccataatataaatatttctgggaactggtgggagctacccatctacaaaggtggttctgttttatttggttcccagggagtatagcattgatgtcataatttgcatctggcagtaccttctgagtcactggttaatgccaaaacatgagaatgatggagccctgaaattcattagcttcttctggggcttggtgaacctcaaaaccagaacctgggtttaatcagacattcagtaaggaaagtgatcaattgcttttcctatctgtaactaattgtatttttaaaaaagcagggaacttaatggggaaaaattttccctcttctgcttttctccatgagcctcaaattgctagatattctgtttccagggtgttgatgtcagtggaaatggcatgcacagaatcattatctactatgccacaagctccatgctatggtctggcaaagaaaagactgccccaggcaaaggggaagtcagcttatataaaaaagcaataagcttttccttaattgctccctaagaaggaggattctggcatttaagatgagctaaaagtacaaaaagaacatgttttgtaatgaaggaggcacacctccctcaaagacccctacaactactcttctggtttttggctattagtaaaatagagactgaacaatctcccattgtgcactcaggagtatgtggctgtcccggtagccccctcctcttttacctgaagcccctcagagcagttatgattgattccacttctcttctgaaagcatcaagtcctgggctgggcaaaggaaagatgaatgactcccatggctctgttgtagattacttagtgccagttgtcagttcttttctccctgggaagggtttgaaatgagattgttttcgacaggctatccatgataaatgattttccgagtaagaaattgctttcactgctgaacttcaccaaatcactctgacaaatgtttgtggctgcagggggccttctcgtggctgtctcatgcttgaggggtgggaggctgggatctcaaaccaggatggctcaaataggacgtctcccagtgaagacagaaagagacaggaatgtcgtctcgttaatgtgcatttggtcagctcctttcaactgctgctaaaaatcaacaagtgaggcccaaaatattccagatccaagaaaaataggtaggctaaagggatgtatacatctcttagttctgattattacattgttttcatgttggttataaatagaacagcaatatgtacctacagcaagggcaagaaccctcccagcaatgttgcaatgtttgcaacctgttattagtccatgacccttcctgaaaaatcataaaagcagcatgccctcttttaatattatttggcatttcaaaagagattaaataccatgtctaaaatcacaaaggactgttagaatttgccttttccagctgcataaagtcccccttcctcccctagattctgggagaatagggccttctgcaatcacagacacatgtcacttggcaacaggggcccccagggcattgacgggaagatgcctcctaagcttggatctgcggcctttgtgggtagcatcattggattgtttactcagag[450 bp omitted]ggggagtcccctggggcaggtggagaaagatgagtcatgtttcacctctccacctgttcttgctgaaatgataccccatctttctagtagttcctgcctttgtttagacacacagatggccagactgaagcccaagaggaaatggatgtgctcaagacaacccagttggtgagcttcaatgccagtcttttttgctgtaatgcccagtctcccctggccattctcacattgctcagtttctctctggccagtgtgcctgcccgttgacattctgccctctttcagaacattgcaggggaggagtctgtaaggtaaccatcaccaagtcaagctgtatatagtccagcattgccaactggattcgctttattcattcactcataaaacattttgagccttttctgcaccatgctctgtgctgggtgctgggaccatagaagtaaacagaaaaagtttcccaccttcaaggggctcctggtctcacatggtatctgacaagtgggagcagcggcgccaacaacagcatgggaagtatgttgagtgcttactattctagtccacgttctaagcattttctttatattagctcttctgagccttacccaagtctgtgagatgggtgctgtcatcatcgacatttgatggatgaggacattagggtgcagattaactaagtagctcccacagagtcacatagggaatgggtgacacctccaagatctgaatcccagaaactctggctttggggatagatgctctgagttggcactgcaatgggagtgagtcaagggcagggatggtcagcacttcagcagggtaaggaagagctgccggaaggagctggtgcctgagtggggtcctgagtgttcccaaggtgtcctggttttcagttttggtgagaagcagcctggctttcctgagctctgggctgggtctttgggagctgggattgtcctgcagcccctttcttgtagtgtaaagactgtcatagaaaaggcaagttcatcagggtcctgcctttgcatccagggggcttgagagctatactgaaaagaggagaagatgtgaaatccacgtgctcagctccatcctcaaaactccacttctaaagtcactcatttgggactgaaagttttttagaaactgttcagaaggaatgtggctcctctcccagtctggggctatgggccatgggcctaggtcacaccttgctgatcaggacagaaactggaataaatgactctctattttgggagcagacacatgtaaggctaattaggtctgctgaaccccaggtgtatcagggtctgtggaactgtaccatcccagatagggagcaaatatggcaaagtgagaaggcagaagcagcagttgagaatggctgactcatgggcagcacctcttccctggcctgacttcagcagggggcagatggcagaggcgtggcagagcaagcaatctgagccctcctgtagctgctgggtccatgctggaagaggctcctctgttctggaacttctctcgtggcagttggatattttaagtcatgaaggcttccatatacttagcagatctctgactcattgggctgtttgattccttgcgtgaaccagtaccaccaagacttcacttttgtcttcacttcgtccatgacctctaccagatccaagcacaccctccttgaaactgtgctatctgcaaccgtgcggtgtaaagaagtcatctgtggttagaggacagtgccccacaattgaggaaggaaaaaaggcatgccaatcagagagggcaaaacactcacatttgagaaaatgaacttgtgttctagtaagctccatcgctctgaccctcccggcttctgagttttctgtcaccatgtctgtctgtatgtccaatcaagactgtatcccatcttggatgtcatgggattctcattttttattcattctagatacactctgattattctgcactttcttttcaacttgtttgggggacaaacagcttttatagctggggagtgaggttgataataaagactttaaagacaaaaatacagatgtgcaggttaactgagcaggaccaagatgagcaggtggctgggttaatgtcatctgaaaagccaatacactgtgtgtcacaacatggtctgagcaaaaactacaaccactatgaatggcttccaaattaaaattctttttttttttttctgagatggaaacttgctctgtcacccagagctggagtgcaatggcatgatctcagcgcactgcaacccctgcctcccgggttcaagcaattctcctgcctcagcctcccgagtagctgggactacaggtgcctgccaccatgcccggttaagtttttgtatttttagtagagacggggtttcaccatgttggccaggctggtctcgaactcctgaccttgtgatctgcctgcctcagcctcccaaagtgctgagattacatgtgtgagctaccacgcccagccccaaattaaaattctttatagccaaagagaaatgatataatgatttcaatgcagttaaactctgcagtagcatgccccacaatacaatcataatataaaatcagatatgtagagaatggcaatcagcttcaatcctctgcctgtctcagataataaagctaaagttcttttttctgggagtgaggcaaccttgccatgagaaatagaaatgcaaaggtggggtcctcttggcctgcgttctgttggcctgttctctggaatcaggaatctagcccatacaacaggagcagattaatcgacttcaggatgtttttgaagtcattgatgctgttctggaagtcccaacagccaaaggatctagaagcctctaattgatatttaccccagagcagcgaactgacccaggtagaacctgaaaatattgggatcttgcagaaggactgcagacatctggctatgcgggcttcctgaggtcatttcagtgcccttactgtggtgcaacttcacattgtacatgattgaaatgtttaggctttgcttatcacattatgttgggagtagtaggtagagacagtaggagaatagagggttagaggcttattttaaatcagattgggcatgtcactataagatctataaaaaggtttataatctaatatgatgctcataaagagtgctcttccaatctgattcttatggatttcccaggggtgatcccaatctgattgtctttgtagtacagtgaccttcatctttagcaaagccagaaatgcagttcccaaagatgggagagcagcgtctctactcctgagcctagatctgcctttttttctctctcttgtagggaggattttcattttgccctttctatgtacaaatgctttgtgctttctcgtattattttgtatagtcacccaataatcctgtactgaaggagttatgatcaccattttacagatgatgaaataggctcagagaatttgacatttgtctaaattcatgcagctcgtaagtgacagagctgggatttgaacctgcatctgtctggctcctaagcctgggctgtctcactctgcatcataaatattccttgtgatgcagtgtttaggtgggtacagtctagtcctttaatgcttaatgctgttttagggggttggggagaacatagactttcttgagaatttgatgaaaattggacctcttgggtgggcagggagccaggaagtaccctaccctcacaattttttgtttgtttttaatttttaatttttgcgggtatatagcaagtgtatatatctgtggcatacatgacctgttttgatacaggcacttattatgtaataatcacatcatggagaatggggtatccatcccctagagcacttatcgtttgtgttgcaaacaatccaattacactcttgcagttaattttaaaaggtacaattaagttactattgactatagtcaccctcttgtgctatcaaatagtaggtcttattcattctttctgattttttttgcacccacccccacaattttgcatataatttcagctagctcatggggtccctgaagcgcatctatggattatttaggcctagggcagtccttggatcccaggttaagctaattagggtcttgggaagattcgttaaatttttttagagaaaaagcttgagtgattagaaggtcatttccagaaatttccttttggctcttcaggaataaagagactgggtgaggagagaggaggatggtgaggggaagaggaactggatggaagacatgaagaaattagcaagcagtaaaagcaatttgcatttgtgaataattaaggttgttaagaccctacggacttggctaacgcaccattcactagcagtttcttttcaggttaaaattaattggagtgttggtttatttatcttttcccttggtgaatcaaatgactcatcctgatttataaaccttccacctatccactctctattaagacctgtgggggctagcgattgataattttattgagttccccagggacattatttgtagaacccagttgctaatggttaggtcagtgaccgctagagacatctcagaaccccagaagctctggtttctatgaaaagagaaaacagccccaacagttggatgtcacttatatcttgaggcagactttttttagcagaaactggaatatatggctaagggggtaaaaaggaccagatccaagagcttggggatttttagatttcaaaactagatagtttcaaactccccaggaaaggaagagagggctactaaaacaatctcctccccttttgtctagaaaagaccccttgaaaccactattagaatggcccctttgtatgcacaaaaacgacccagattttcttcttatcacttatctgctctcctagaagttttaaaatctcctgacatttaaaaaataaatgacaaggaaatgtttttcccagcctagctctgagaaaggcagtacatccatcccagaccctgctgccagccgttggagccactgcagaggaaatctgaccccatgaacatctaagcaggccgcagagcacatggctgcccctgtggctctagattctgaccacatggagtagactcaaactccagccttaaccagtggtgtgactttgagcaaatcagcctagcagtaaaagcacagctttggtgtcaagctgcccaagttcaagttctgcctaattactcaccagctaagtgatcttatttcacctcttccctgtgcctcagtttcttcatttgtaatatgaagacaacataaatagtaacacaaaaagggtgttatgaggattaattgagtcaacagataaaaacactcagaacagtgcctggtatgtgtagtgggctagaagggcacccttcatgaattttagttattattattatttaagctctctaagtttcaaggtctccacttgtggaatggagctgataatggggattttatgaggataatgagaagatacacttaagttcttagaaaacaatgccactgggcagagcatgactgctcagccagtgttcggcaatcatgagttaccatgttagtgatgagaaacaaaccagtagtcttcttacagttcctatatggattaagacttgaggttgctaaattagccaggtgtggtggtgggtgcctgtagtcccagctacttgggaggctgaggcaagagaattgcttgaacccgggaggcagagcttgcagtgagccaagatcgcgccactgcactccagcctgggcgacagagcaaaactccatctcaaaaacaaaacaaaacaaaacgaacaacaacaacaaaggacatttgaggtttctgagaaatcatatggtgggtggagactttaaaacactgatctttctttactttctgtaccctcataatctttggcactaactgcagctgctgggtttagggctcagggaaaagccaccacccctcttagaacccaagaccccaggctggtatggatatggaatgtacacgtctctcttcttccccactccgctagtttaagcagagtgagcctgagtgcctgagtcctatgtctattaactttttgttgtcagctccactggtaatagtgcttcaaagaaatgaacgtcttaggatccttcttagaagcatgtcgtcacgattgtattaagctgatggaaagcagaacaataacaacaacaacaaaaacaacattcctttctaagccctgtggtctaaagggtaaagtgaatttattaagcatgtctgtgaagcaaaagctctggaggcatggctgctgtgctgattctctgggaaagtggtgatatggagtcatatttgtcactagacgaaatgaaccaggagggcacttcaagaacagaggatctgaaagaatttgggctagctctaaaaaatttattaaataataaaaaaaataaggccaggcgcagtagcttatgcctgtaatcccagcactttgggaggccgaggcgggcagatcacttgaggccaacagtttgagatcagcctggccaacatgatgaaatcccatctctacccaaaaaacaaaaattagccggatatggtggcgtgcacctgtgatcccagctacttgtgaggctgaggcaggagaatcacttgaacccaggaagcggaggttgcagtgagccgagattgcaccactgcactccagcctggtcgatggagtgagactctgtctcaataaataaataaatcagtaaataaataaatccaacagtctcatatattttgaaatgagaccacattaaagaaaggatgctcttgggatcatggatatttgcgggctctacatgggattgggtgagtcgtgtggtggtgacccttagctcagaggagacttctactggggtgcaagtgaaaatgcctgcaggagccaggctggatgcaaggcttaagaagtagtggggaccaggagacacgtcttcaggagcatctacccagctccagtgagttattccccagtgggaatatggagcatgtcttgcagatcttttattcattcaagtaattctgcaaatccattttaagaaatgtaacacttgatttttaaaacctgtatggttttaaatggtttaaatggtttaaatggtttaaatggcctgtatgggtggccattttgtaacctttggctatggaagaccagggagctagtgacgttgtaatttgcaaggaggccatgggagtcatttggaaatggagtgctggactccttcaacttctccctccctctcaactgtcaagagagaagggttcagggcttttggttacccaggggagatacttatctcctctgaacttccccacccacgcaaataatctccttcaatagtggtcctagaattccatccctgagaaggatcttctcaaccctcccattatgttgagatatatatttaaagtattatggaaatggctattataaatggcatagatagtttatatttttaagcctttgtaaagcattttggtctcatgacattcctgcacatcaagaatccctggtggttatcgaacttttatgtgcaggtaggctccccttgagaagaataacaagtaaattcaaaagagaggctgagaatcaactattctcagcacaaataaatttttctgattacaaaagtttccatcacaatgcttttgttgaatttatgatagggtttagttcataaatcaatttgatctacacataattttcaagaaagcatctgcagcataaattgaggtgcaactgcacttcataccactttttttctccttttgtttctcattttccactttgttctgtctgtgtcatctgtaagtatctccatgttttcattcggcagctcctggagacttcatggcaaaccaacatattgaatgcaggaaattccagggtggccaagaatattctccagaaatgtactgtaattcctattcctttaatacataccagttgatgttgggagaagttggccatgtgagaagtaaggcctgagatgatgggattgatgggcatctacatctctaaagctgacagaggaaacatttggcttagaaaaaaatttagtttttttttgtttgtttgtttagtttctttttttttttttgagacagagtcacccaggttggagtgcagtggcatgatctcagctcactgcaatctccaccttctaggttcaagcgattctcctgcctcagcctcccgagtaggtgggaccacaggcacctgccaccatgcctagctaatttttgtatttttagtagagatgggatttcatcatgttggccaagctggtctcaatctcctgacctcaggtgatccgcccgcctcagcctcccaaagtgctgggattaaaagcgtgagcgattaagattgcacctggccaaaaattcagtttttgctcacaaggtttctgcatctgaactgttcattcataacacagggacagagcagagacctggagacatggcttaggatcctggctgtgccacttaagaactatgggacctttctgtagcccacacccttatctataaaatgaggaatataatgtttatcttgaagggtagttgttgaagattaaatgaatgatgtgcacagagtcaaaaccatatataaagccaatatccagcttataatactcatttgataaaattttttcttatgaatgaatgagttcatggttaataaattatctttaaagaagtaattcaaatttagaagccttcagaagctggtacctagatctgacaacagctacgtgtactgtattttactaattctaagatacaattttttcatagtttaaaatctccaaaatcaggaagtgtctcatcattcatgacttcttatggctataattggtaaatattttctttcttggtggcatataaagcagtggcttacttttttgttggtggcaacttagattccatagactaactcagctaggttaactaatttgagctgctgctgtttgccttctcttcctcccgcttctctcacccttccttcccacttctcctcttccccccttcttcttcatagttttattgaaatatgttttatataccatagaattcactcatttaaagtggtttctagtatagtcacagatttgtgcaactatcgctgcaatctaattccagaaaattttcaacacccccgaaagaaaccctatatcaattggcaatcattccacattctcccagtcccccagtcttctcagccctaggcaactactcatctactttctgtctctatagagttgcctgttctagacatttcatataaattgaattttgtaatatgtggctttttgtgacttccttctttcaattagcatgatgttttcaagatagaaatagaggctaagaagtctaagatcaaggcaacagcatggtcaatttctggtgagggctctcttccagggttgcagatggccaccttcttgctgtgtcctcacacggcagagagagagagagagagagagaggagagaggagagaggagagagagagagacaggtgggggggaggggcaagctcactgctcactggtatctgttcttacaaggacattaatcccatcataaggccccactcttatgatgacctcattagacctaattatctcccaaaggctccacctccaaatgccataacactggggactggggcttcaacatatgaattttgggggaatgcaatccagttcatagcacatcaagatatggtatctcgatgtttaactttttgagtagctttcagctaagtttattatctctgctctggccctggctttcatcttggcccttataagtttaccatgaggctcatagtctgcatattatagatgccaataccatagtcatttatttatttatctaatgaaagttaattacctgatctatgctggaaactgtaaataagtaaaacaataaatgtaatcagggaacacagtctagaggaggagacaggcaaaaaaaaaaaaaagcaaaaataaaagacagacaaaacaaaacaaaacaaaacaggtgcaatctgtaatcatgttcagaagataaagaaaagaccatcccgacagaagagggcactggcctgatctagtggggtggtgaagtagggaaattaaagaggagaaagacattttggacaggactccatgatgaattggatgtggagtgaatggaaggaggaatcagggtccttctagccttctagtgtttggcttcaatgacaagtcgctggtggtagcatttactgggaagggaggggctgcactgggggctaagggctgcactagggagaaatcaggatttccatcttggatatgttcagtttaagaagtctgtgacacctgaaagagaagatgtcaaacagcagggtagataattgagtccagaactcagaagagaggaatcatattacatttggaaattacaaagatgactttgaatgcctgtgagttgatggtaccatctggggaaagagtgtagggagaggagagaaggtgccccaggtgaaggcaagaggatgcccaacatttagagggtgagtaaagcaggaggaggctggatgggaaactgaggaagggcacacacagggcaaggagatggcagaagcctagggaggagagggtttcaggcagagggagtggccaattgccaagcactgttgagacagagggaaggtaagggtctagggtcatctgtggagtttgtgacagggatgttgctggtttctttgacattgaagctctagtgagtggagggagggcctgatcaaagtgggctaaaggatggagcctgcagtagtctctggaaatgtggttggctatggaggacagttgagcaagcttatattttggcagcagagctccagcagcaagggagagcttgctatagcaacacagtacagttagacagtacagggctgaaagagtgtctgtggagggcatggtgtgttatgaatgaagaggcagaggatgtgctgggcgcctgtaagtgcagtgttggagagctgctggtaggaaaaaaagtgtaactggcctgattcttttatgtgacttttaatgacatgatgaggcgaggccatccactgagcctgatggtgcagaaaagaacatgggaggttggaggagagaaggaaaactgtgaaatagtggccttggaaaattggaaagcaaaccaattcaagaaaaatagcagtttgccagtcagtatggagtgtcaatttgcagtttgagatcatgaatttaaagcgaaaccagtcatttcccttgtgtggttttattcaggaactttcagctttccagagctggtgtgaagtagggctgagggcttctgttatggaaggagggtgctgcccaggggtgatgacaatggtggactatgggaattaggctggacaaggagcgttgcaaggcaaggcagggagcagatgactggccaggggtgggatgtcgggggaggtgtccagaatttggagatttctctgaggttggggaagggtcccagtggggagcacgtgaacaggcgagcacaaggatgagaggttgctgttgatgaatggggtgtttgaggccgagatatcagaaacactatagttgctgctttcttcgggtccagagcaagatcatgggagtgggtgggtggcgtggaggaaaggaaagggtcaccgacaatcagcagagcaaggacctgggaggccagcacttctggtggttggtctatgtcctggtgattaagatgactggagttggggtggagagggcagactgagagctgggagctatgtcccaggccataatcactaggcccacttgtaattgtgtgtgtgatcaccagacattctccaaccctaactttttgtctcctgattacagtttcaaacttaaaactgacatgcaggagtgactgtttcagaaatgtgagtccatctcttgctgctcctttctgtctaagggctgattgtattggtgatttggttcttggagatgtgagtgctcctgccctcatgaggaccttccttagacctcgcctactgcctttgattcctgtggagtataaaagtcaaaggatacattagggggataaggatgataagcaagtccaagtataggtgctgaaagctactttccaggtctccaactttagctgtgctccattcagccagggttagagccgtttttgctcgttgcagagtaccctgtgaatgttatacatcataattgtatcattacacgtcataacaataggatttcaactgttattattgcacattctaattatgtaattactcagtctttcaccgattatgtaattagatttaattacaccaattgcagaaataaacgatagtcaactacaaattacttaaaaaaaaaatccagaactatgcatacgtcggcaattgtcccaaaaataagaatagaaaacataaggaagggaagaaggcttacgaaaccaattagcaagtgaaaggaatgatgtgatttggatagatctttaaggataatggcagggaatcatcttgtctagaagtttcctgtcattttttttctctgacgaagtgtggtagtaggaattgaagatgtcaaagtcaagagcgctgattcctcttggctgtgccttgaagcagagattgctctcatttccttaaccatacagcttaatgaggaagagggaagagaagacagcaagagagagaaaagagcaagagacactgagcaggggagggagagaaggagagagagagaatataacaaattggcatttcataattaaaagtagtatacatacagtacttttaaaaatatatatttttaatttcagtttttattttagatacagggggtacatatgcaggtttgttatgtgaatatattgcacccaggtagcgagcatagtacccaataggtagtttttcaacccacggtcctttccctcccctctctagtagtccatagtatatattgttcccatgtttatgtccatgtgtgctcagtgctcagctcccacttataagtgagaacacgcagtgtttggttttctgtttttgtgttaatttgcttaggattatggcctccagctccattcccgttaccacaaaagacttgatttcacccttttttatggctttttaatattccatgatgtgtatgtaccacattttctttatttagtccaccattgatgggcacctaggttgattcaatgtatttgctactgtgaaatttcatggcaatgagcatgtaggtgcatgtgtttttttggtataattatctagtttcctttgggtatatacccagtagtgggattgttgggttgaatggtagctctgatttaagtgttttgagaaatttccaaactgctttccacattggctgaacaaatttacattcccaccaacagtgtgtaaacattcccttttctccgcagccttgccagcatctgttgttttttgattttttagtaatagccattctaactggtgtgagacggtatctcattgtggtttaaatttgaatttctctgacgattagtgatgatgagcagtttttcatgtttgttagccacttgtatgtcttcttttgagaagtgtcatttcatgtcttttgtccattttttagtgggattatttgcttgtcaatttttttaagttccttatagatcctagttattagacctttgtcagatgcatagtttgcgaatattttctcccattctataggttgtctttttactttgttgatagtttcttttgctgtgcaaaagctctttagtttaattaggtcccacttgtcaatttttgtttttgttatagttgcttttaggaacttagtaaaaaattctttgccaaggctgatgttgagatgggtatttcctaggttttcttcaaagattttatagtttgaggtcttctatttaaatctttaatccattttgagttaatttttgtacatggtgaaaggtaagagtccagtttcattcttctacgtatggttagccagttatacccacaccatttatttaatagagagtcccttccccactgcttgtttttgtcagccttgttgaaaatcagatggctctagatgtgcggctttatttctgtgttctctgttcagtcccactgatctatatgtctgttttttttaccaataccatgctgttttggttactgtagccttatagtatatttgaagtcaggtagtttgatgcctccagctttgttggtagtttgatgcctccagctttgtttttttgtttttgtttttgttgtttagaattgctttggccactcaggctcttttatggagtcatatgaactttagaatagttttttctaattctgtgaagaatgttattggtagtttgataggaatagtgttgaatctgtaaattgctttaggtagtatggccattttaacaatattcagtcttcctatccatgagcatgaaatgtttttccatttatttgtgttgtctctgacttctttcagcagtgttttgtagttctccacatagagatctttcacttccttttttagctgtgctcctaggtattttattttctgtgtggctattgtcaatgggactgtgttcttgatttgactctcagcatggatgttgttggtgtgtagaaatgctactgatttttgtacattgattttgtattctgaaaccttgctaaaatcattgatcagttataacagccttttataagaatctttagggttttctaagtaaagagtaatattatcagtgaagagaggtagtttgacttcttcttttcctatttggttgccttttctttctttctcttgcctggttgctcaggctaggacttgcaatgccatattgaataggagtaatgagagcgggagtctttgctttgttcctcttctcaaggggaatgcttgtagctttgcccattcagtataatgttggttgtgggtttgtcatagatggtttttattattttgaggtatgttcctttgatgcttactcttttcagagtttctatcatgaagggatgttagatttaatcaaaatctttttctgaggctattgagatgatcatgtgtttttgcttttaattctgtttataatgctaatcgcatttattgatttgcatatactgaaccaaccttgcatcccagggataaagcctacttggtttgtggtgaattaactttttgatgtgccactggatttgatttgccagtattttattgaggatttttgcatctatgttcatcagggatattggcctaatgtttttctttttttgttgtgtctctgccatcttctggtataaagatgatgctggcttcatagaatgcatcagggaggagcccttcctcctcagtgttttggcatagttgcagtaggattggtaccagttccttgcacatctggtagaatttggttgtgaacccatctggtccaggacttttttttttttttttggttggtaggttttttttaaattactgattccatttcagagcttgttattggtctgttcaggttttcactttcttcctggttcaatcttgggaggttgtgtgtttccaggaatttatctatctcctctagatttcctaatttatgtgcatagaggtattcataatagtcttcgagaatcttttgtaattctgtgggatcagttgtaatgtcatctgtgtcatttctgattgcacttatttgaatcttctttttttgttaatctggccagctgtctagcattcttgtatattctttcgaagagccaactcttggtttctttgatatgttatatgaaaaaaggtagtacaatatattttaatgtggagaacagagtccatgttaaggttcaaatttatgattctcccttggattagtttcctaaaccccttttgagtttgttatctgaacctagaacttcagagccagtactctatcatgttctgttccagcaaaatttgcaagaccaaaaattaataggtgagaaaccaagaatttggtacatgaataaatgtcatactctattgtttttcttttccattacctcaggttattgggtagctttgatctgaggtgcctataagaattcaattagggctgtgtcacaggtgtgaccattttttttcctatgaagacattgtagagggtggtctttttctggagaacaggttttctctgttgtaactcctagaggtaagaaaagaacagtgatagctcccctaggctgagttcactcagctgcctctgtgcctggagaaaggactaacccagagcttctagagaggagaggcgaagagacagctctgtggaggcgggaatgtgcacacatctgggagagtgggcatgctacacttgcactcttccaaagagagataattggtaggtgccatttaagcatatatatacttaggagaaattacccactgagcttggccaagtactgcataaccatagaacaccagcattgctcagcatgttccccaggatcttacagcagttgacaggatgaggattacttcataagaacacataatagttggtgcatgtacttacactgctataaaaataggtcttgatgctatagagggtcacattggggaatcagtgtatttgtttagctcttgcctgtgcatgaaaaactaatagtctgcaataacacaaataaggaaaaaatgtagttttaaatatagaataaagccattttattttgagcttttctactgtatgtttgtctatggaatcccataagatggacagtagatgctaaagaactttaatctagacatattcatctctcctttggtttatgcatagctccaggattgcatttgatttttttgctgttcatgggctttcatttctgcgcacaggtttttaaaacgttttatttacttattatttatttttagagacaaggtcttgctatgttgcccaggctggagttgtgtgatcataacttactgcagtctcaaacttctgggctcaagtgatcgtcccgcctcagcctccaaggagccgggattataagcatgtgccaccatgcctggctctgcatacaggtttaatgcctgttgaggtcaacccacagcagtggaaggtggcccctagaatagagtagtgctcttacattgggcatttgagcaaacaaaccctgggaaattggaactaagagaagggaatcaagctggaagtttgtagcccaaatattcattctcatctacaaaaatccaccagaacaaataaggttaagctgatgcgtatccgcagatttgcaacagtgtggcattccactctctacttttcttgtcagaaactgagaatgtgtaaaatggaagatgtggcgatatcaagcagccaaagctattttccaaatgaggacaaaagaagtgcggccagtttacacaaagcaagcgaacttgctgagcagttataatctgcattccagattctcagcccagagccatcattcctggcttgctcttctaaacagaaatgtcaatgcaaagattaaagtggattgtagtgaggtagaaagttgtcagcagggactaacatcagagtcttacaaaggcattttacctagttaagcatttatggtatgcacgcaattttggccatcacaggctcaaggagagggattctacaaaatacatcacatcagtataggaagggccacacaacctgaacagacattagcgaggaagacaaggaaaggctgtcatgcagttagtcaccagtagcagccgttcactcagtggatctctaccagatgttcaataggtcaggtactggcttgcctggctatcattaggggattctgatcttagttctagtttgctctctctaggtctacaagcagcttctgtatttattgagtacttactaggtgcaaagtgccatgataagccttttacaaacttattattctacttagtagcactactacgattttctttatttgcttgatgaagaaagaacacctcagaaggtttcaatgtccacatggttagtaataggaactagagtttgaacccctggtctgaatccagagtccattttcttaacctctaaattatgcaatgtgttatattccaatatctatagaatgcagaacaattttgtcattgtaaagatactttaagtgtggaattaaagtttgtttagggagagtcctctattaaatttatgtaatcagaagagctttagattaacatgggacaagactattaatttcttcttcacataatctagaaaaaaaaattgacaagaaaatgttccattttgccttcaaatgaaagcggaaatatgtggttaagtgtaagtcaaaaattagatgtcaaacatctttccaggtgcatatattatataatattaaattgtcaaggaactccttgtgttggaatgcaagagaggaaaatcctttttgtgagtacaaaaaaatcatatagacataggaagtgaggtgggagcagcctgatcctaataacaagcatggtttgataaaggaaacactagcaaactagtattgaccatagacttaatcttagtgagaatgaactaagacccgcccccccctccctccctgcctccctttattccttcctttggctctccatttatttatttacttgtttagcaaagtttattgagtacttagtctgtgtcaggcacttgtgtaggttttggtgaaacagtgaacaaaacacacatgttttctgcttttatgggccttgcattccagtggagatggccaaaaacttggacagttgaagaaacagaaagaagatgagtatggttagagctcagtgggaaagagagagagtaatacgggtggtaggagacttacgtagaggcaagaggtccagttcccagttagacgaaaaaccaagagcagatagaagtttggcgcatgactttacatttgacaacaggtaacagttaatgagcccttaatcagtgccagtgactgtctaagcccttgtcctgttttaactcatttaaactccacaacaccactcaatgaattcttaaacatatctactaaatagaaaaacaatgaatccaacgtcaggttgacacatttttttcaaactcttttattgatttaacagtgagttagaacacaatgagattaattaaacctctttttttcagttttaaaaatggtgatgctgtattaatttaattgtcttagcacttataattttttaactgagaaaaagtattttgtatgtaaagagattgttcttaagctttaaattaaacaaatgttctctcgccttatggggaaatgggcttatttgcaaatggacccactcaatggttttattttgttctgttcacaccatactgtcatgttgtccatagattcattagagcgagattggtgcattaattcattccattattctgttgctcataataaacaaataatacagttttacatcactgcttctatactattagctcatatagttacaaatagtctttgtagaattgcctacccagaggtgtcacttcagaagctagtgataactctacaaatttttacaatttcatagacttttaaaaagtcgtcctgattttttaaaaaatggttttatatttagggagagtgatgactagaaggagcaggttatcaaaatctaggctgatatgagaggacaaattcaaaggaaagttaatgttaagtgatttaaatacttggttcagatggacttcctaatggaatcttcatcatatatgcagcatggagtaaaaactataagaaaccttcatcaatctaagactgcattaaaaattactatattttttgaaggtttaaatatattcagccttactggaaaaattagagcatgttgatttatatccagtaagataagttactctccaaggagaccctttgggttaaaatcctcacccacactcctcttcatctatgtattcttatgtggagattttaattcatctttttccattgttgcttgaacacctgattccttgggttggcttcctggagaaatgaatcagcaagagaaacatgagctgacttcctcctatttgatatgcacacatctctagatttttagctttgctcctagtatgcttcgtgtcaagtttaggtccagcttcctgagctagagcacaaaaaaatatatcatttgaagcaaagagagaagaacgaactggggcttcaatcacctctgtgtattatttctgatatagaaccaataagtttgtgtgcccactgcatagtaacagacccattaccctgagacagcaggtttgcagcagagaagggtttaactatctcagggcaccaagggaggagatgggaggagagcctcaaattcatctttctgaggagctctgggctgtggtttttaagaacatcatggagcgtgatgggctggaaaattggggttgttgactgatcaggggaagggggattaaatcatcagaatgtggaaattgtgttctttggtgagtcagcttcttgtggtgttcctcagaccttcctggggtcacccgtggggtctttcattcagatcagctgatgtagtagtttcactcgtatgcaggacctgaaagactacctcacggggaaagcttaacatttcttaatgttcaagttgttatctatagagcacttaaggggaactatcatcttatcacagagtctacatgattctaggacaataggcaccaaaccatgtcgaggaagcaggtcagagaatgagttgacctcatgcttaatgctgaatgtgcttcaagcttggtttattaatttattttttcccctttcttcttccctgattaattttataatgtttacaggggcaacttcatttcaatcttggtttcccagttatagaagataaccctcatagaaggagaaaagtgcatactcattagtttcagaggaatgacttttttttagttttaggcatttagattttgtgatgcctaatgacacagaaattgaatgccctcggggagactctcctgtggaattttaactatcccatagccttctcaggtcttggacctctcatggctagtgaggtcaaatggctttgctgagtggtgaatcttgttacctccaaggtcattcccattcttcttcttgcacacatgaggtgagataacctgaaactcccctgaaacacgggaagagcacacaaatcagtcctttgaatgcacctcatcctctagggattgtagtaatattgtaactgatgtaattgtcatataatttaagttcttttttctttctttcttttttttttttttcctgagagggagtctcactgtgtcccccaggctggaatgcagtgatgtgatcttggcttgctgcaacttccacctcatggattcaagtgattctcctgactcagtctcccaagtagctgggattataggaacccgccaccatgcccagctaatttttgtattctattagagatgaggtttcactatgttggccagactggtctcggattcctgacttcaagtgatctgcccgcctcagcctcccaaagtgctgggattacaggtgtgagccatcacgcctagcctaatttaagttctgaattggtatgggactatggggccatttgaaaccatgttgggagatgggacttccctagtatcttggtactgttgaattataatcagtttcctccaggtttgtctattttctccctcaattcatttatttttctcctcctccttaaacatgtattgagggcctattttgcgggtaccatgatgatgggaacccagacacaaaacaccaaggctctcccctcaggagctcacagtctagcagggaagggagacagatacacaaacaaataaattaccacttcatgagtgatgagcgccacaacagaagcacccaggaagaaaagcctagaaaaaggttcagttacctctgggtgggaggaggatcaggggaggctttctggaggaggcagccactgagttgagtgttcaaaggtggatgagtaagagcttgcaagggaatagcatgggtgtgaaacagaggagtgaatgcagcagcccgtccattcttagctgctgttcattcttacagatgtcaaatatttctgggagtcttctgtcttccactgttacaaaacttctttaaaaattgttgtgattaggataggacccttcttcatagcaggagtttcccagttctttggggaatgctttgaaaaattcatttgttcccggattgagctgttctagttgtttatcctttaaacagcaagaaaaagatggtacttccagacttcttaaaagcccaagccacttgcaggtaataacggtgtcaggttaacagcagtgacacatcttctatttcaggaaggattgaattggctcttcctggatattcatttgctgaggcttcaattccaggagattttattctttgcacatttctctgttttctttttgttcctgttagaggcagcttctcagaatgataaaaactgttgacatgttccttgcaaagtctttggcattctaaggatccatccttattgcctcatttggccttgactttacttccaatataattgcccatgacaacttattttagtagagagtgtggtagatggccatccttgggtgagtttgagggtgctgtaaatactcctatactccaaaacatctcttctaacttgcaaagtacctgaaattccaccaattagacattcattcttgaagccttttcagttgtttcttaaaatctaagtagctcttagtgtcaccctgcaccttcattaagcaggtatcacttgttggctcctcagtgtggtgagcactgagttctgggaaggacaaaacagggactgaaaaactaaggaaaaggatggcttagcctgcaccaactgtacgtgaaggaagagagtcattatcacatcagttgcattattcagcacagcttgttacctgatatctgcttacctgaagagattactgtgggttaattctagaagcttgcttattacattaacgacctacatttattgacagctgattatcttgggggattgtctctgagaatttgtgcagtaggtaaatgatgtctttgcctcaattagcactcctttgagaaaggaactaagatagttaatgttgatttgtatcactgtggtttcttatccctcttttatatcttttggaattgaacacagtattatacctataacaggtgctgagtaaatgtttgttaaagaaatcagtctgtagacatttagaggcacatatcaccagaaatagaccactagcctgatgtctggctacagtaaaaccaaacaggagaataactgttttttaaaattagaacttcattttgaaatagtttaagattcacaagaagttgcaaaaacaggacagagtttctgtatcctttccaagctttccccatgatagtgctatatgctacataggcatgcatggtatgttatcaaaaccaggaaattgatattggcgtactgctgtaaactcaagtacagatgttttgccagtttttacaagcacttttttttttttgctgtgtagatccaagacattttatcccacataaatttgttttattacctctccagtcagtatacagaactcttccatcagcacaatgaaattctcttgtgagaaaccaaattttaaaaagaaaaagaaataacttaaaaataagcaccaacatttttataaggtcacatgcgtgaactttaaaataatactaatttcaggctgggtgcggtgcctcacgcctgtaatcccagcacttaggcctgttctactctcctttgaaatgaggtccttccccagcatgccttcctgctgagcaattgctgcctggagcatctccctgagtgtctgctgtgcagcaaggtggctgccactttagggaatctcagcctgtgctccttttccaagttcagtgtgtattgtcttctccgtaagtccatgtatagagggttctttttccctgtgttagcatttgtacacttggcctggcttcatggaaactccaaactagaatggacttggaacaaatggaaatccaccaaacaaatatgaccgcatggtcacagcagcacacagacagaactttcctgtttctgatttaccaacatagggtacagagctcccaccacggttaaaattgagctaagtgagtatcaaacacacttggtcactttttaaagagaaagcacattacctgaaaatggcatctttcctcttgtcaactcctgccaaaagaaagcctcaccccctaccccctgcacaccccagaattcatactttcaggcagccctctggaaactaaggacatctaaatctaaaggtcaggattctgtgagagaaaaccagtccaacatgctcatgaaatcctaactgtgcacagggttggatggacacttaaaaggcagttaagttgatggcttgacggtatgactaaccaagttctttaggtaattaatagtggatgcagcagaagtgttcactgtaatttttctatgtgcctgggtgtgatcacatgtatacaatttgtctataatctgttatctgtaatttgtctataattgttggcatgtgtctactatgtccaggtacccctatttgaggtactgaaatatgttcattttatgtcgattctaactataatttagagactgctctccaaatagcagaaagaacagcttcttactagggtgggtttttttttttccagaagattaagagacatgtgctgtcatttcttcatgacacagattcctgcaatagacatgggggccgtggtaggagagagaaccatgtggtttaggaaattgcttcagtgatactgtggacctaatcccctcttcctaaagaactctgacagcagcaggccctgaagaaggggtatttcccaggatattaagatactgtaattatatggcaacaatgatgctcatcttagtatgtgcataggttacttttttccgtggggatttaatttgactaattgacctctgtcttcacaaccttctgcttccaattcctactctatattgtccccagaattaacttgctacaagacaagataatggtaccactctccagcatttaaatttctatcaggctgggcgtggtggctcacacttgtaatcccagcactttgggaggccaagacaggtggatcacctgaggtcaggagttcgagaccagcctagccaacatggtgaaaccctatctctaccaaaaatacaaaaattagccagccatggtggcaggcgcctgtagtcccagctacttgggaggctgaggcaggagaatcgcttgaacctgggaggcagaggttgcagagagccaagatcgcaccactgcactccagcctgggtgacagagtgaaactctgtctcaaaaactagatttaataaaaataaaaaataaataaacttctgtcagctccctatttcctataggataaagagcagacatgcttccagggcacacagatgcttcaccgtctcctgtctggccttgtttcttgccaaccttacaatctacttaggctctatacgaggtgtccttccactcccagaatgcactgtgttctctgtgcttctgtctctctgcccaagcttagccctctgcttccatcccttcccctgccttctcacgctgatgagtttctaatcctcactcaaggcctactgcaaaagttaggcagaggcgatcttctgcttccagagtcctttgcttcttacttatatttgagtactactgatcataatagctaccactgacatagcatccatcatgtgctggccactaacaaagcagttcacgtttactaactcatttatttctctcaacaacctcaggaggtaggtattatttgcattttataaatgaggacactgaggcacagcatgattaaatatcttatccaaggtcatacaaggtaatcagtagaatttttaaacaagctgctcttgcatatctgctgccagaaattaaaatctgggtagacttctctgctaaatggaaaactactccagagcaagaatcatgtcttattgaattatatgtctccaaaaccagcatagtgcctgtcaccaaagaaaaaaactcagagacatttgttgaatgaatgtacagactattatgtttttgttcaaaaagataatcctttgaaaagatgtcattcaactaagcctctgagtttttaatctataagagagaataaattgtgatcaagtggaaacagctgcatctcaaggaatgaggaaggtagtgtcgggaggaatcctgtgttttgcttctacctgcattcactcccatgttctgggtggtgctcaagtttcagtgggtatgttaaggtctcactgagtgtggaaagtgaggcagtgcactgctcattcacactggacctaagttccctatcaaggcctccatcatacacgcagggaatcagaaggctgaactcctggagaacattttagaaggagtaatttataagcacggggcttgctcttcccctgtcagaactaggaggcaggaattgtgagttaggactagaccgtaccattttttgagttgtgttcaatgtaccagagatcataaaaggcagaagaggcaagaaaaatgataacaagccttatattaagcagggagtttacaggaaactagtttttagatatccagtgtagccttgacattagagcgaagcttgatgaatctctactgaatttaaaacagtattattactcctttaagagaaatgttaagaaatatatatatatatatatatatatatcacatatatatgctttttgctgatgaattgattttgataagaaatacctttgagaatcttgctcgtaactagggttctgctaaatggtcaatatgtatgaggtgagctcactgttcacctgtcattcatgctgagatgaagaaaagatggcttcacttgagagcgtggttaacttcagggttataaatggctttcaggggtatagatgcatagagtccctacccttgcaccacccgagctttcacgactgttgggttccttcaacactacattacgccttgagagtcatcatgagctctgtaaccaaagtgttaaggatgttggcacttaactgtctcttatttatctgacccgcttcagctctgcttctataatgaactgtaactacaggaaaccatggtgtgtatctttatgtaactgatgccttgtttctcctgaattttcacaacatcttaacaattatggttgatgttaaaaactctcatgaggttatttgttgaagtgaaatacattataaaaatacatgcatatgaaaggatggccagggaagccatttcattgagtaacggccagttctgtcctcaccttccctctgtctcgcccctcctcgtccccaaagctgcctcttctcgcgtgtaatgccagcgctctgtacagtgttctgtttagagtggtttgaacatttttctgcctgtgtctctcattgctgaagtaactcacctctctcatatcgactcttacccaggagccgcactgcagactctttgatgtaggtcctttctgcatggcagctaaggccaagctgtggttttcatttgcatgatgcaacctccccctttcggttgtcgcctccaggttaaccagattcttttcctgcactgcccaagcatgttgacgtgctttccccgatggccctgaacgtggtgagcactggacgcatgcatgaattaaagcagcgagcattccaatacactgaagcactgggcctgaggcttctcctggatcatccctgtgggccctcagtttgctgtgatatcacaaaggccaccatgtcccttgaaaattcaagactaggacattggaaaagagagagataaatctcccgtttttaggtttatgctgagcaaagactaatgacaaataattagaagctaggaccagttttccaagtaacaacctacctgatcatcagtcctacatgttcctgactccacctgggtgtgcaccaagtgaccaggatgatgataccctttcatgtctttctgaataatgttacctgatttgattttgcttagatctaacaaatatctaaataaaaagatataccttttaaaagcacttcttgggctaaatgcctcaggaaatgcaattattgatcgttttcatagtgtttagtaaaactattaattcaactttaaaagaaatgaaatggtactactaggaagaaatatcgcatttgttaaagcatgttggcactgcattcaacatcattgattagtaaattgtgatcattttctctccttgaaatattttttttttgccttagggctgtctaatgacttactttaaaactgctttcttttccttattttttttaaacttgtatacttctttcttgtattctcagaatggacttttataaaacacaactgtcaggatctgttttctcactgcatttctttttttgtcatttcaaatagatactttgcattttagacatgccttggttgtaagctgagaaaaatgaaaggcgaggcattccaagctgtgataatcctagggtaggaataacagttcctagacaattcttgatgatactagcttgtcagcatcccttagcccaagagtaggcactaagcagtcagaatgaaacaaagccgaatgcttcttatcttatttttaggttttcttcatgaaatctgatcttctacaatctgggggcttagtagattgaagctcttcccacagtcctttttcctcctattctattaaccatatcccatgtattatattgaaatggactttgcttagaatttcataacatgttcttttggtaaccagtaaaaagatcctttgaatgggagcatttcgctttttgaaaggagcttaaatgtaattacagtacagacctgtgcaggcaggcgatcctgcccagcacgttggcatattctcactttatgaacgttttcatctgggggcttggcgaaggaaacatctgattctcttttgtgagattcttcagtacagagacccattcctctttcccagaaaaacacagtgattcctcataaaatgaaaggatttctgaagcccaacagaaagtggggatacagagatccattcacagagacagaagagaaaatcctaagaaatcggcttcctggggccatcctaggcctctcacagagatgtttttataatgataggaataacatctctagagaagttcaaagataggacaataaaattaaaagaagggcctgcaggaggaagcaaggagaaagacacttcaccccactgagcaggtaattcatcatatttctttccaaatttatacccaaaaatctagtggatgtcattgatatggtggaaatagctatttattattatttttctttttttgagacagtctcactccgttgcccaggctggagtgcagtggtatgatcttggctcactgcaacctctaccacccgagttcaaaccattctcctgcctcagcctcccgagtagctgggactacaggtgttcaccaccactcccagctaatttttgtattttcagtggaggtggggtttcaccatgttggccaggctggtctcgaactcctgactttaagtgatccacctgcctcggcctcccaaagtgctgggattacaggcttgagccaccatactcagccagctatttattatttctgaaacatgggcaggggaaacctaattttgataaataaatgattttcaatgttaattagaagcaagaaggaaagaaaaaaaaaggaaaagaaatgttccaggagatgagacattactttcatgaagttgtcaagaaggaaatgaaaagtgtgcatacttgaagatatgattgtataatcataggggttaataagtcattgccattttccctattaatgatgacagtttgttttaaaggtaactcatcctgtctgattttccatggtggtgttggtttctactgcccaggtcctttatgacattcctaaggagtgactctagccttgtactcagcagacccatgacttctaatcagcagcatctcagacactccgttttggctgtgaggctgctaggctctcaacaaaactcctaaataggaaaacttacaaaacttccaggccttagctgtcagccaaagacggagctaagacacagctattttatttccttgtgcaataaaggtataattgtcttctatgccagatgtcagaaagacttctaccaggtctttctctgtgtgttcttaaaaaaaatcctcaacaacaacaacaacaataacaacaacaacaacaacaaaacttcaagatgttagaaatagatataagccattataattatccttcagcatcacatataaattcatgtgtaactttaaacaagctggtgtccttgtggtgactatctatgttatgtgacattgttttctgttcgtcaaagtgaagcagcagataaatggaacaactgttttttaaacataattatttttttttccagatgttctcaggcttcctacattcaggatcagcaagtcttcagcattggtactctttgttagtgtagaccttgagtgccctgctgaggggcttgtgtgccattctgcttgagtgcagatgtgccaagaggtacaagagttggaactgtaatagacctcttaggctactggctgaaatactaaggttcagaataagaaagagatacgtctcaggcatctcattatccgcaactgtcagtccggaactcagaacaggctggttctagctgtcgattcaatagttttagcttctgtactccaaatccttacaggtagacccatagcaaggtgccattgccagggtcatgccatccaggtatgacaggactatgtcaaagccaggtaggagggcaagaaaagggagtataaggcataagttaaataggggactggtgagatgaccaggggaggcccaaagagtccaaggcaaacatctggagaaggctcagacagaattttgaagtctgcatctagtaacagcccaaagaagtcccacagtgatttgacagtctgttatgctatgggagtaccagcctacctgcccaaccgtgccctgattggccagcctttggcaaatagagagctcttcttttctcttaggagcctctgccatcccctgtatgaatatgagggcttcttatttgggaagccttgatatgaagtgccttgaaactgtaccctgagctactttctctaggatgccctctctttcagaaatgtgagctccaggctgttgctccccaatggctaggggttgttggctatccctggttatagattattgtttatcagcctcctagcacataggtggcaattttaatatccagaaaaaaaaggcataggaagcagaatgtagtggttacatgaatagtctattcttgtttccctaggactaaattcctgtagatgtgagaggagtatggatccaggggtcagaggttccattccccatgccagcatttgtgtctagattctcagctctccattcagacctgggacttctcttctctttcctttcccccatttctaatcacctcatctaggctgtcctgttttgtgagtggtcccagagtggggttggggttggatggagagcatatatttgtgctgggaggctggggatgtttgtgtgtacacgttgtgtgggtgcccacccacatgaaccactccatacctatacatggctcattgaccctgccctcgaagaactttcactctgtcttctggtatatgtgcataagtgcatatgcatttagtgctatttgaatcacctactccatcccattccttttctagataaataagggttccctaaaaaaaagggatggctagaatcagtggagggagtggaacgagtgagtagaattggtcagtcatgattcctaagacagtttagtgaaaactaaaatcaagcaatacttgtttggaaagactctgttttatgtagtagcttagctctgatttattacatagaagttgctggcaaatatgaacactaattctactctggtaacaactgtgattgaaataattgtagtctgcagataagctggagaaaacaagcattagtgggtaggttgtcttggacatcattccaaaagtgtaacagtgaaaaagtacgtgctcttagagaagaaaacttacaagagatatttacaagacatatgactggttcagatctctgcctcttatgtagatccgtgctaagccaaccaggcaaggaaagctctcatctctaaaaaaaaaaactaggaaaaaaggagaataacaaactcctgtggccactcattaaagtgacttatggctttctctgtcaagaaatcttggctaattatttagcatttatgagactgtgtggctgccttcatggaaatataattttcactttttcttctttaatactctatagaattatactaggcatttgtgaaatcttacagtagcccaatgcacagcctgttgggcatttggattacagtgcaacaccagataaagaggcagtaaagcagatacaaatgaaaaaaatagaaacaattgatcctatcagtttttgttcagttgaatgattgccttttgggggcattttctacaaacagttactattatcactattattattaccttagttttggaaattactatcacttttgagtgctgagtcatctgattcagtcttagaacaacgttgggaattcgtaaccttatccccagtttacagaagagaaaacaaagacttgaagaggtcaaattatttgcttaagatcctatagctaggaggtgatagggctggaactttagctcttccattgaattctaaaactacctagctgccaaccacttttgaggtcaacttgtaatgcccgtattttgcttttgctatacctatctaggtctatcgtggataagaaatatggaatgaagatgggaaaggagactcttagttcagatataatattgaagtcttgttagataaaatttaaaagaacttcataacaaacaaaagggttctcgccacctgagtttcttgaaagcaaatgatctgtgtgtgttttattgagaaatttataaagaattgacatattccattctctctgttagcaatctatgtcattttctttgtctcctagaagaatgttttactcttaggaataattattcaggtagacatcctgagccttacaactgctctgaagtcaactgctatcattgtttcaggagtctccatattactcaaagctcaagaatacagagtgtatatggatgctaaagagttgttagggtttttatactactttccggtatgctccaattcatttcaacatggaatacatatatttgtggctattggatcacatctcttcaactgagcagagctataattagaagcctgctgccatcaaaaggattaatagtcctgttgatacaaacccataactgatgacttcccagtaaagccagttaaacaaccagctggcatgggatcataatcgatcagtactgcagagtaacaaaaactgttttctatttacattagagtcatttcaaggtctaagaaaaatgttttaagattaaaaaaggggggcccattttgatgttatcatcattactattgatggatgattgaccacaaactgacccatcaaaggtgaccacatcttagaagataactattccatgatgtctgggataaagtgaagaggctttattctgtttggtaaaactaaaaactacacaacttattgaacacacatgccccgtccagtgtaaacatgagaagaatcgatattagaaagataaactcttaggtacacagctctgataagataagtaaaatggcagcatgaagaaaaccaaaagaatacaaagctttcagcttggatcccgtcaggttcagggcagtcttggggtgttgtcccaagttcaggagaaaatgttctatataaatattattgctttctcaatgatgaattcatatcatgtcattcacactaaatccattattgttattagctcacaaaatatttttctgtgatcttaaattttatgaataataatatcagtttctaatttgaagtacattgcaaagacttgcctccttttaaaattagtctgtctcataatattctggctggctagatgcttttattccagtgtaggcagtttatccaggatatccagaggtagccaggaaagcttcaaatcacttagacctactctcttggttatagatagattccataaaaatccatatccatatgatatcatcttttttatttattttgattggatcaaatgggatgcaaagcttattaatcatctagttcataattaagagtcttcagagtgtctaagtattatcagctttcattatcttcatccttgttctcctagaataggagagggtgagggaaaattgggccacttgaagggtcattcatctttaatcagttggataactaggagttatccctctataagcagaagaacttcccctcagccgatgggatcagtcttcctgataccaccaccccacacggggtcccagagaggacttctggggattattagtgtcccacatgacagtctctacagagcagggttagggttaggtacaggttgaatacatctgcttcctctgcattttcctagaccacccaacagacacatcagttattttctagggcagtttgtcctcctctatgaaggatttatgaatcagtcaacccccatcatttttgcatgagccccaggcgaggctctgtagatagcagacactatgtcttatgcttcctcttcctctccaagaaggctgcactccatctggagaggaagtggtatggcacaaggctagtgggtctctatcctaactctaccacatagctgcagggtcttgattggatatctgagcctctgcttctctgtctgtaaaatggggattatagtacaatatctactttattctgccattttgtgaggaccaaatgcaatagcatatgtaaattttatacaattgtcaggtattattacattgaattgaagaataattgaatatgaacataatgaggcagtttagaatttttttcctcccagtagcatgggaattcagagatgggagaggtcaatgagggcacaagtagtttgctgaatcaagcctggaggttggcctcgaagactgcccaaggtttgaacacaaagagtaatcagcagttgaagaggccacagagaaggcatagatttaaaattagggaatacatgggtcacattcatgaaataatgaaggcaagggtttggactgaaacatagtagaaaataaagtaagagatgtagaatgagtttaggttttagaaattcttcctagccaggcttagagttactatatgaaacaggcagggaccgtgatggtggatgaatgacatttttaattaaattaatttggcaacattgcagaggtgagactaggaaaagagtctagaatcattaggcttattgcattgactcatgtctgtggtgctgtgggcctgaactctgcctgtccataatcctggtgggaattgagagggccccattcaatttagaaagggactagccacaagagtgaggagaatttgaacgttggaaattatttcacaaaatgatatcttgttcctcagccagtcccgtccctagtaaatcatcttgggtgtgtgttattgttgttgtcattcttaagctacttaccatttctttatcccttgtaaatgatggtctccgtaacccctccccatctgtacttcatcatttttccttttaatcttaatctaaaatgtgctcagcaggtactctctgattgttaattggaacgtccactggtgaagcttgcacagtggcattgcaattgcttccctgtatctttttaattttttcacccccttgttcgcatctgaaacagaaaatgtctgttcaaccccttgatcccagcaattagctaagtggtaggcagctggttatctgggggctggctcaaacactgaatcatctctgttcaggtctgaatgggaagcttctcgagcagcaacacctataattagtgtgtagttgcaagaaaggttttttgggagtggcaggtctcaaagcggtgttcccagataagcagcatccccattatctgggaaactgtaagaaatgcaaaatctagggcccccaccccaaacctactaaatcagaaactggggatggagcccagcaagattttaacaagccctccaactgcatgccaaagtttgagaaccactaccctggagaagtagcttcacagggttcggcagccagactcagggaggtgggaaaacagactgcaggaaacccagggaagtttagaggctgtgaggagcgggtgatccttccctcttggagatgaggaagatgcccagaggaacaactgctagcagtgagattttgtgctgagagctcctgccctctgaaaaaaaacctgggtagccctcacttgccttgtgctctgaaaagataagttcttaagtcagtctttgggaaggtctgttggatcatcctgctcaagagtctttttgaaaattctatgactaagtagatgaggaaagagaaacatttcccactttgggtgagtctcattttcctctgtagaggcatctaaatgctgaggatgtacttacttgatggccaagaggaaataggagtttgtatttcaacctctaccctacaactgaacatttactccataagaatcaactctttactgaggctcttttgaaggtgctcagtcatggagtcctggtcaacatgctaaatttgcctgtggttttagtatcacacttgtttcatggattatgggagcctagaaatgaatagtctgccacttaccaagtatcttatattctctaattattaagaggatataagttaagttagttaacccgtagcaatttagggtaagtcagttttctactaccagaggcagaactagtgttatttcagttcataaaactccacttttttttttttcctgttggcaacatatgcccatgtaaatccttctgaggtggatatgcctcatcagactggaaatctaagtctgtgtgtgatccagagtcactttcctttgtagtttttttttctttaaagcacaatttctttgctagcttttgaagtttctgtgtatctagacaaggaaactcctcctactttacacaagaagggagaggtgtttgtatttcattctccatcctataatgtgcattaatcattaagatgaagtctctttgggaggaaaataaatcctggttgatatggccaactcttttgttgttgaaatatgtattctttttttaaaggatcattgaacttctccatgggttgtttccatttggggaatgaaataatggggatttggaagctccactctgtggtctctgattgtgcgagtccgtaaactacaggcactcagaggacttatctcagaggggatctgataaacagttctgttgccacttgaaaaaaatcaggcaggacatttctcctggggctgtagtggcaagcaggaaatagctaaaagggatagaaagtacattgcccgatcactcatcctatatgggtcttttgtcccagagtttcctgcttctctgcctgccccctgccccctcatattattgaggtatgctcatattacctgccagctccagccagaggaaaagccacccgcgccagcggcatcatttacttcctttagtatttcagctccaagtctagtacgcaaggaatgataatgaaacatgatgaaatcggttctaaattttttgaaaggattagagaaaaggaaaaggtcttgtatggcttcaacatggtttcctgtaaaccaggggtgttgttaaggtgcgtttttcaacacccatgtcctctagcttcaagccctctcactgtggccattgaacataagcattatgaggagggatgacagaaaggaccaggaaggtaagaaacagtggagaagtcactgcagccaattccttatgctcttctcaatacctgtttccatttatgttgaatccaagtatcctctgtggcattcagctcacatctctcccccaactattccattttctaccacagcctagcaaatacttttccaattagctgtatttctaggttaccaccaaattaaccacagaggccacgggattaataggagctagggaactcatgatggccccaaatatgccaccagtaactccaccaataacgactgtgagggcaactgtaaggttttggccttggtgaaacaatagtcagttttccatgatagtcttggaaaccaagccctttttttctctccccttgactgcgtatacatcaatcttgatgactgtgagtttataatgcacagctatgtgagtccccgctggcacaagtgagcacctgagtacagtagttacctacagatctccccatccttgcttgcttattctctgacacacacacacacacacacacacacacacacacacacacatttactctttagtaacgtatcctgcagagatgcattgtctcttcaaccctggagtctataggatttctggtcaacctagttcctgtacatttttcactgcaactagagtggctgggaactctgacacccatggacctttgggtcttgtttttgaaacaaaaacaagcacccccatggcctgagaattgcagaagtatcaccgattcactgtagcctggattttccttttttcatcgaaattagtacctgtgtaggagagcaggcctagagccatggcaggctgtgatatttggcttccttgcttgtgtctcctttcagcattggactaaccaaattccatgctgtctttctacccaattccctaccttagtgaaaacctggcaattgtcgtttttttttgttttttgtttttttttgaactgtttttcagtgttgttttttgttcagtccacctagtttgtgaatgcaaataaaggttactcttaatgcttgtctggagatttttccacgtgatttgggagatgatatagggcatgtttgacttgtagcagagatgaagaatggataaatccagtgcatggaacatgatcggagattcccacagactaacttaccctgcctctaagtgggccccgagttcctctactgcacagattcctgcctgttgaacagccaagcgttgtccttacagaagtgcaactatactaactggtattgcacacagtgatttccaaagtggcactactaggaaatccttcatcttccatttctcaagctggccctctcctggagggaggaggtctgtcgcttccctttagctaaagtgttttgcttctcttggtattctgtctcctttccctcacctcacttcaccttcacgttcctggcctgggtgttactatttacctactgatcacagaatactatgtgaatttccattcacagctttgagtgtttatgaggctttcctacttcccacccagcccaaaccttgggactttccacacactgatcctctgatcagtttgacacaggaaagcacacagaagtcttgtaccagtttgtatagtagtacccttttgaactggcgactcttgaagtagagtgtgctaggggtttgcattggctgctcgacacacacaccaagtcaattagcatgcatgccaaaaaaaaaaaaaattaacccttagagtactgcttcaaccttttggtttaatggtctgaatttgactggtcggacaatgcttctttccccagatccgagtcctgcacagaaagtctgtgcttaatctagccagaacctcacccaggatcctctcctctctagctttcttgagatgctcctgggtcctgaatttattaatcaactaatggtttttaaaaggtccaaaacacaaccactgtgtttaattgaaaacaggccccactgccaatgcgttggagggcatgaggaactgtgttttagctttagtatgtgtcctctcaaagaaagaaagaagttctttaagggttaatatgaaattaaggaatttggaggcctctcctgcttgtccttcctccagggtatctgcatgatcctctttagattcttagttcaactgctgaatgatgataaaaaatgatagtatataataatttcgaaaacaataaataaaagaacagtagttcctgaatggttgaatggaaagaccccttggcaatgcttgcttgatgatcccaggaggcagaaagaccaaatgttttcttttatgaatattcatttcatcgtctaccctaagcactaccacttctcagcatcgtgggagacaggatgatactacctgtcatttacctcttgctttttcttcttcctgtctaatagcccaatagaatcctgccagaatttctacaaagatttcacattacagatcgacatggctttcaacgtgttcttccttctctacttcggcttgcgggtaagtttgtgcaacattgttcagtatcacaatggggtgtttcagtctgggacccagggatcatccccctcagcctctgctctcgcagtcaagatatttccaggagaaacagcgcacccgcattctgattttcagtctgagagagagccctctccttagctaagcattttctggaattcacatcagttttgtttcaagggggagaaatagggattgaagaaaaatgatgatgtatccaccggtggattgtttctcatctctctattcacataatgccctgttcccttaaaaattaaatagaaataggctgagtgtggtggctcacgcctgtaatcccagctttgggaggctgaggcgggtgaatcacctgaggtcaggagttcgagaccagcctgaccaacctggtgaaatcccatctctactaaaaatacaaaagttagccaggcgtggcggcgggcatctgtaatcccagctactcaggaggctgagacaggagaattgcttgaacctgggaggcagaggttgcagtgagctgaaatcacgccactgcactccagcctgggcaacagagtaagactccatctcaaaaaaataaaacaaaacaaaagtaaatagaaataaacctcttcagctcttaaaattacgtttagcagtgttcacttagctgagccctgagagagcagttgtgagtatgaatgaaaggaaggtgaggagagtagatggatggaattttgtgtgtgtgtgtgtgtgtgtgtgtgtgaatgcgtacatatgtgctttatttatagttatatttacatgaatgagtctaatacaagtaaaatcacccaatcttccctatgaagctgttgggaaccacagaaaaatacactgcctgatctttctcttaagactagcatagcatatagttagtctatatagggctctctatggggcactagaaaacgtgtgtgtccaatcataaaagcatgtgctttgtgtagatatgagaaggacataatgtctccctccagaccttaaaaattaaatagaaataggccgagtgcagtgactcatgcctgtaatcccagcactttgggaggctgaggcgagtggatcacctgatgtcaggagctcgagaccagcctggccaacatggtgaaatcccatctttactaaaaatacaaaaattagccgggcgtggtggccctatgaaaactcaaaacttaccctttgacaaaagagtgtacattggatgccagcaccatgcttctcatgttttttctctttcttatttcttctttcccccagtttattgcagccaacgataaattgtggttctggctggaagtgaactctgtagtggatttcttcacggtgccccccgtgtttgtgtctgtgtacttaaacagaagttggcttggtaagtcagcctctctttccttctccttcctggttcctgagtcatggctgaaggacagaatttgcagtggatgagggggctgtctccctacaaacaatgttgtatgtattaatgtgaacaacgggctcttggagttttagaagttgatggtggcagctctctttggagcactagccccaaagggtttgcacagtttgcgcttcaggcagtgcagttttatcattgtcaaagcctagtggtcatcactgtcacagccagggcctttatgttcatggttctgtcacttttcattcaggaacttagagtcaggactggattaagaagcccatgggggtaaggccaactttccgagtggctggctcaggtaccccagaggcctgcctgccaaagttagctttggtctgcttccaaaaagtgggttctgcatggtctatttataggtacaaggttctttgtagggcagggagagatgaagcttcttgagtcatctctcaccttacaggagactgaggtccctttctgtgttaaggggagagtgctgctgggctgtactgtacagggcacctcctggaccaggactagaacactttagtggagaaagtaacttgaccagaggatagtcatggaagcccagggcttagagagacagcttcaagtttctcattgctgcgttgatttcattttttccctgaattcagagtattcctgctgtcatggggtctactagggaagaaggcaggccgaaacagaacctggaggactatttgtgggttccttctgtccttatttttaggatttttggcttaattatttaaaaagtaatatgcatgcattgtaatcaatgaaaacaaagatgtgtgaagagagcattcatcatcttttccccttgcctccatcactgcctcctcctttagacacccacggttcccaggccttcacatgtgcacacatgatagtgttttagagatggtggtgtttgtataagaaattgtttcaaataattacattgcaccacaatttggcttcctaactaatcatgatggacattccgtcagctctgtgataactcattttgtaagagttgcataaaattccataatttgtttgtatcgcagtatattcagccataaccctaatgatagaccacctgaatgttttccttttccttttattgctgctagaaacaatggtttaataaacactgttattcatatatttgtataattctaattctatcaatagttccaggttcctggaagaggaactgctggttcaaagaatatgtgtattttcttttgtgcagacattgatggataacttaaaaaatgttgtgtcaagataggcttccgctagcaatccattttgatgccattgctagcactgggaatttattatatacctagtgtcaagtatttttttaaaaaataagcatcttcttaatatagtatgtgtggtaatctctatattatatgcacatacacgtgtgcatgcatatatatatatatgtatgtgtccatatcctaaaaagatttcttttgctacagttttctcattagaattatattctcttgctctaaggaaaagtttttgttttggacctgagatatgcttggttagactggattttttgcttatcgtatcctgattcctccttattttctccgtatcgtatcctgattcctccttattttctccttatcctgatgaggctagtagagtcacacacaaatctgagaagtgtcctcagtgtaacttacgtggccctgggtgccagcagtcccagctgctgtagcttcactgctaactggctttgtgacctgggagctcaattttctttacctagcctgttgtttttcatctgtaagataaagatttggctagatgacttcgaagaatcttttagctcagaaagtctttaaggttcttgggtcattaatgggaaatttgggatctaggtcattggggtggacagggaagctagtagaattctatcagcagcacccctgagtcaaaattatggatgagttgttaacagggactccttttaaaacatcttgttgctaagagttcaaacacatacccatgcacacacagggaaatcgatggggaaggggagaggtgggatctgccttcttcactgagctgtgcttaattaccctgtgcactcgaacaaccactttgcttttctggatcctcagttttctcatctgaagaatgggggtttaaatgaaattaccttctagtcctcacacttcatgaatctgcactttctgccagtgtccattgtctcttggtcccctgtgggcctgggtgatggaagggctccctggtgactgtggtggagacatcctcctctgcagtgagcagaacatgcccccggtaaaagtgtggagcccagcttccttgtggtgagtgacacgttccctgaagcattttagggccaggagttctggtatgctttgaaatccatagccttcctgtggatgatttaattctgatttttggagatatgttgtgatctcataaaaaatctattggcacaaacacagaatgggggtgaaaaaaattgaataggaaataaaagaggtggaaatgaatttctaatgagatacatctttgtatcaactgtggtcgctttccaaaagaaatgtgctctaaatgtgcttccatttgtatattaatatttattgagcatctactatatgtcaggtaccattccagatgattgggaaacaacagtgaagaaatagagtcctatccccctaccctcctatactgcagtgttgggaaagcaggaaacactgaacctaataaggaagtaaatgatacggtatggttaggaagcataagtactattgaaattgaacacatagaacaataaccttttgggatatgaaataataataacaaaaataaaaaaacctctttcctcttgtaggagaaagcacctttaatgaaatgctttaggttctttggtagcgaaatctccttgggtgaaatctaaaactgatctccctgttatggaagagaattcagtacaataatatttcaaggaggttctcatctgacttaatacatgggttattacattgtgaaacaaccattgtaccaatgagcttccagagagaaaatgaacattcccatgagatatgacttataaaggagaagaaataatcccattaaataggggcatttcaggcatggctgcccttctcctggaaagtggaagggtgctgccttttctggctgaggtttgggataagatgcaggaaaccgaagtctatccccattctcctgcacaaactttcctggccctgctgagggtacaggactgtgcggtagctggctctgtgggagataaaaaccagagtgaatgcagggtccctgcccttacctgtcccagaacgctccccacaccgtgtttagttttcaattgtcggcatatgattgcgtgttgtatagtacagaatatattcattgtgcagatcatcctagtgcatgtaacggtgtactcatagagacactactatgtagtcagctcctactgtgtgatgggcactctggaaagcccctcacagacacggactcacttaatcctcagagcaaacctatgaggcaggacttgtcatttccccatttacagatgaagaaactgaggctaagagagattatcttgtccaaggtcacatctcctgggagtggtgggaggggtgcattccccagtatgtggtctgactttatgtccacactcttcctctgctcttctttctgtgtccttaccccttgaatgatttggagttgtgaggcctgggttgggaatgacagggctagttttgctgtgttgtgttggcatccctccatcggtgcttactcataaagggcttcactccaggcaggaagagagggaagagatcttatttaagactccgtgttctcctggctcctctttccccctcctccttgcccacctccagtttctagaaatgccaggaggaccagaagaatgcagagctagcctggtgtctcccgagtcctagtgcccctcagcagcttggagatccgacctgctccatctgggacagagagactggggcttaagaacaccccggatattggcgcagagtagattaaagctcagctctgagctccaccaactcagtccacatcttggctaaactgtttgctgatgggtcgctcagcatgagcattttatctgcctcaggctcagttatctcacctgtacaatgggctaattacagcacccacctcatagggattcaccgaggtaatgtgagtagcacagcacgtacttcatacgagcttaatgaacagaagccaggattacctcggtctctctttctaacctacccatcatattttaaagcaccgcaggagaaaacaaaccagaacagaataaaaaataaggcagcggatgtgaggacagtcatgtcggcaagcagcaagacgctgcttattttaattcctgtccccacccaccaacttattcattttgtttcccttacaaatccaaacctcactaaaataaatgcaccttgaaatgagagctttatcttattttgagatttgaataacatgctccaaggagaactcatatgtccgtctgtctcattctcttttgggaatgtatccccaaggtaggtcaatgggctgtgctgcctctgtttgtgtgtatgtttttttgtttttgtttttgtgttttggagtttcgcccttgttgcccaggctggagtgcagtggtgcgatattggctcgctgcaacctctgcctcctgggttcaagcgattctcctgcctcagcctccccgatagctcagattacaggcacttgccaccacacccagctaatgtttgtatttttagtagagacgggatcgccatgttggccaggctggtctcaaactcctgacctcaggtgatctacccgcctcagcctcccaaagtgctgggattacaagtgtgagccactgcaccttgcctgtgtgtatgtttttgttgagggtgatcttgtaggatttaaagaagggagtaggaggaaagtaatgatgcactcaccagccagttttctagcccatttttattacctactgtgtgctcagcactgggatgagaggaacacatgccgggccaccctgtatcctactggtactgtgatttccaacaccatcccctgttctttgactgatgaaatcggcatatgataagggaccatggtcattggaaccatgattggaaaactataaacttgattctattgtctgtatcagaactggccttagaccttaaaccttaaaaccttcagtaaactctgctagaaaatagaaaaatgagttaatgcccaatcacagggcagttgcaatgatgtagggtatctgcttataaatatatgcccaaaatagtcctttttttgtgtcagaaggcaataaaaacaggattatataaaaaaagcacaggtgcttaaaaacaacaacaacaaaaggacaaaacattgttcctgtttgagactaaagtttcaatctcattttggaaccaaaataaacacacatgcagtgacagcaggtaacactacccactatataattaagcccgtaattgcaaggtacaggctgtaaaggccatgggagttcagaggagtgagagctcatgtgggtgggagaatgaggataggcttctgtgagaggctggggctcagtggaggctgcaatgatgggctaagacagggagaatgaagcctagtatgtgtggagcatggtgtgtacccacagaagctaataacagcctagagaagaaagtggccttgctactggggaggatgaggcaggaggacccctgagctcaggtgtttgagaccaacctgggcaacatagtaagaccctgctaaagaaaagaaaaaagaaaagaaaagaaaagaaagaaagtcagaaagagagaaagagaaacagagaaagaggaaggaaaagaaaaggaaagaaggaaggaaggaaagaggaaagaaggaaggaaggaaagaaggaagaaagtgaaggaaggaagaaaggaagcaaggaaggaaaggaaggaagaaaggaaggaaggaaaataaaaggaaggaaagaaaagaaagaaggaaggaaagaaggaaggaagaaaggaaagaaggaaggaagaaaggaaggaaggaagaaagagagaggccttgctgagtgccaagcatcagcctcacaaccttgcaaaatggtgtagaagttttctatttccaagcagttctgtgggtgagaagtccaacatgggtctctccagaggctctagggaagattccatgtccttgccttttccagcttctagaggccacctacaccccttggctcatggcccctttctccaccttcacagccagcaactaagggtgcatccccaccttgcatcactctgatcttgcttcctgccatctcttctttgcctccttcttctacttttaaggactcttgtgattacattgggcccacctggatactccaggatactcttcccatctccaggtcagcctatcagcaaccttaatttgcctgctgcgttcatttccttctggcatgtagatgaccatattcacaggtcccaagattaacacagacatctttgagggtcatcgttctgcctaccaaaaggggcatattattattcccattattatttccaaagaggaatctgaggctctgaggggttgagtaacttgccaaagtcagagcccagaagagggtgcgctgggatccgggcccctgttcagatgtgccaaaagctctgcagagccttttggagtcctttgctccaggggtcattcacggccctttggggccatgcttcatgttattttacagcctgttagggaggagaccgttggggagagccttattgaagctcaacaccctcccacacccctcatttgcatggagtgacatttttttttcttttcatgggaacaggtgagttactagacagacttgcctgttgtctgttgttcttacgcaacttactctgaggtttgggtgccccttcctgtgcagctgcagtgactgaggggaacatattaggtctgcataacctccacctagtagccctcttttttaggaatcatgctttattgctttctggagtttacagagaaacccaaatgagaccaaagagttgtggtggtaggccaccattttcctaagggaagcggtggatggggtcagcacaccactcttccttttaatggttaccccacccagggctcagctgaagtctcaagcatctctctgttcctctgcttcaatggagcatctgggcccaaggccacctgcttggctgaagagccccgccccaccttcaggcagggtcaggatgattctgtgaatctctggaccttctgttgactggcctctgcatttggtaagaataatcaagaatgaaagctgtggcctggtttcagtttcctgacatcagtaattttcagtgtttgggatttaaacaaacacaaatagtatggtttggccagagagtggaggcagaccctggttggcatccccatatgcacagccctgcctcctgcctcccctttccctgtacttcctgccccagctccactaggctgctagctgcatcttcttgctgtctctgccctgtgcctggtcatgagtaagttcctgccctgactctgcaggttgtaatccttctccccattaaggcacagctctgactccagctcctgtgtgcagctttcccattctcatccattggaatgaattcctctctgacctttgtattgtgctgttaggattcgtgctataggagcaccatacgcagcctgctttgtactgacaggtaggactgcagcttccatgatagcaatgtggcagggactgtggcccccttgtttttcgctatgtccctagtacctggaacagtgcctgacacatagttcatacttgttgaatgaatgaatgagtgagtcttcttaggatcatgatagtaaggaacagttattgattgcttattaaaagtaggcactatgcccagcatctcacagtcattctctgagttaatattcacaataactcgatgagtaaatattcatagcccaagtttacagtttgggaaactgaggttcagggtctaagtaagtggcaggtccaagactcaggttagtccaattctggagcccatcttttaaaatgattagaccagtggttctcaaagtgtggttcctggatcagcagcatcagcgttactggggacttgttacacatgagggttcttagagctcaaccgagacccagggatcagaaaccgcgagttggagccagcagtctgtgttttaacaagcactcctggtgatctccagttttggagccaccgtactgacttatgctgggatggttctcgaatttttattagaatcccccagagtgcttttaaaactcttcatgttcaggccaagcctttaaaccattaacctaagaatctctgggtggagggtgtgacctaggctcagcttcttttaatgtttctcagttgtgtctgaagtgcagtcaggatgagaaccacttgtatgcatctcctaactttctaaactttactgtgcatgagaagcaccaggagatcttgttagaatgcagtttctgatttaggaagcctatgctaacgtcagagatctacatttccaccagctctcaggtgtagtgattctcctgctctgtggaccacactttaaatagccaggcttaccaatccacttaaaaatggccaaaaccacaattacttttgcaccaaactaatacactgtgctgtccagtatggtagctcctagccacatttgcctatttaaaagctcagttcctccatcctaccagctgtttttcaggtactcaagagccccatgtggctcattggctgcggagctggacagcacagatgtggaacattccatcatcatagacagttctgtgggaccacgctgctctagaatgagtctgtgacagcacacaccatggctttttactttttgtatgcccaggacactcttgcacatagtggaagcttagcaaatgttttttgaagtgattttgagtgaatggaccaatggtaaaaattctatatctaaaagaaataaataactttcctgaagaaatgctagagaaatcatgaatacactgttaaaaggaaccctctaccaccctacccaaattaaattaaatatacttaaggactcagtaggccaaaaagcacaagagacactggaccatgctccagctccaggacacactactctgctgctactgaaatggcattttgggctctgaaaggaaaggtctctggtgccccctagaggctggtcctgcaatttgctggatttgtgagcaattaagtagcaaggggagaggggaagggggccaatttcatcatgctcagatgggcagttcgtggttagcagtggtggagataggctcactttgaactcctataagctatttgacatctgataacttgactcaaccgctatgaccaaaagcacccctcccccaagggagttgcttctcagtgacagtgcccgaagcctggaaggaagggcccctgagtgcccccagaggtcacccactccatgttccaggcagctgactttcaacttggacatctagattccctgaagcccagagccttctaagtaaactgctgtctgtagtctgtgggtttctttagaataagaatagtgaaataaagaaaagaaaaagtatgatttccctttttgggccaggtgtccttaggagagtgggggttggggggtttgagagaaagagaaatccaaaagaaaagtgcttccataactagaataaagttagatgtgttcatattacacatattacatatatgtgtatatatatgtatgtatgtgtatgtacatacagtatataattgtctcaagtgctcttccaaacagtactatgaaataggtgtcatttgggggcccatattacagatggggaaactgaggcttcagaaggttaaataaattgctgagagtcacctagtgagtaaatggtagagctcagctttgatctcaggcaatctacctccaaagtccatgttacttgatatgatactatgctgtctctcaagctacaagttaacacatttttaataacttaccagcctccaaactacttttttcccccatgttcaccagtcccctcttctgagcttcttgacccattctatacaagtagccaaataaataaaaacaatccatgtttttaccattagtccatgttgaaatagtatcatgctagatgttatgggctgctatggtctgaatgtttgtatctgccccaaatgtatgtgttgaaatgaaatcccaatgccgtcgtgttggagatggggcctctgggagatgattagatcatgagggtggagccctcaggaatggtattggtgcccttatgaaagaagcccttgggaggctgtttgtccctcccaccatgcagggaaacaagaaagtgccatctatggagcagagaaaaaaccctccccagatgctgaatctgttgtcgccttgatctgggacattccggcctttagaactgtgagcaatcaattgctgttgtttataaattacccagtctaaggtattttgttagcgcatatagactgacatggggctctactcttggcttgagcttttttttttttgtttttttttgagaaagaattcaatggcaacatacaccttatgaatagcattgcaactgaattgctctagtgtgacaagaaaaatgaactcattattaagttctgtccctatgattgggctctgaagaaggcagcccagccaagtggaatactaaaaatttggatgtatttcagggagctcattgctgttccggtcgctgctatagctaaaactgcttctagagaaattactcctctccaagagatttccaattgtgttcccttgatattgctttgtcagggacacgctttaaataagatgccctccgtaagtagagattctaaatcctcattgatttgcatggctctgttatatgccaaattggaaataccatcctaaaatgaatgtcttcaaggaacgaattcagcagtaggtttgcatggatgccaaaacctctccagatggctgtacttcatctggggtattattggaacagcctcctcagcaacctaaatctctaggactggacgtatatttaccttcacatcatcttcaaaaaatagatgccttgattcttttccatgagaccagggccataatggattgacctggctagcagatcagatagggagaaaatgaacacctgaaaccagctcagggattcgactgcattattcagctgaacacctactgtgtgcaaatccctaggtgctaggagtgacccaaagatggggaaaacatagatcttgcctctataagatgttaataacttaattggagtgtcctctagaaagaacagtaagtttataggaatttagaggaggaacagatggaggaaagttggccatcccagcccaaagaagatttcaggtatctaaaatataaacatgtttctcctagagcaggactactcgaggtgcggtctgcaagccagcacatggcctgggagcttaatagaaataaaaatgttggagttcaaccctaaacctggagaatctctgaaaggtagggctgaggaatctgttttaacaaattctcctggtgattcttctatgggctaaatgatcttggcagtatgttagaatcacccaggaactctgacacgtcctcctggccagactgtatttctaaccaagcatatgagaattggggatgaactcagtcaccagaatgttttcaagttctctgaataatttcacttgtgcagccactgttgagaggcctggcacagtggtggttcttaaaccagaggaacatacctgaatacctgagaaacttcaacacacacacacacacacacacacacacacacacacacacacgcacacacacacacgcacacgtactttccgaaatctattctgtgaggctctttgggtcgtggtaaggacaattgctttggaacaagcacactatgtattctagatagaccagtggttctcaaactttgagtgcaccagagtcacctagaggtctggttaaattacagatttggggtgttccatccccagagtttcagattcagtacacctgggatggggcctgaggatctgcatggctaacacattcccaagtgatgctgctgctgctgatctgggggccacactttgagatctgctggtccagcccacggtgaggctgaacttgaattctagttgtagctgctatgcaagtttccaggattctggtattagagtaaaccttgctattttgtgctcctaaatatcagtattcttattaatgtaatcctttatttcatatgtttttgagattaaaatctgagtcatttacatcttgagatatactcatcctatgatattccatattacaatttcaacttgaacagcagaacccttttcccatagctcttggatcttccacttgtaatccccttctaaggtattccaagtccttggttactagtaagaatgagcacctttgcttgactttattagtcactagtattttgtctagagccaatttggttgatatcgcttcctaaactctctgaaattaggatagggtcaactcattcaggaaaatagatacagggtgtgttggagattagggaaggagaggggcggagggaggtcccaggccaaatttctaactcatccctagagtctcacctccgatgttctcccagggatggagcctcacctctgaccttctcccagggatggagcctcacctctgaccttctcccagggatggagcctcacctctgaccttctcccagggatggagcctcacctccgaccttctcccagggatggagcctcacctccaaccttctcccagggatacagtatctcagcccgctcctcgagggaagggctctcttagggtccagcctctctccaatagcagggtgacttatttgaacaaatcttctttcccagtcatctcacttgcagacactgagatgcccaggcctgggcccaagcctgctcatgagagtaagaacagatgataggtggtgagcagagctccatttttcttttttttaaatttatttttattattattttttagattgggtcttgcattgttgcccaggctggagtgcagtggcacaatcttggctcactgcaacctccgcctcctgggttcaagtgattctcctgcctcagcctcccaagtagctgggattacaggtgcccaccaccacgcccagctaatttttgtatttttagtagagatggggtttcaccatgttggacaggctggtcttgaacacctgacctcaagtgatctgcccacctcggtctcccaaagtactgggatacaggtgtgagccactgtgcctggcccatttttcataagacacactatatcactcgaaataaatgccaaacactagtgtggtgacactttgctcccatatcacaatcactaaattcgacttacccctttaaggccaggtaggaatttagcaacccagctcataaagggtaaaattagcttattatttcctgagtggattgcaaacctcactggccagattgggagcacagcagatacttcctttttgtaaaaacttggctgagtgtggtggctcactcctgtaatcccagcactttgagagcccaaggcaagaggatcgtttgaggccagcctaggcaacacagtgagaccctgtctctacaaaaatttttttaaaaaattagcccggcatggtggcacatacctgtggtcccagctactcaggaggctgaggtgggaggattgcttgagccttggaggttgaagctacagtgagctgtggttgtgctactgtactccagcctgggcaatacagtgaaatcccatcttaaaaaaaaaataaaaataaaaaattaaattaaattaaacaaacaaaaaactcagtctcatggtcttccttctttatattctcacctagccttcttctccagccctgtttgcatttttgtgaatttctcccattttcactctagccagcctacttaccaaccactcctacccaatctcagatatgttccatcgccatggttttggtagtttcttgtctagcagctgctttcttgtcttctctgcttacctgcactcaaccagttattatcctgttacttgcctcttccaaaaccactatagtctgagccactcttttgatcatgggtgatcttctgatgtggttgtgtttttataagtaacatgtacctgtcctgactcatcaactagatcaggagttagccactctggcctactgcctgtttttgtaaataaagttttcttggaacatagccatgttcattcgttcacatattgtttatggcaatgacatgaagaagataggacccaaaaaagccttaaaaaattattatctttctttttagagaaagtttgctgatccctggtctagatttgcagctatgttatatattcttttatattcctctaaatgtctggcactatgttttgcatacaatagctactaatcaattttgatgacctgaacatgaatttttctctgaaatccttataaatgtaataggaataaaataagttatttttgctcttgttattgttattattattatagctgctatgtacagtcctgctacataatgtttctgtcagcaacaattcccatatgcaatggtggtcccataagcttataatatgtatttttactgtatcttttatatgtttagatgcacaaaacttaccattgtgttacagttgcttgcagtattcagtacagtaatgctgtacaaatttgtagcttaggagcaataggctataccatatagcctaggtgtgtaggaggctatacaatctaggtttgtctaagtgtactttatgatgtttgctcaatgacaaaattgcctaatgacacatccctgtcattaagcaatgcatgactatattttgtggcaggtattggacaaagctctttaccggcctatctcatttaatcctaacacacaggtagaggaacttggaacttggagaggtgacctgtgtgacctgtcttacttgctgtatgacttcagcaagtgatacagcaagaattcgaactcacatctttgtgatctcagcgcctgagcttttaattactactatatacccacggtttagtagtaactcatacatgtgatgagagacagaaatgtttaaaagccctaccaatgagataaatcatgtaaagaaaactggcctatgttataaataggctaggagcaagatgaagcaagtgaccctgaaagcgagggcctcagctgggtgcagcagctcatgcctgtaatcccagcaatttgggaagctgaggtgggaggatcgcttgagtcctggagtttgagaccagcctgggcaacatggtgagaccccatctctacaaaaaatacaaaaattagccagacatgatgctgcatgtttgaagttcctgctatttgggggctgaggtggaaggattgctcgaggaagtcgaggctgcagtgagacaagatcatgccattgcactccagcctggggacagagtcagcccctgtctcaaaattaaaaaaaaaaaagaaagaaagaaaaagaaaatgagcgtgcctttcaattttgttccctggatgcatcactgtcttaccctagtctctgccctggttaagaaacttcataaatattgccggtttcattattatcatcatctttattattatcatcattcactcaacaaaccttaaaacaagtgtaatgtgccagctgttgtcctaggcttggagtttaaactaagatattttagccctactataggaaagatgaatctataaaccccagattgcaaacacaaatgcttacagggacaagaagataacaaatgggtgaagcaggccaggtggaggctgtctctagcaggagagtgaatgtctctcttcaaaggaaggctgttccatgaaaaagaatgaaaccctgtcatttgtggcaccgtggatggaactggaggtcgttgtgttaagtgaaataatccaagcacagaaagacaaatattgcgtgttctcattcacatgtgggagctaaaaaaaaggggatctcatgaagatagagagtagattggtagttatctgaggcagggaagggtaggaaggaggggaggatgaagagaggttgattaatgggaataaatatacacttagatagaagaaataagacttggtgtttgatagatcagtagggtgaccagttaacattagggtgacaagttaacatgaatcaattgtacatttcaaaatagctacaaaagaataatttcaatgttcctagcatgtagaaaagataaatattttaaggtgatggatgtcccagttaccctagtttgacaatatggatgtatcaaattatcacatagacactgaaaatacatccatctactatgtattaattttaaaaagaggctattgatcaacctttggcaaggtcttgctgtattgacagcttctcaatgtccactagcagttacctccttctccccttcatctttcctacattaaggcaaaaatacagtattcagttaaaactcctcctcccctccttcttttcttcttcctcttcatcctcttcctccttctcctctccctctccctccttctccttttcttttccctcctccatgtccttcccctcctcttcctctctttcttcttccttcccttcctcttcctctgaatcaatcatttttggccatagcgacttgccctttgcaaactagtatgtgttgcagtattatgatttctctgcttgagacaggaacctctggtgttttggaggaaatttcatcttgggctgctccccttcttaccacatctgttgcccagtatccaccacaaagcctgtaacttagcatctgcctataacaccaaacaggttgcatcagataaacaaaaattcttactgtggtaggtgaatattttagcaaacgtaaaatactataactcgaatttacaaactgggtcagaagtgctttctcatgttttggtgtctggagcaacgtgcacatggtcagaggacttcttatttcaattttcttgtttgtttatatttattttatgaaataaatagcctcccttccattagtacaagtacttctggtttgttagagacgaagggccccagctccactgggaacaaaggggacctataggaaacacaagtgtcgccagcttttccatgcactgacctgccctaatgtgtatcctcctcccatagcccgcagagactccccaacctcactttagctcaactgcattttccccagactgttctgaaaaatgtgttgtgacgtgctgccacctagtgaaggaaagtaggaatggacattatagtggctgtcgccctcagaatcctctttgaagcctggtttagttaacctctgccgaaataaggtcctacgtttttaactttcagaaaataactcttataagactcccaaagggtccaaagactatttagtgaagactgaagaagacaaatgtcaagtgaatagctaagagtttgaaaagtaggtatacgtgttcgggctaagtataaatggaaaacaactccccgcagaaaaccattctaattggacttgcagggcaggttaagaggaggaagtcagcccgactccagagtacagacattacctgttttcactaaaataaaggactgtcttcaattgtttgcattatcattttatctccgtagaatattttccttcggtcttttgactgaattggttttgaatttaaaagaaatattgaaatgatctgtcactttactttttgcctatcaagctgtcagcttcaaaaaatgaacaaatgtatggattctgaatagatatgtttctcagacctaaaaagaaagaaaatgtgttaataaacttgcgtctagtcatcatatgtgtacttcaatgtgtcagaactgatttatgaaccagaagtactgtgtttaagtgaggacttctctgcattcatattttaagtattattatttcattctttcctcttggggggcaagttagtataatattaccattgactaccgttgggtgggtcccaaaggtcatttctgtggaggataatagagcttttcatatgagacactttcagctgcctagcagaggcagcacactatgacaagtggccaaaaaaaagtagtgaatatttttatcgtgagttttcatggcatgaatcaactcattcttcagaagtctgtatttttttctttctattatggcatgtctgtcatttcctttgactctctggctggtcttcatctcagcaaagtggaaaaaacatattttagatgggaaaaaatgggaagaaactgaaagagggaaaatatccctaatacaaggagaaacacaactctagattccctattgccatatggaacatttaggatttcccaggaggaaacacgttcaaccagttgcttctgttacctccggactaagagggatcctgatagtagctgtggctggtgaaggaacacctctattatctggctctgggtgctgcagaaccaggcagttaacaggacaagaaaaccaaatgatccatgggtgcaaatgtgcttttgccaaagccacttccctggggtctagatagcgaagagaaatggtggcttctagaggaggaagagctaggaagtaatcctggagtccagttgtcttttcttaaagatcatgtttcaggattccaaaaaaaaaaaagaaagatcaatggcatgtaggagggtgggggacaaagagggtgaattatgagtttgtgtctgtgttttaaaatagccacctgccttgaaactgccatttagaaatgtgcatggaaggagaatcttcctgattcttagctctaatttatggccaatttatgaagtcaaggtcatctctcttcctgctggtgtgtgttcaacctggcctccctttatgccaaagaccttgagcagaccttggctaaaacccccaggtatactcccattcactgtcagcagtgatccgtggaatggattggggctggccgccttgccttgggcagagttcatgtgtcactcaggaagatgcatcaggctgctgagtcagagggagtctgccttatgtccacagagaggagtgaatcagaaagccagatgagtccagctctcaggacatgacaaattgcagaatgccgagctgggaggcttgagtacatcatatccttcttattctactgatgagaaaactggggcctggggatgcccaggaatttgcttacatttcttctcctaatgaattaattctttcatttgttcaacagtgatgccctgagtgtctcccgtgtgtcaggctttgttctaggtgctggggttagaaagaggaagagtgtcacatgaggagaagacacatgtcacaggtcattctaaaagggaaacccaactgagaatgaagagtgtctcagggcagaaaaaggaaggagcaaagacatccaccttggcactagacaatttgggtcctgatttgacagtctttagtaattagcataaccatcagtacatcatggaagcttaccccatgtaccatttcttagctctcctcactgttgtgattgcaaaggtgcttggaaggttacttgatgagcctctttctgctgctccagacccagactgtgagttccatcaaggcagggatctttctcagctctctgttttatccccagaatgggacagagcactgcacgcatgggagatactcagtaaatagccactgagtgaacaatggaatgaatgacaaatgataagggttcccaagttccattctatagaataagggtcagcaaaattcttccataaagggcctgatagtcaatgtttttggcttcaggggctgtatgatctccaccaccaccattcaactctgcctctgtggcatgaaagcagccataggcaataggtaaaagagtggacatagctgtgtcccaataaaattgtattcgggacactgaaatttgaatttcatacaattttcatattccataaaatattctaatttttttagctgttttaaaatgtagggggaaaacatttttagctggtgtcctgtgcaagaactggtggtggccagatttgtctcacaggctgtagtttaccaacccctgctataggaggaagattaatagggtaaagattttatgaggtttttaattgattcatttatccatatgtttgagcatttacttactctatgtcaggctctgtagcagacactggacatacaaacagaaatattagtcaccaatatcaagatgaaatcattatccttgatgggtcagatcttccgaggatgagtcacgaccgtgtaggaaatatgaaccccgcagtctgtttaattgatgtatgctatgcactctaaaattaattggagatttctagataaaactttccaaatgtcacaagtatccttccagcatttcatatttacagactggaaaatcaatggagatggaatcattctcccactgtctctaagttaatttgcctgtctaatgctttaacactttctgctagttctgtctcattctttacccattggagagtaccagtgggttttcagataacttccttaaagaccagaaagaaagatttaaaaaaaattccagctccttccttttggctcgggtcttccaggtctttatcttgatgaaaactggaggcaaagatgttatctctggattgtagtcagagaacaacaaaaacccccatcttttctttcccaggaaaatattaatcaaaatagaaataaggtgagattagaaccttagaaggttttgcataatacttttcttgtttgactgtttctggcctgtcttaatccaataatctattaaactctagctagtactttctttcttcatccccagcaaatttgcaatcctccagaatccttttgggaattccaaggcaaacggccttaaacaagaacataattgtctgagagattttgtttgcttatcggaactgtttggtccacagcattatctgcatgggggcataattcccttagctgcagtcagttttacaggtctttgctcataggattacagttcttttacataaaaggatgcttggaatgggggccaccaagagtgccaatatttagtatctttaactgagctcaaagtaataactacttaactagaatcagtgtgcttcttgatatctaggaaaaaaaggcaaaggaaggaaagaacaggatttggggatgtaatttgagattaataaatgattcactcaatagatacatatggatcatagcactctgcttgttgtgcatggtatactgtgaaatgtaagacacaatttcagcctagagtagcttaatctagttatagatatgggaattccaaataccttttctacaacaagagttcaaagtctttcataagtcaatataacaaaagatgaataaatagttaaataatactacagaagagtaaacatgagaagacatgcatttaaatgtatgcagagcacttattgctttggatagaattcacatgttatccatgcgttgactacaagatacatgcacatctctaaacacactcataactgaattcagcttaataggatagtaattgaatgatggaacctagtgtgcctgacttttctcagatgaaatatctggctggtgcaatgcagtaactactattaaaactccatcaggcatggtggctcacacctgtaatctcagcagcttgggaggccagggcaggaagattgcttgagcccaggggttgaagaccagcttgggcaacatagtgagaccccatccctacaaaaaaaaaaagtagttgggcgtggtggcttatgcctgtagtcctaactacttgggaagctgaggcaggaggatcgcttgaggcaaagaggttgaggctgctcagagccataatcatgccgctgtaccccagcctgggtgacaaacacagagaccctgtctcttaaacaaaactcactaggatataccagtgagtccatatgaagaatcctacccatccttctcaccttggcctgaatgaatgagtacaagtgtcagtaaaacagctgttatttatttccttatcccacatctgtccttgaaggctgtcatgtggtcaaggaccatggagccgacagacaatgtttctatcaacaggcagttcaaaccaagcctgtggctgaccatattgagtggatgaaagagccttggagggactgggccttttagaaaaataggctcgtaagtcaagagcatggtgtcagctgtctgtgtgtatttcatggtgagagtgaaagcagatctaaattatgagttgttgagtcacctgcatgaatcaattcaattcttaatttgaaaggaagctcagtgccaagggaacataacatatggaaggagtggcctcaatgactaacaaaaccagggcctattagggttgcctgagtttacttaggtgcatttataagacatgacatttccacagctgttcaactatgtgaaaaccttttgtaagcattactgtatttgataaactctgtgagatggatgttattgttatctctgaattggcagatatgggcaaggatgttccaagaggtctgcagtgtcacacaagtagtaaatagcatagcctgggctagacttagaggtcttttaaccagtcacattccccctcagcagtgagaactatggtctgcccctgctccctcagtgcacgccaattagttaggcctgtattcagatgggatgagttatgttctgattaggaaccacatgtagtatatgctataagttaaaagtaggcagatgtgcctgtagccatagggacttgctgggggagctggacttgagttgagtcttaaaacatggaaaagccttaactaagtggagtggagggccaagagcattccagacaagagaaaaaggtgagcagggggaggaatttgcatccttctttggggagccaggaagtggactggtgtgaatatttcagagtgatcatatagggaggcagctgagggatcctcagtgcgtggttatagtaactggagtggatttactctggggcaggacttactccgttgacacccttggagaagagcaggggaacaggaggagagccttcccagttaccctgttagggaccttctctttgaccgtgtcctgcagatgcacagtagttgggattcatccacctccatccacttatttctttttagctcattttgtttcattcaacagacattcccattaccacattctaggcactgtgtcaagtcttactgaagttactaaaaggaaccctcaatgaatgttttgtgaatttagacatgaatgaatgaacaaaagaaaagggacaagggctggtgagctcattcatgggggagaaggaagtaagtaaagaattccagtgtgttgcattgaatatggcaggagagtgctgggggaacaggcagaaaagagacagcctgacgtgtcccagggaagactttccaaaaggaggtggtgttctggctggttcctggagtctgaagtagaaatttgttagctacaggaggggggaataggcaggtcaaactgagggcaagtgtttgcaaatgaacaaaggcctgaaaattaggggaaaagcaaggatgtaggtgtaacttaagttgaagtggagaagaaggtaaggacagaagaccagggaaaacatttccacctgagactgaacagaaccacctggtccaaggtcacttcgttatgtctttaggcaagccctgggccaaaatggtgtggctctgggaactttgctcactcaaagccctacataagcccatctttcccataagaaggctgagggaacatctatctaagatagatgctagtaatttaacaaaaaaataaaaggcaacgatactatagggaagaaaagaaagaaaggagcggatgatgttacttggctattgttttcctaaaacaaaagcaagaaatgaagcatcttttaagagctggcctagaatgccattctgggggcttaggaaaaaaatcaaaatgtattagagctctctcagacattggatggtttatggcagcatctaaaattgctggtaaaattatgaccttgtaattcacagccgtgtcatatattctctagcacacagtgtaatttatgtaccaagccagttgcttcaaaaaagaatggggaaaaaactcacacaacacaaagtttataaaatgtggttatttttaatggataatgtctttagcctaaacctgtgttgttaggaggaagggtgtgccgttgctcaaggttattaccacagttcttgcagcatggggtgagagtatgaggattacttattacacttacgcattggctggccaggctaccatatccacaactacacagtcctcccttcctccctccctcaaagagagctatcaccttgaactccttcttcccttgaaataaaacctgggcaactaccgaagcttgaccttgactcatgccttaaacctgagcacaaaacttaacctctgctgggaaaccttcctccctatgaaacaaaggggtctcaagacaacttcttagcaagccaaaaatgagatttccactcagcttctcaagttagcctggctttgaccccagttatggagctagagaggggagaggagctgggagcaaactaggaatcatggagggggggactatggggaatatcagattcacacaactctcacttccatgaaaagggggaaggggagagagaggagactcccatggccgagtgatcaggtccagagacctccttgtggtccaggctgcacctgcaccagtctgcttgaccttgagcaacaagctatagtctctgaatcctatcaccctcacctataataaggagatgagctcttgccttcactacctaaaggagttactgtgaggatcaaagggtctattatagcttttaatcttgagccaatgactaggtcattatttttctcttgctctgcctgtatcattttctcctcatggcatacagctcttttgcctcaaagaagattcttgaggatgatgacctgcctcaaacttccttctccctaaaagtgttttcttttgttcagtttcatttctgtctttccacttattcctgattattttccctgagcctcttagagatctgatcacctcattgtataggagctatttacactccttctttgatatgaccacatgcttctctggatctgattcttaattctttgctacttccctccctgcccccaacccatgggggcaccagaagctgtgggaaaggaggcagcccatcgctaaggaggaggaggaccttgtcagggtgttggtggcgcaggtgaccagaggacagagctcactgctgtgatcctggagagggtgccaggacgctgttcccattaaaggcagtggggcttggagacactgcagcctcatgctcaggcctcctagactttggcccttgctgtggggctcgcctcgctgaaggcaggatgaagggcttatttttctggctgagatattgcatcccagaaaccacagaaatacttccaaaacccccaagataagagtgctcttattttgctccagcgtgaagaggagtttatttcatatgatcaagtaaagcaagtctggacgtcttccttatgtattttcaaaataattattttattatttaaaaaactcaacatattcatttaagagaaatggaagcaacacagaaaatgccaagaagaatgtgtccaacaaaccaaagcaaatatcataaaacatttgatcacattggataaagatcattctagatatttttctgtacagtagataagtaaataagttagacaaacagaaatttatataaaatgaacttgtactagcctcccgagtagctgggattacaggcacttgccaccatgcccggctaattttttgtattttttagcagagacagggtttcaccatgttggccaggatggttttgaattcctgacctcgggacccgcctgcctcagcctcccatagtgctggggttataggcatgagccactgtgcctggcctacatgtttttttaaaaaataaaactgttaagtttaagcttatttgtgtagtcacccagtggattttccctgtctgctgcacagacaaaagtaattcagtgagatggcagtattgctgtaaagaaagagtttaattaatgtgagtctggccaccctggaggactagggttatccttcaaatcagtctccccaaaggctaggaggttaggagtttttcaggatggtttggtgggcagggggctagggaacagggaatgttgattgcttgggggtaaaaccacaagcgtatggaaaacagtccactcgtgttgagtcctctgggtggggaccacaggactggctgagtcatgagtcttgggtccaggtggggtcagtcactcgccagaaatgccagaagtctgaaaaacatctcccagggccagtcttcagttctacagtagtgatgttatttacaagagtaattgaggaagttacaaatctgtgacctccagaacaatggctggttatcatttaactgcgcttatgtgttagcagaattcaggcacctcttataaccctaaccttatggcctttcgttagttttacaaggacaatttagttttgggaagggctattactgtccttgcttaaaggttaaactataaattcctcccaaagttagcttggcctatgcccaggaatgactaagggtagcttggaagttggaagcaagagggagtcagctctgtcagatttctcttgttgtcataattttgcaaaggtgatttcacttgaatgtagaaaaattggagaaaaatgaagcaatcgctaaactttgtaacttttacctcctaagacatgctgatatgaatatgagaaagcaattaggagaaaagatgaaggtagagtcatgttttcatttaacttttttttttttttttttttttttttttaagatggagtctcgctctgtcacccaggctggagtgcagtggtgtgatcttggctcactgcaaactctgcctcccaggttcatgccattctcctgcctcagtctcccaagtagctgggactacaggtgcctgccaccgtgcctggctaatttttttgtatttttagtacagacggagtttcaccctgttagccaggatggtctcgatctcctaacctcgtgatccacccaccttggcctcccaaagtgctgggattacaggcgtgagccaccatgcccggccaactttgttttttaatttggtgtaaaacagatgaactttctgctgtgaaagaagagaaaatgacatttcattttctcccccatcctttcccctcacttcttagttatgtaattgtttcactgtgtcagggttttgtgacattctcttctgaggctatagctttcaattctatttagccttagtaaagtcttgcattttaaagtgttcagtactcacccaggttcattttttgcatagcatcttcttattgttttagttcagatcgtaatggtggaggaaccgtttccatgggactgagaagaaagacacttgtgttgacgttcaggcatacagggaatgaaatctcgggggcagcatgggagaggcagccagagccatggctgagcgtgcttccagggaggcagaacagggcagggtgagcacacatctggagttccactgcctaaatttcaaccgcggctccatcatctcattgctaggtgagcttcggcaagatgtttaagctctctgtgcctcaactgctgccacatctgtaaaatggggacaaccatggccaccgcatgtaaggtgttgtgggaataaaatgagtgatttaaaaatgattacagaggtatctgactcactgtcaatgtttgctcttgttatagaatcacactttttggagatcaatagcaggcaggaaagaattctctgagaatctcacagtcatctcctttctttagttgtttgcagggatcttttaaaatgtcaaccctttttcaatctgcttttgtggcccacctctttaaactttttccttcttcttagatggaaaccaagacctccttacggcccataaagcctgccatggccttagagcttctgccttctcctgcaccccccaggcttcttctccctgcctcagcaatggcaggcagcaacccgctcctttggatggcacttgcccctgcgtcccctgatggcccactctctcccttcagttctccactgatctatcacctcattagaaaggcctctgtggccacacagtctaaagtgtccctcactggaatttgtgtgttttatagcaatttatacaagcatttgcttgaagcaatttgtaattagttgtttgtttgcttcattgtttagttgtttcttgatgtgacttgtctgtactactaggccgtaacctacttgtgagcagggatcatgtctgtcttattcagtattttcatccaacacagagcaatgccaggcaccagcaggtgcttaataaatatttattgcatgaaatatctctgcctctatatatctgtatctctatatagatacagatggacattgcatattaaggtacctacctgtagagaggtagctacacagctgtctatatggatatagatactcactaagtggcctgaattattcaggcaacagtctttccatttcatcattctattttctctttatatgacaattatctaagtaatgaagaattggaatcagggctaggggtggttagaggaagaaatttgaaaggcaagcgacattcattgagcattagttggtggctgcacagtgctggatgttttgtgctgtaattcatttaatttctatagtaacctgtggtattagtccattcttacactactatgaaggaatcctccagaccgggtaatttataaaggaaagaggttgaattgactcacagttccgcatgcctggggaggcctcaggaaacttacaatcacggtggaaggcaaaggagaagaaggcaccttcttcacagggtggcaggacagagtgagttcaagcaggggaaatgccagatgcttataaaaccatcagctttcttgagacttactcactatcacgagaaaagcatgagggaaaccgcccccgtgatccaattacctccacctggtcccacccttgacaggtggagattatagggattacaattcaagatgagattttggatggggacacagagcctaactatatcacctgtgaacaacagacattttctcattttacaaatgacgttgggaaagttaataagcaacagagctgggcccggagactcctgtccattaggtaatgctgcctctgagagaagcaggacttggtgagcactcagcaactttgggcagggtgcaacacctgtaaactccaggatgtaagttgctcatgcagctcccataaatgatttcaaatcacacgtgaaaaccattatgaatctgagaaatgcagaataaaaaaatcatcagggtgggtttgggttcattaaaaaaggaggtgaggctgggcatggtggctcatgcctgtaatccagcactttgggaggccaaggtgcttgagcttgtgagtttgagaccagcctgggcaacatggtgaaacccatctctagaaaaaatacaaaaaattagctggatgtagaggtgcatgcctgtagtcccagctatgcaggacgctgaggtgaaaggatcctttgagccctggagactgaggttgcagtgagccaagatggtgccactggactccagcctgggcaatagggccagaccttgtctcaaaaaacaaaaagaaaaagaaaaaaagaagatgaaatcagaagatttgggtgtagttaaggaaacatatttgtcagcagaattttgggggtgagctggaaattatggaatgcttttctgggtaaaattcaccagtctcaggccttcttttcccaaaatgtgcttcatggagtgttggattacactgaaagttggcatacattatttggaaagagaactctgtgctccagtaagtttgggaaatcctcatttaattaaagagtttcttaaccataagaatcctcagagccttccatatgctaatgtgcattgtcagtttccaaggctaggaagtggcatttctctggatctataaggtctcaagatgcccttgagactgtattctacctgatgcatggctccaggggccttagtggggagcgccacattttccatgttctcatgacagcaggaagccctcagtgaatggaggtacagtgtgcagggtcgcaatcagtcctttccatccgccgcttcatttaagcctcacatcaacctaagacataggttttattattcctgggaggctggccctgttggtgcctgtcaccgcaacccagacccgcttgcccttacctgtagtgcaggtggctagattttgaattgccagcatctgcatttctttgccagaggactttctccagtcactgaagcttgcttgtgggcctgtctacaggtcgtaagtgctagggacttaatgcctcctcaaccagtgaccaacaggaggtgttggatcaatgccccagccccctcaccccttggtcgcaaggctcttctgtttacacataaagccatgtgtagatcctggctgccagagtaccccagtgggattttcctttagttgcccacagtgataaatgcttgataacaaactctttatggatgctttcccatctcctccccactttcctgttcccttactggtgtttcctgagatcacttcccaagttaactatttgtaatcaaatccttttctcaggttctcctgcagaggaaccccaactgagacatcccattttacaaaataatgacaacagcaacaacacacacacacacacacacacacacacacaaaagcaaaaaaacagaagagtctccaagaggttatggaaggtgccctaggaaacagcttatgcatggtagaaccaggacttaaatttcacaacacatttatttagcacctgctatgtaccccttgctatcctaaatgctgagatgacaagatgaaaaagacagtcttggaccctctgtcctaaaccataggcaaaaataaattagtccaggcctgtcttcaaagcctctgcccttaaccacaatactctgctaattctcccaggatggacatttgactctcttttaaactgggagtccatttccataccacccttatgaagagaagctgtggtattcagctcctattctgccctctaggccatgaaaaaactgcatcagatcaagacttttgattcatgaaatatgctagagaaaattgcaagatttcctgactcaatgattttcctgcccagtgtaacatctctcttaattagtgagttgcaattagcatttataaaaagaaatcattgcacaaggtgagtcaactgagatgtaacatcttgctctaaacactgtcctcctggtgtgagtgggatcattcagaaattaggtatcttaatcagctgagtgctccagcattcaaatgtatctggcccagctgggaggccagagtctgtggcatgcataagaagcttacaggagggagggagttttctgtgtacactagcatttgttcatagttgcaaagtagctgtagaaactgcagatttatggccaggtgtggtggctcatgcctgtaatcccagcacttcagaagggcaagggggggcagatcacaaggtcaagagatcgagaccatcctgaccaacatggtgaaactccatctctactaaaaatacaaaaattagctgggcctggtgactctcacctgagtccctagctacttggggaggctgaggcccgggaatcacttgaacccaggaggtggaggttgcagtgagctgatctggcaccactgcactcccacctggtgacagagcaagactccatcagaaaggaagaaagagaaagaaagaaggaaagaaagaaagagagagagagagacagggaaagaaagaaaggaaagaaagaaagaaaagaaaagaaagaaagaaagaagaaagaaaggaaggaagagaagagagagagaagaaaagagagagagagaaagaaagaaagaaactgcagatttatgagaatgattgttatttttcctactttggctatttttaaagttatatttctttgttactgagtgacctccagaggcagagagccacattataattatagaaatttgatctgaatgggatattaagggttatctattaccaacactcccagtcccttcttcctcccttccttctttccttccttttgatgagaaacctaatcacaaagagagaacatgacttgtctaaggtaacatagtgtgttggaatactcctgaaactagaacctacttagaatcaccagaaacttgaagttcttttgttattattatcttctttatctctctcagcggttctgacagaagaatgatcatgaagggaagtttaaattgtcagccaatgtaaggttttgcattatttatgcacttctgccatgtgggctatgctctcagcacttttaaactatccatagtccatagttggttctgataaatgattatttatttgctgtttttcagttttgcttttatttttggtgattgtttgtacttctttaaagcagggactgtgtcttacagtccctttctggccctaacagctcccagaaaagaacttaccatgtaatagggatgtggtgacttattgatgattaattcattttatatatctggattctttccctttgctcacataaatttcctgggtttgaaatttatgcctgtttatttcttctgttggcccctcatgttgtcagtgaaatggctacaagaatggcatttgatggaagaagaaggaagacagggctggcctatttcattctctaattggataatcagtccagaataatgatggtttgattttatttgcaaacctacacctcaggcagtgggtgaagaacaacagcataagcaacaatgcgagtatggtgttcatttacatcctcagtttgtctgtggcaggaagaaagaatccacttattgctaatgataaagtagtagacccactttatttattttcatataaatcatattgtggcagaaattttcatagcccgagaccaacttctggagtttttcttatctgtgagattgttcctgttgtgtatgagctgttttgcagagatcaagaatccctgctcaagtgtgatccatcttcatcagtgaagtcatatgctgcgaggacttctgagatactgtctgctgccacatgaccactaagcagatggttttgtgcctcttgcatgggttctatgaaaagatggagatttcagtgtccatcctctgtcactcaccagtagtatgcagaaatgggtgagcctaacagagttgttaggtcaacaaagcctgccattcaaattcagatcagtgaccttgcactcagggacaaattggggttaggatgcaggctgagattggagacggattatttcactatgcatgggtttgaccaggcagcccaacagcacaggtcttgcccatcaaaatattgtaactgcctaaaagagttggcaaaagtctctaacaaaacaaagggtttatgagctaagcccatcttgcattcatttcctcattccttctacacatatttagtgaaggccactctacactggacattgggatatgaacacaaagaaggagacaagtcacacagccatttatttataggaaaaaaatgttgaaataaatacatgagctgaagactttagaattacaaaatgagacttgctaacttgttttggattggaagaaattagtttatgcccatgacatcgctttattccagactgattagaagcataatgtacatggcaggggcagggagaaggggatgacaatccattctttgaaagagactcttctccccttaggttaaatagatcgtcaagtccttgcatgtcaaaagcagagatgtgaatcactgtccttcagaaagggaagaaaacactttaagcaagtgcaaagttcccagctgtgctaggcacgatggattatacccaaagaagttggacagagaccttgacctcaaggatttcatcgtctatttgaatagaaatgatttctatataactgaattaagccagagcaataaaaatagcatgatattaggttctaaagtgagtgttgcaggaaacagaaggaacttccaaatgttgttatttacagatttctaccttgtgaaatgtagaagtacctgttctcaaattaaacattccttcctcatttcaagatgtcagctacatcagaggttgaccaactatggcctacaggctacatctggtccatcacctatttttgtaaggaaagttttactggaacgaggccaagctcattcatttttgtatcatctgtggctagttttctcactccaatggccgcattgagcacttgcaatagagattgtgcagcttacaaagcccaaaatatttatgatctggccctttacagaaaaaaattggcaacccctgatttagattatccaggttgatcctggtgctaatttagagcttcagaataaaacacagctgaggtgtgcctggtagcaaattaatcccccccaaaacaagtacttcattttccttaaattaatgttgagcatcagaattaaacagagctaaatctcatgatacctgaggcccttgtgaaaatgtttttgctgacccaagattcagtgttatgctttctgtccttacagagagctaaatcaagagtccccttttggaaggagtacctctgttctttgtaaactgtaattgaagatataactcaccgtgttcttcagtctttattcaaagccgctggcacaaaaattctgcttgaatttaattttaggatagatttgatctctgaattggctttataggttttctcagttcacaatagtcataacctagttgtttctctcttgccataggtgacaggcaatgcagagccaatttcagaagtgagctcagtagtaaactcatggcaggtgcaggatgaggcaagagagaggcctgggtgcaaacatgagggtggctcattcccagggctatgcaaaggcagggtcagtcccaaaaggagcacctccttacatgttgtgcctgaagtgtccctttctcagtcttttcttggtggtggcaggtgctgcctggcaatccccatcccttctacttttagatggtgggggccctgtcctgctttatccttgtatatggcgcttttattttaaccatgtaaactgattcaggtcctccctgtagtcaacagagataaaagtctcaataatcaaacctgtgggtacttcagtgaccagggaccaccatctgtcccctgtgggtccagacatcaggcaggaggaaaagttggggccatgtgtcagcgtcccagctggggctcaccatgggaagtgggataagggaggattattccagttctcttctttgagttcaggtttttatctacgggaagaagagggagattggacgaggttagattcacttgtctccaatgtcctgcatggggttctgggacagacaatgcctcagaaatgggaggtccaagaggatggtgactttcactgctagctgatgatgaaagggaaagggatgagggaagaatgggctgaattagaggctattccacccctctgatggttagctttcagggggaagggaaggagggagggaggctggtggggtgggagacaaagacgaattggagattaggaaagattctttggaatagtcaaaccagagaccaagcaaagcatctttttcccttgtaacttgagacctgtgcaaatgacacaggcttctagttcccaaacttaataagagtaagtgcgtgaagaagagacctgcagacacttaattcaaacagtctagaattctgggaataagttatagtacaagttatatgtggctggttatagattcagccttgatgtttatgttccctgtttcaagtcacacacatcagattactcacttgtcagctaaaaatagggccatcactggcttgcaagtcgagttaggttttatttctctatgtgcttcattgttcgttcttttgtgctccctcctctgtgcctggccccctctgccatgcccaggtggcttcacagtcccccttccccatggtcaatacttctttctaactgagggataaatgactctgaaaaggaaatgtatttcaatggggaccaatccattacacccgagagagagaggccaagtgcagggacttctggaggagaccaggaatgagtgattatgtagcatattctgtgtgaaaggcattttaaaacacacgtagatcaatttattgtcacagcccctgagaggcataattctcatcttttttctttccttctttctttctttttttttttttttttttttttttttttgagatgaagtcttgctctgtcacccaggctggagtgtagtggcaccatctccgctcactgcaacctccacctcctgggttcaagtgattctcctgcttcagcctccccagtagctgggactacaggtgcaggccaccacgcctggctaatttttgtattttttagaagagacgaagttttgccatgttgactaggctggtctcaaactcctggcctcaacctatctgcctgccttggcctcccaaagtgctgggattacaggcatgagccaccgcgcccagcttctcatctttattttttacatgcagtcatagacattcaggtttcatataagcagccagggtctctcagtgcatcaggagcagagccagggtcaaaacttacatccatttgaacccaaggcacagttttttcttactgggtaatgctgctgtcttatgggggaattttaggcatcaataaacaaggaagagaagaaggctaatttcttttgggggctggtggatcgtcccctaaaattatgtagatagtcatctttcctatcttagctaaatacaaatgtagattgtaaacagctcctcaagactgtacattttttgaggatagatttagagcaaatcacatttgtatccccaatatggttagcccagtatctggctcctagtaataattatagcaagcactgactgaacatttcctatgtgccaaggacaattttaaccgttatagatattaattcattcctcacaataaccccatgaggtaggttactattactgttcccattttatagttggggaaactgagatactttgagttgaaggaacttgctaatgctcactcccaattaatggcagagctgggatttgaatcctataacactgggcccagattccgtctcttttctaaataggtactccatgaaaatatgttgttgaataaatgtactattactttgtacagggttgagggaattagatatgacttcactgaagaggtcaatttcgtctgagttcatttcttggtcaatatttttaaatgaatgaatggattccagtgtcctttttctctgaccacttctgtctcagaaaaacaagcctaatgcagaggaagaggagcaagggagttttcccagtattggtagatgaagatctatgacttcagagacaaatgaagccctcctagaattctttcaggcagacaataccaggtggcaccatgggacacactggtgggaggagtgcaaaatgaggatacagtttatgacagttttttttggaatagacacatgtccagagaaatgggcccacattcacttgtatgtgtgcatacgtttgcatagaattctcttttaaatatttcaaatttataagaaatcctttcttgtgatgaacagatttatcttgaaaagtgtttcccattttaaaagtcagagacttgaggcagggttggaataacttccaagagcatgtggctcgtatgtggagatgccaggaaccaaatcccctgctgctggttccagggaccacatttattgccacacctacagggtcctaggaagaggctggcagatgtgccccatggagataggtggggtttttatttacagtaggagaccagattgcccagtgatgatggggcattcgatggcagaatatagaccagtttgactgggccctagtgctttggcagatttttggaggagaatttgctgagtgtcagaccctgtgcagagctttgcaaacatcgttttctttaatctggatagttcgtctgtgaagtagatgtcataatccctatttcggagatgaggaaatgaggctaggagttacataacttactcagatgtgcagctgctggtggcagagcctgaatacaaatccttcacttctccaattaaaccagccatctctgagttgcaggggtttcatgccatactgcccactggaagttgggagggaatttacagggttacagcagatgatctctgtttaggcatcaggtgaaactttagtgttccctaaattggtacaagcagactctgtttgagtatctctgttgacagggagataccatctaacatggcagcccatctcaatgtttttaataagtatattatacatgcaataaaatgcatagatcctgagggtgcattcagtgagttctgacagagatatgcaccactgtaaaatggtctgtcatccatatcaacatagagaacatttttactatcctggaatgtttctttatgctcatttctgtcaatatctgctctctcctcccttgaacataaaaaaatcactatcttggcttcaatcactatagattagtcttgtctgctctcaatttttgtatgaatggaatcatgcagggtattcacttttctaactagctcctttccttcaaaataaggtttttgatatttgtatatattgttgtatatattaataatttcttccattttattgctgctaatattccattatgggatataccacaatttgtttatcaaaccaccctgttgatggccattaggttgtttccaactttggcttattttgaataaagctgttatgaacatccttgtacaaatgattttgtggacatatatttttttttcttgggtaaatacttagaaattgagtctctgggtcataggatagatgcatgtttaacattacaagaaactgccagttttccaaaggaagatacaccattttacacttctactagcaacgtgtgagggtgccagctgctttgtttcttcaccaacacttgataatgtcaacttttaaattttagccattctaatggatttgtggtgccatcttgttgtagttttaatttttatttctgtaagttctttgtcatataaatgtactgcaagtgtttcctcttaatctgtggcttatcttttaatttattgtctttttatgagaagttttttattttactgatatttaatttatcagtctttttaaaaatgtgagtgccttttgtgtcctatctaagaagcctttgcttatccgagtgtcctcaagacactctgctgtgtttgtttatagaggcttcagatttagcttttacattgaagtcagtgatccatctcaaactaattttgtagattgtgttaggtaagagttgagactgatttctttccctttgtagatatccatttttccttccatttgtggcgatgactttatttttctcattgagttgtattggtgcttttgttgtaaatcaattgattgtatatatatgggtctatttctggactctgtttcattaatcaacttgtctttttggggggcacgacacattatcttaacacaacatagtttcattattttttgatgcctattaaaatgatcatatgatttgtcttttaatttttcaatgtggtgaattacattaattaattttcattttttaaaccaatcttttactcatgggataaactctatttactcgattctaaagtattattctttttatatactgctggattcatttgactagtatttatttaaggattgttgtgtctatgttgatgacatatatttttctgtaattttttttcttttcataatactcttattaggtttcaatgtcatgattattctggcattataaatcaagttgggttctcttttcctccagtccctgaaagagtttgtgtaatattggtattatttccaccataaatatttggtagaattctgcagtggaaactgcctgaacctgaaattttctttgtgggaatgtttttcattgaagtttccatttatttaacagatatgtagctgtttacattttctattttttcttgtgtcagttggagaaaattgtatttttaaaggaatttgttcatttcatcagggtgtcaagttttggagacataatattattcctaatactttaaaattatcctcttagtgtttgtaggacctgtagttctgtctatcatttccagacaactttaggtgttggagagttagtttctcaccaatttctttttaaacacattgagtttctttcaagtcaggaccaggccatctacttccctcttcaagatattcgtcatgctgttccctcggcctaaaaaaattgccatcaccataatttttttacctggctgtctgctactatatcattaggatatagaattattgtgaagcccttttgcgtatgtatgtcacattttccatacacattcactcagatacacatttatgtaacatacacatacacatactcagataactacttggggtttttcctttttcttttttgttttctttttttcttttcttttctttttttttttttaaatggagtctccctctgtcacccaggctggagtgcagtggcactatcttggcttactgcaagctccacctcccaggttcatgccattctcctgcctcagcctcctgagtagctgggactacaggcacctgccaccacgcccggctaatttttttttgtattttttagtagagacagggtttcaccgtgttagccagaatggtctcgatctcctgaccttgtgatccgcctgcctcggcctcccaaagtgctgggattacaggcatgagccactgcgcccggcctacttagggtttttctttacagcactttaaccaaattgttaattacagttatgatatattgtttcactctctgattatactataaatgccaccaaggctggacttgtgcattgttcctgttaatcagcaaatacccagtacccagcaaaacgcttggcacataatagatgctcaatacgtcatggtcaggtgaatgaactaatccacattgagaagaaatgttatgctttgaaaattctaccaataattttagccttgctagaggtctgaaaaaataggtggggattaaattatgaggagcctcagctaacaacttgtggaatgtggatattttcctgtttatatttttaatgtttcccctctctctgtctgtgtcatatttttgtttacactcagtaccctgggaagggagactttcatagtcactctgggctgccttaacaagatatcaaaaactgggtggctgaaataacagagatttattttctcacagttctgaaagctggacatctgagatcagcattccagcatggtcaggttctggtgagggctctctttctggcttgcaggcggctgccctctcactgtgtcctgacatggcagagagggagaaagagcaaactctctggtctctcttcttataatggcactaatctcatcatgagggccctatcctcatgatcttgtctaaacctaatcactccctaaagtacctcatctccaaataccatcacattggggtttgggcttcaacctacgactttggcagggatgggggtccataatgtagcctgtaacagagaactaagagggggctggggttggtaatgagagaagatgctgaaaacaatgggacaaagaagcagggggtgggccaaggagctctaatgagtgtctcctcccatcttcctctggatagcccagaatccctcttcttcctcagtcctgtatgtaggattagcagaggatttgcgtatttgggttatgttagtggtgggaggtggccacgacaggaggagtaggacaattcagtttttctttcttgttgggcatcacatcctctaagggaatcctccttatgagtcctcagttgttaagcaggattactaaaataaaagaaacgacttagtgggccccaaactgcagcctctctcacactctattctataccacttgatttgaggaattatagccttttctctttctatccccctaaaccatgtccaaaggagcttacatggttatttccagcgtgaagctgattgatcagctcgcaggacatcgtggatcagagtgcttcccccgcccctcttaaccgcctttctgatgtggctgcgtgcatccagtgcccagagcatgccggggttcttgcaagagggactggagggtgagggaggagagagtgtctattggctccaccaggacatagatgctggtgacccacactgcgctggacaggaggacctgtttgcagcacgggtcagaggaacacaggctcctccaggtctttccagagcattgactcctgcaagaagtgaatggaagggagccgaaagcctagcccatctccctccttctaccatgatccccagtaagattctggtgtaccgccacccatccagcagaaccggcacagagctttacagacccggcaggcgccgcaagaagtccctgggggacctgttccataatggctaccgggtgaagtctgggcctgctgctccggagaaggaggaaccgccgaacttccggcagtcattggtgtcttgctgtggtgtttgtgcatcctggggtaaggactcacccgtccatggctcttctcctcccaaaagtattccgtattcctggaggctgcctgggaaaaaaagtgctttccgtctaggctggatttggggaactgtctagtggagaggtgatagccaccttgattcctgttttcttggcatacccacccaacgcagatgtgctgggtgaggcagaaatctcgtccttcctttttagatgaatttaactggcctctagtgctcctgaatgttattgagctattaaagaatatatttcagaaatgtgggagaaagtttggcaaacgatgtaatagcttgcttcctatttattaaatggcaataattttcagtgagtcagcatttttggaagaggcatttggacctatcgataatttttttttcaggggctacagtgcgagttgtggctcattttctgtccttacatttgaccatgggagcgtggtcttgcctgtcttgggtggtacttttttattcttacccagcagagatcataagaatagttttctaggcagattttcttttctcaactgctttctgataggcatttggctttatttaggcatccataatatattacagtttaaaacaaatagattaaatgtacatttctggccataaaaatgtcagtcttagggagggatagcttttatttccaggaaagttagcagtactaggaatttctttaaaatggaatgtagtccctttgaaacctagtttaggattctgatgtgggtaggcacagctcaaatacttctgcattatgtaattgtgcctaacaaaattccagttggcaagcaataagtgaaacctagtcaatccttttcattagaactgatataaaatgtttctgtcagctgaaatgcctggaatctaaatattcatgcttctgtgtctataaccctagaattagctggccagattgttatatttcctctcccttcatcacagagaagagctgctctgtactgtaacatctggccttggagagaatcaggattaaagccactagagagaagagaccaaatgatggaattattaagctaagggcacatacactacttcctgagaaaacgttgaataattgagtaaaaccatgggtttaacttagtatccaatacccttcttacttttcctttgaaaggattaatgcatttattaattttcagtagtgagtactcactatgtaccagtcatcactgttctagaagagggtgcacttggtagtgagccagtgagtgagacacctgccccaatagagcagatagtctgctgaggaacgggcaggaggcaggcacctgaacaagcaaatgagatcattttagattgtggtaaaccctataaagaagaatggataatggcggcgaaggactgggctccagatcgggtggtcagagaagacctccattagccaaccttgcaatgatctgggggaagaacattcccaagaaaagaaacagaagggaagactcagagctgaggacgaactgggaaatgtttctggagcagagacactgtgtgcagggcgtgaggacatggagagtggtgatgaaatgagcagaaaccatggagagccttccagagcgagataaggaatctgaaagtaattttagtgagatggatgccatgtaatggcttttggcagggagcaatgtaatctgatggatatttgaaaagaccatgctggctgctttctggagaatgctggtggggcctggggggactggggtagagaagtgaagcaggaagacccgtgtggggctcttggtccagatggaggtaacagcagtgtgaaccatggttctggcagtggagagggaaaagataagttatttcacatatatttaagatgtaaagtcagaccaggcaaaatggcttatgcctataatcccagcatgttgggaggctgaggtgagaggatcatttgagcccatgaggtcaagactccagtgagctatgatcatgcaccccaggatgggtgaccatgagacactgtctcttaaaaaattcaataattttaaaacaaagtaaagaggtaaagtgagtaagtcctatttgtttacttttaaaaaatgtgtttctctacttactggctcctctattcaaatagaagacctggaagcaggagcctcacccctgtgctgcagcatctggaaccacaaggggtggtggaagcagtgactctgtgcatgtgtgtgggtgaatgaatgaatgaatgaatgggcgacaatcccagtctgaatatcaactgatgttgagcatctatcagaacaggaaccaggactgggttaaggtagggagccaggattggcaacatggtgaaactgtgtcactaaaaaaatagaaaaaattagctgggcatggtggctggctacttggggggctgaggcgggaggatcacttgagcccaggaggtcgaggctgtagtgagctgtgatcgtgccactgcactccagcatgggtgacaaagtaagaccctgtctcaaaaaatttttttaaaaaagtagggagcaaaacaacctgaacaattaccaaaggaaaggatggtgaaaaggtcagacaagcaagaactgtttatagaacacacattctgactgtgggaacaaaagcccaggggcatttgagaggaagcgagacagtcctttttctccagctgggaaggagaggctcagattcactctgtgctggggctaagaagcaggtggtcctcacagtgaccaagctggggatgggaggtgggacctgtgatggcagaagggtgcaggggaccaccctgaagaagcctccccatgctcctgggcatcctctgtttaccctgatatgcctgccctcagtttgatccctctgagctgcaaggccagataacaatgaccttgtcagacaccacaaaaataattgctcttcaggatttgcgtggggctgcagagattggaaacgacagacgtttattggaacctttcagctttttggatttaaagattaaggagtgaaagggaatggaaaatagcaaattggaaaaccctggcaggctttctggtatgggcttggatgtgtttgctgttgtgttttctgtcttgtcctctcccgagacctcacatgtatgaatctccagagtcttttctctctggggatcacaggaaccctgaagcagtgaatgagttatcatttacctgtttatccctcaatttctgtcagtacagtaactctgcttttatctgagaagggagttcaagatcccttaatctgtctggtcattgctaaaattccacagcaatagttctcaggaggagcctcacctagttgttcaggccctgggcagcaagtttcgaagggaaagctctggcagggggtcctcctcacctggagccaatggtctcatgtgactgaatcttgcatgtgagtacagggctcggagccaggaaaacctgtattccagtcctgacttgccactgactttatgactacagcaataagtaattatgcataaaaatagaaattttgatataaatattacaaaaaaattaaaaaactcaagaatattaaagaaatccaaaatgtctgcctttgtaacatggccactgtcatcattttatgcttttcttctactttttcattttacacatacctatagttttcatagttttatcatagggaccatgcacttcatcttttacttcttttttttttttttcagcatttccaatttgctatttttaaaaaattgtggtgaaaaacacataacataaaatttaccattttaattatttttagtgtacagttcagtaatgttaagtatatcctattgttgcaaaacagagctccagtactttttgatcttgcaaagttgaaactctaaacccattaaacaaataatttttcctctcccctcagctcctggtaatcgctattttaatttcgacattctacttctttaacttaacattatgtcaaaaattttccttgttacaatctttgagcatatataatatcctataaagaagatgtatcagacgtaagacctatttttggattttaagctgctttctatttttcttgcttaatgaacaattttgcaatgagcatctttgtttctgtagcatatttccatattttgttatattttcttaggctatattcccagaaatggaattactttgattaataatgctgaattactttctgaaaaggttttatcagtttataattccacaatggaattataagactatttcattgtagagtcatctccactaggtgaagctcaaatatgttgctattaagtagaataaatacagtgcttacttatttttgtttaatttgcatttcttttaattttttaaagcatttttcaagaatactatatggttattaactatagtcaccatgtaatacagtagatatcttaaacttatttctcttatttaactgaaattttgtatcctttgaccaacatctacccaaccacccttccctccaaccgccccagcccctctttctatgagatcagctgttttatatgagtgagatcacgtgatgtttgtcattctgtgcatggcttatttaacttaatataaactttaggttcatccacattgttgcaaatgaaaggatttattcttttcttggctgaataatatgccattgtgtatatatatcacattttcttcattcatctgttgatggacactgcggttgatttcataccttggctattgtgaatagtgctgcaaagaacatgggagtgcagacatctcttcagcacgttgatttcatttcctctgaatatatacccagtggtgaggttgcttgattgtatggtagttctatttttgggtttttgtggaaactttttacctttttccataatggaaaatagtactaatttaccttcccatcaacagtatgcaagggttcctttttcccacatcctcaccaacacttaaccttttgtcttttcgataataacccttctaacagatgtgaagtgatagttcattgtagttttaatttgcacttccctgataaatagtgatgtcaaacattttaaacatttactgttggctatttgcatttcttcttttgcgaaatgtctattcaggtcctttgcccatttcttaattgggctatttgctttcttgctattgagatgtgttctctatatattttgaatattaagcccttatcagatgtatagttttcaaatatttttctcccattctgtaggttgtctcttcactccgttgattctttcttcctttttttttttttttttttttttttttttttgagacagagtcttgctctgtctcccaggctggagtgcggtggcatgatctcagctcactgcaatctccacctcccgggttcacgccattctcctgcctcagcctgccgagtagctgggactacaggtgcccaccaccacacccggctaattttttatatttttagtagagacggggtttcaccgtattagccaggatggtctcgatctcctgatcttgtgatccacctgccttggcctcccaaagtgctgggattacaggcgtgagccactgcgccccgcctctcttcactcggttgattctttcttttgttgggccaagctttttagtttgatgtaatcctctttgtccatttttgcttttattgcctgtgttttaggggtcatttccaaaaaattattgccctgaccgttgtcatggggctctttctcaatactttcttctagtagtttcacagttttggatcttaagtcattaattcattgtgagttggtttttgtatatggtgcacattttttttatttgaaccaagttaagataaaatagtttcatttaattaatttatttaatgattattcactagttatattatctacttcatgatgtagctgtttgatttttgcctacttatcaactaatgataaagtattttacatacatgcttttgacattacaaagaatttatccttattgtatcatatttgattattttttcattggatattgtgtttattatgattttaaacatgcagaattttgacgtttttatggtggtggcagagcctgtatttcaaagattgtatgactccttttacacatgaaattagaaattcttcttttcagagggctaataatatatacctatattttcctcaatttttctgtcccttattatctatatttaatttttaattcatctcaaacttatttccattatggtatgaggtccatcattgcatgatgcctgtcttccttttgatttgtgatgacctctttattgtctgtaaaattcttctgataaaatagagtctatttctctactgcttagtcattgttgccatgctcttattactttcttattctattgctttgtggtaaatgtgacttagatgatttttgcattttagattttgatgaaatttctttgtggcctaatatgtggtcagtttttgagactgctcatggctgttattaaagaatgtgtgttcctagtttactaatatatgtgtgtgtctttctgcccatccattcagatacatatagatacgaatatatcccaagggattaaatgctacttaaatgtcctatatttgtgcattcttgtcatatttgctttatttatctcaaaggaatacttttaggtgtataaagtttttttttgttacacattctttgtggattgtttcttttatcaatatgagatattactttttattctttttaatataatgtttatatataatttttatataactttttgcagtagctgccactttatttgatatagtcattgctctatttgttcctcttttctcagcatttgccaggcacataatttccattctttcatttctaacttttctgtatgtcttgtttgcagtgtatgtcttttaaatagcatgcgcctggaatttattattgttgttgttttcatatcatgtgaatctctgtctttccataggtgaaagtaattttaatttaattttattatgattacaaatatatttggactcttttgctattgtaactatgttttctgattaatataccttttattttttttttcttttcattggatgggctgaagtttttgttctttttttcttttctccatttgattaaattcctttgtccttttttttttctctaggctatggaatttatatccttaaggttttgatacacatactttaatttttttctgttaatatatatgattgattgtatcctatcaagacaagaatttctgcacacctttctttttcccattgccctctctccttcacacctccatcttccatttatttccagagattttaattttggatcattgttattatttattcatttaaaacatactcagtcaacacataaatgaatccattacttttatcttttccatgttgcttcttgtatcttgcttcttttggatttatttttctttcaactggctaagtatatattacttggttcaaattaatctgtcctgagaattgtaaagatatccttcttttgttttcttgcaaccagtgaagccaggagaattgtgacaataatttgactcttgttgctttgaagggatttatttcttcacattgatgttataaaatttatccacaatatgcttggatttaggtctttgaaaatgtaatctgctggccgtggggcggagcttgcagtgagccgagatcgcgccactgcactccagcctgggcaacagtgccagactccatctcaaaaaaaaaaaaaaaaaaaatttaacctgctggacacttaaaagacctttccaatctgaggatacaggtcattctttcggtctaggacactttaatgttattttaaatgtttcctgttctctatttccttcattttttccttctggcagctcaattacatggatgtggaaaactttattcctgttttctgggtctcttagtttttcttttgcacttttcattcctgtgcccctttgtatgaagatggctgtgtgatagttcagccctctactttgctgtgtggctatgcccattcttctattaagctggccttttaagattttgatgttcaaaattttaattgctaagatatttagttgattttttgagttgagatagtttttcacaactctttatatttttcaaatatttttctaaagcattttttgtttaatgctttgttaatgttgtatccttaagggtcagttggcctgaagtgtaatatgtgcatttcttgaaggaaagttgcctttcctcaaatgtttggcaattctttagttcttttcttcccttttcttttcttttttttttttttttttgagaccgagtcttgctctgttgcccaggttggagtgcagtggcgcgatctcagctcactgcaacccctgcctcccgggttcaagcgattctcctgcctcagcctcccaagtagctgggattacaggtgcctgcctccatgcccagctaatttttgaatttttagtagagatggggtttcatcatattggccaggctggtctcgaactcctgacctcaagtgatccgcctgcctcagcctcccaaagtgctaggattacaggcatgagccaccgtgcctggcaacagctggataaattttcacgaagagaatgcatttgagaagccaacgctcagctcaagaaacagtcattattgcctgtcaccccctagtcccttctcctggcaaccttctagtcactacaccccacaaaggtaaccactctcctgaccatatatcagttttgcccagttttgaacttcatataactgggttatatagaatgactctgtgtcaggccttgttctctcagtgttacgcctgtgtgattcatccatgtggttatatgtagatgtacttgacagtgtttttttgtttggagatggagtcttgctcagcctcccaaagttctgagatgacgggcatgagccaccgtgcttggcctgttttgtgcttatctttgcatttgagatcttctgttagcctatatgtgaatgctgtctttgtgtgttgcagtttgtctggggagtactgagatatgctactgtgtgtttctattcggtaactggtcttacagctgtagagacagtgtgtttcttccaagagttacagtttactcaggatattgctctattttaacacctcaagtgtatgcacttgctgccatgtagtgactactcctgtttggcaccccagtcaatcagtgttattgtcacagcctccttcttcccagggtcagccacttcatttcaccttttggatggttgttttcttcttcactgtgatctctgcatcccaaccacccccccatcaacctcagtctttatgtattgaccaaagacatttttaatattctgtttatcattgtggagatagacatatgtgtgtgtatatgtctttctttctcattatggaaatatatacatggaaaatatatgtatatgtttatataaatataaataaatacatatatatgtatgccaagtcagtttctaacagagtatctacccacattttgtgttcgtctgttctgtgttgtaatctcctcttccattctttttgttcttgtgggattctgctgtttcctaccccctcaacatttgtattagtttagtgaagttttgagagggggcagacataaaccattgtgatccatctgctatgtttaactagaatgctctggattatcattttaattcattgatgaataatttatgttggtattatatacagaattttggcatctatgatcttagtgatattagaatacagatgcttctcaatttaaccatggagttacatcctcacaaacccatcataaactgaaaatattttaagtttgagaatgcatttaatacccctcacctaccaaacatcacagctgagcctaccctatcttaaacatgctcagaacacttacattacctactgttgggcaaaatcatctaacgcaaagcatattttataataaagtgctgaaaatttagtgtaatgtattgaatactgtactgaaagtgaaaaacagaatggttgtgtgaatacttagagtatggtttaaggtgaataggtatcacttttgcaccactgaaaagtcagaaaatcattaagttgaaccattgtaagttgagggccatttctactttatttttgtgctttgagagtcagtttttggtcctcagtttatgtttattttataatataagttagtagctttagatctcgttttgtattatggaacagtttagaattttaataaaatgtatgtgcaataatttaatcataaattatatatgggtgcagagtctgtaagggaagctgttactatatatttcaatgtatatctcaattgttatcctataatggatttcttttttgtgtgtatcaagtttcgaagtttatatttttcagaaagtcatccctctcactgaggtttttcacagatttattagaatatcattgtggataatttttttctttttttattggatcagccagaactttattttgtttgttttcttgttgccattgtttgctcccataaaattctacagatttttaaaattttttttcatatttattggttttctggttatttagtcataaacactgaactaaaaaatcagctttctcctattgtcaagactacttttcccccaaaatcttaagctgaatgctttgttttataaataatcttttattgtattattgatttaacttctagttagccagtatgttctttaaaattgatttaaatagactggtagtgtgcttagagggtagattactggttttaaattactcaagtgattactcggattaacggaaatttgctatttggagaaaaaataaagcattctccttttggcatactactagccaaaataaataaatacatcctgatggattaacaagttagaggttaaaaaaagaaaataaaagatactctaaagcagtgattcccaaacttggctgtacactggactcatcctcatccatcatctggctgtacattagaatcttcttgattagaaaaataaagcttggtccttttggtgcactgttaaccaaaataaataaatacatcaaaacagattaacaaattaaaggttagagaaaagaaaatatattctgaaccactggttcccaaacttggctgcacactcgaatcagaatttataaaaattctgatgcccagcttgtatcccagacccgttgaatctggtgggaagcaggcctcagtattgctttaaaatcctcgggtgattgcaatggcagagaaatctggggaccactgccttgcagccttgttttcccaaagtgtggtcttctgaccaacagcattgacgatagcttagagcttgttagaaatgcacagtatcaggccccatcggagacccactgagtcagaatctggatgtttacaaatgccaggtgattcatgtgcacaatggatttgaatcccatgcctccaaagcaagtgtagaaaattagtgtccatggcctatttatatgaataacattttactggaatatggtcacacctatttgttttcctattatttacagcaaagttgagtcgttgtgacagcctaaaatatttattaatatttactatatgttcatttatagaaaaagtttgcaatgcttcttaacctggatggctcattagaatcactctggagccttaatactccctctgcctgaatgtaccccacgcccattaaatcagaatgcaggtagggggtgctgagacccaggtgtcaacaattctaaaagtttcccaggtgatttaaatgtacagtcaaagtccagaaccagtgccccaaaagtacaaagaaaaaaaaatagatgcagtaaaaaaaaaaaaaaaaaaattatctatatgatggggatggccaaaaaaattttaaaaaaagggaacatggtagaaagattgatatattttagaattcatggggaaagaaacccaccttaagtaaaatttgacagtaggaaaaatactttaagccaaattgagaagaatgacgaacggtgggagataatatatggtatacaaaatcttctttatatgagaacataattgtattactacaattaagataaatacacaggcagactggcaaaggccactctaaagcactttagagaagaaaataaaatgactaataattatatgaaaaaataattagcttcatttgttaagatagaaaagcaaaataaaacagccatgagctcttatttggggtctatcaaattaggattttttttttaatttttaaatttttaatttttttgagatggactctcactctgtagcccaggctggagtgcagtggcgagatctcggctcactgcaacttccacctcccaggttcaagtgattctcctgcctcagcctcccaagtagctgggattacaggcacataccaccacacttggttaattttttgtatttttggtagaggcggggttttaccatgttggccaggctggtctcgaactcctgacctcaagtgatcagtccacctcagcctcccaaagtgctgggataacaggcatgagccaccatgcccgacctcaaattgggattcttaccctcgttctctccctttcccctcctgccttcctgccttcctgccttctctccttctctcccttcttgccttcatgccttctttccttccttccttccttccttcctattttctctatcactgtactcaatccagtgggaatacaggcaaaagagcatttgcatactgaagggaatgcaaattgtgaggacaagttggtaagatgtatcacaagtcttgaaagtgtgtgcttgagtcctaatgtctgaattggaaatgactggctgaagtctgtacagggcagtggctagaagcttgggctttgtggagtttgtcacatttgtggtgaaacttggctctgttgctttcaaactatgctggatacactgtctcatttgtgtctccttagctattttcttctgtgtacgtattttttaaaaaagatatagttagaagttttagtgtgtgtaagtaaataaacatactagatatcatcaataataatagattaatgtcattgtcaacatcatcatttcaccagtaatttaaaataatagtaacactatatgtactctgtgtgtgtgtgtgtgtgtgtgtgtgtgtgtgtgtgtgtgtgtgtgtgtttgtgtgtgtgtttctgggctttctagtccagtttgatgacttttctgtggcgtgtgtacactcctacgctattgtaattcttcatatgatgaaattaccatttactgagtgcctccagtatgcccacatggactcttagaatgctcggtcttctggtatgcagatcaccagggtaggatttaatgcccatgcctgtgagggaataagggtggagaactcaggctggctgcagctgcctgggaagcctcaacccatcccacaggaaaaagtatcccaaattgaggcaaggcagctgacctttgtccctacatcagccagcatttgtgtgtggtggtggggggggggtgggggggtggggggcaccaccactgacaggggatgtagccccaggtgaggcagctccttgtagcagagggcagttctcatgaagggactagctctgagcctttagcaggtcactcttcaagagcccaggacaaataaggtccctgaagaggggatttgggctgtaccctacagcatctgctatagctcatgtcttttattcatttaatgcagtcttggatatgataccctagtattttatttaggattattgttgttagtcattagtgtgataagcttgccatttaagaaaaaatgcaagggaacttgtgtccaggtaatgccaactttctaaaccaatacagagcatggaaaaacacagataagtccatttttaagaattgatcatataatagagaatagatagagaagttactattttttgaaactgtaaaaatctcacttgtaaaactctctgaacctggaagcttttggggagggcatgtaattcctggcttttggtatatacacattttcttcttcacaactctattatagctattttgtgttaccttagaaaatcatttatttcagagattttatagaataaaaataataaaagatattataaaatagagaagatgaataattgtcaccaaagagttccccctctcacctctcttatcttggtctcctctcttagcctgaagtcgctgtctgtagtcttctgggctctttctgggtatagccagagtggtcattcgttaaggcttttccctgatgaggctactttctacttcccaagagtgcagccctgacctctctcaggggaccccgcagggcttctggcttttccctttagtaggcaacatatagtctcagaattctgaatgtggattatctaacctttaactccgccgtctaattatttctcaaaactttgattcactcattcagttcaaacaaggatttattgagccttcaccttatgccagacactatgttcaatgctggaaatatagccctgaacaaaacagacatcagctcctcccctcatagagctgatgctaaagagaggaaggcagaaagtaaccacataaccgaggtgctagtgcttcatgctgaggagaaaagtgaagcaggaaagaggatagggagttgcacgggtggtgtgggaggagttgcatgtttaggtcgggtagccagggaaagtcacgctgatcaagggacattgagtaagaacccaaaggaggtgagggagtatgccatgtgggcatctggcaaacagcattccaggcagagaggctgcatgtgcagaggccctggggcagtagcatacctgtgtgttcaagtgtcactgaagacatctgccagatcagcggacagtagtaggagtgacagtaggaagccatcagatccaaaaggagatagtgctggtggtgggatggtgttgctttaggcctttgaaagactttgacttttactctgtgtggaatgggtggcattggaggcttctgagcagagaacacaaggggtccagggcagaaagcggttaggaagctgatatggtttggctgtgtccctacccaaatctcatcttgaattgtagttcccataatacccctatgttgtaggaggggccctgtggaaggtaattgaatcatgggggcagttacccccatgctgctgttctcgtgatagtgagttctcacgaaatctgatggttttataaggggcttttccctcttatgctcaacacttctccttcctgccaccatgtgaagtaggatgtgtttgcttccccttctgccatgactgtaagtttcctgaggcttctccagccctgtggaattgagtcaattaaacctctttcctttataaattacccagtctcgggtatgtctttattagcagagtgagaacggactaatacggaagctattgtgaatgattcctgaaagaccaaccatttctccagatagtctggcttgatctgaggatgaaatgtagactgacttttttaacctatggagaacttcattggctcatttgcattagtgaaactcagtgccataaaaatgcccagtatgaggcagtcaaataagcaaaggccacccttgttcagcccacaggggtcttgctcctgcatcaccctgggtcccttttgcaaggagatatttccctctggtctccatgttgggaaaaataaatgattctcctgcaagccagtttgtttttctctcatatgtatacactattgatcttatcctgtctgcctgcttgcttttgttaagaaggtgctcagagctagatctgcagtttgtgtctagcaagagtataggaccttgtggcctctgcattcatttctttcctgcccttactttcatgcaccttaattaaaagaaaagcttttattctactatatttgtgtaactcactcaaatgtggcaagctgccaatcagcaatggatatacgatacaaacaccatcgtttaaagataaaaagaagaaatccagtttgaagttcaggttgtttgtattctatttttagttccataaataaaagcatatctatgcacacacagaatgttcaggattaaacactaaatggctaatacattgctagcatgtatttctacaggagtgcctcttatctatggttttgcttcctgaggtttcagttatccccaggcaaccgtagtctgaaaatattaaataggaaattctagaaataaacaattcataatgtttaagttgcatgctgtcctgcttggttccatctgggacaagaatcctccctttgtccagcacatccgtgccatctgcactccctggccattagtctctcagggcacttcagtgggcagaccgatgtcttgctgtaacccatgttacctgtgttcaactaacccttattttacttaataacggccccaaagcgcaagtatagtgatgctggtacatattgtcataattgttctattttattattgccattgttaatcccttcctgtgctaatttataagttaaattttaccgtaggtgtgtgtatataatgcatataggatttggcactatctgaggtttcaggcatccactgggaggtcttggaatgtatccctcaaggaacatggaagagtgttgttatctttcatagtttcagtgctaactgccagtcgccttctactccacgtttctacatttgtcgttttagctcagcaatatgcgacagtgatactggtatgagataacagtctaggttgggctggaaggttaggaccagcagtagagtctgttataaatttaatttccagcccttgccccctcccattctgatttagcaagtcttgtgaacctctttggaaactttatgcacacactgagcaaacaatgtattttttgagaccttagaatttgaaattttttttgttacttttattcttgaacaaccacttgactgggtataaaaatcttgggtcaaattctgtttgtctaaaaattctgaaaattgcccaattgctgtttaacacttttttttttttttttttttttttttttttttttttgagacggagtctcgctctgtcgcccaggctggagtgcagtggcgcgatctcggcttactgcaagctccgcctcccgggtacacgccattctcctgcctcagcctcccgcgtagctgggactacaggcgcccgccaccacgcccggctaatttttttgtgttttttagtagagacggggtttcactgtgttagccaggatggtctcgatctcctgacctcgtgatcctcccgcctcggcctcccaaagtgctgggattacaggcatgagccaccgtgcccggccaacactttttgttaaatataatgatcttagttacattaacggtaaataaccccatcaacactggtggtttatttttattgcttgattttaatacttgaaatgtgaaaatgaaaagccagatgcttcttggcattggtctctaagaactgatccttcattttaccttttagtctccagtcattttttcatatctcaaaagttcttttctgttatgtcctggcctttgcttatgatcaatgtgatgttttgacttccctttggccaacacattttatccatgggttggatctctgtgatttctactgtgtttctattttctgaagtttcatcttttttttttctccctttctcatattttctctgctttctgaggtgacttcttagttttgtactctgcgccgtggtcggttttcagcggtgctaagtcagcctttcatcagctcagttacaactgtgcttttggccgtgagcctttttatttcatcaacatcccgtctcatctctgcaattatttaataaaagttatataagtattatttagcatagaaggagaatgttttcaaaaaaagtcttctgttcatgatggttaatccttttcagatgagaaattatttttttgagccaatccttttctccctctttccttgtacagattttcccccaccccatgaactttaagttaattttcccttattacctaaacagctccacgttgcgtgcagttagtgtactcctcattcaagtagaaggtagtaaggattccttcccaccactgtgccctaggctgccctttactggctcacgggcgtgggagaacaaagccccacccacgggcgtggagttgtctgtcaactcagtgcactggagggcttcgcactgcctttggcacgtggcggtgcttaataaaatgcttctagaaagtctgcaaaagaaaatccccttgggagtgggtgtgacattcaatgtgtctcaaagcggtgacaaaccagcattttgtaagtaattcccttgcatgatagccaaattattatagcccaggactgactgaatgttttgaccatgaatttcacctgaacagaaatataattcactcttagctattaaaacataataatttgcatttttaaaatgtccttgatgtgttttccttctccatctctcttctgccacctaaacactgatgcttctttttcattcaagagaggttgttgatttagaaaggacaaaccatttatcttaacacttaataaaaggggaactatataaattttgaatcctgaagttgtggggtgtgatatctcactgatcttttttttttttttattgggaggaaaatatagaagtttgtagaaaacagataacactgtgggctgtactcttcattttatcagggctgaagataaagataaaaaataaaatccatcaaagacataaggttatccgatttattctcaatctgctcttagcacaagggttaccctgagctatcacaattcctaggatttttcagagacaaaatcctgccagataactaggtaacttagaaacagtgctttcaatcagagatcaccaaatgaaaagtctcattaacctggcttctccccatgagcccttcctctaaagaggttccaaacaggccacctttataaagagaaagtccatttcccagtcgagattaaaccagtcaagaatcagaatgaaggaatatgtctgaggtaccagctggtttatcttctgcaagaacttcccatcccttcgacccttgggaactgtaaatcaaatggcagactgtgaacattaaaatcacacattgaaaataatgcatctctatttcattcttttttccaggtttgagatttttaagagctctgagactgatacagttttcagaaattttgcagtttctgaatattcttaaaacaaggtaagatgttcttcgtcatatttttttcattccagtcccctatgccaagttgcaaatatcaggtgtgcttgctttcatcacaatgacattattaatagttatattattcacagaaagagtgatctaacacagagagggagagaaaaccagagtagggtttgagttgctctcttctgcagggccagggaactatgtggtgaaaagagagaaatagctgtgcatgcagggaagtagggacacttttagggacacatagctgatatctgtgtgcccagtggggttgcccagataagagccacggtgtcaaggggaaaggtgcacagtgaatgagggatagatttgctcattgattgggaagtccttgctgccagattctaaatcgcccctttattacatcactaaataagaaattgaacccagtcgtaaaggcaatagaagcaatgctgtgagaggcaatcacaaacctcatacggcaaacagaaaatcatttcatttcaaagcacattttagatgttcactttatatccgtatagcccttggggctttctctgtgaattgccttttgggggaaaacctacaaacctcctgccgaatgcaccatgaatacttctgttaactgcgttatgatctggaaaacacaactggaccaggaggaaaagcccccagaggatccctttcctgatgacctgccggcttgcagagctggcctgaaaccaaggctgtcttgatgaataaactaataaaagaggttagacgtgctctaatggagaataagtacaggccataaatttctcttctaggaaattacactctaagaagctaacttctaatgttccatttcctctttggttgcccttcatgcatttgataaatgattaaaaacaggacacctccatattttgtgatttgtaattaatatatctgtagttttgaggattagattcagcatcattttcctggtaacacaggctgggacctagcttcctgaatgaacctgacacagccaacaaattcaacctatgattggctttactccttgggtgttagtgttttttttgcttgtttattttattttgctttaattccaaattggtttcctctctctgactgctcatctatgtgactgtgaggtcaaattcactttctattagtcaagttgaaaagaaaaagagaatccaatggcactgaagtctttaaaagtatgtcctcctgccttttactgttcattatcctgagataagaatttatcagtcctctgtttattagcaataatgtaatattattcacatacagtgaatattgtatttcttcatgtttttctgattgccaataaccttgatttctgccttttaattattcttctatgtgctagaatcatattacttttgaaatgtaaacgatcaatgaagctagcatctcgccaatatttacgtatgtcagattcactccactagactgtgttttaaagatggaacgcgtgagtacccagcaccaagcatagagccttgtccttaagagacacttacttttttggtagggatggtgttttgtgacactctctaacattgggtagtgtctgtctctccctgtttcacaattacatcatatgttagggggatttttattctctgatgccagcattttgagaaggttccattgctctgaggaatactgtctactccctggaccgttttagaacttgagaaaatgatggaccatctgaatatctttttctgactttctgctaggacactcacctctctttcctttggatgcgggaagtggctgtgggatccctggtgtcagctcacctgccaactgcactcagtgctgcctctctcagtgcagagcggggaagctgaagcagccagccaggggacgagggagagaatggccctagggaagagtcacggggtggaaggctgtctgggcatctgccatccgggccccaaaacagcctttttccagcaccccacttcccactatatgaaactcttgttgttagagggtgctttttgccacaaacccacaacctgggttttcagagttcctttcacttatggtcataaccagatggttgagataattcagcaagcctggagtgagcacccattggtatcagcagcaaggtgcatgctaggagtcctgctgtcagagaacttgctgcgtagggggccaggccacctgacggtgtggttaatgctgatgtcagcatgcccaggggttgagaggggagtaactaagctgggcttagcctgagttgcagggcagtcaaggatcttttcgaggagaaggttacttttaggtaagccttgtagaaaaaagtgtcatcctcatggggctgggcatgtgaggggtagggtgggggttgacttctaatcaaggaagatgctaacagcacactggtgtgagagcataacacttggggaaactttgggtaattctgcactcctggacattaagcgttctgtgatggaaagaggaggatgaggttaagagggtaggaaaggccaggtcaccaggcacagaagcaaacgtcatgtaattgtaagaaatctagaagctttaggacaactctctgaggccattctctctccaggtgccagcctggctaatcttggctccttccttttgggcatccccaagtgtggatcccaaagttctgtcccagagaaagtgcagccttggcttttgtagggttttggacttttgagcgattctcctgtgactcttccatactctgctgctttcatagcggtccttccagaagggtgggttgggggacccatgtaatcgtctttagggagattttgtctggctctctttggcggtgaattcctgccaatctgtggcattaggcagggatggaggctttgcaatgcaatttgaaataatgatttggagttgctgtttcatttccagtactttggctgcctcactgggccaagagctgaaagaaataaggcagagaagcataaggtgggcagaaagattgataaagaattaagaatgcagcagaaggaaaattaaagtgcatgggatgaaatgggcaaatcacaattatgtgaccagcatcagggccctttcccaaactgcaagcccatagggggcctagaatactccatagcctgaaacggccaattaaaggggagacaaggagactccctctcactatctgaggttttggcagtttctcagttgccctgcaaactggagatctaacacacaggtgctagaacacttattctactgtcagaggaaagtcagcagctgtgtttaaaggctgtaattccacatctcattgactgtggtaaatattgatgactaaaacatggatcactcagcaattttttccaaaatgggaatttccttattgtttcctctaatttttcttttcttttcttttcttttttttttttttttttttttttttgagatagactcttgctctgttgtccaggctgggcgtgatctcagctcactgcaacctccgtctccagggttcaagccattctcctgcctcagcctcccgagtagctgggattacaggtgcctgccaccacacctggctactttttgtatttttagtagagacagggtttcaccgtgttggccacgctggtctcgaacttttgacctcaggtgatctgcccactttggcctcccaaagtgctgggattacaggtgtgagccactgtgcccagcctgtttcctctaattttgaaaatatgttcatggtaaacattgcaacaacacacaaaatcacataggataaagtaaaattgcctccacatcacactactttgagataatgattacatctactatgtcaccttttgtttctcacatagcattccatgatatgcatgagtcatcgtgtacctaaccaatatggttttgggaggcgtttttgaaactaaaacattactactgacatgaacttagaaatggctccaagataaagtttgtaaagaagagtattctatatggagactgcaagagatgtgcagggagaggccaaatcatgcaggttcttagattcatggactttactgagaacaaatgagagctgttgaaggattttaatcaggagaggaaatgtggttagactgacattttagaaagatccactattccaacagttgtatagagaatggggttgaagcatcaaagacctcatagaccataagaccaattaggaggcagtagtccagggaagaggtattagggcatggccttaggcagtgcaaattggggcagagaaagaagaagggatctagagataattaagggattgaattggcagaatttcactttgttccactcatgttgtcattcagaccatttatgttagtgtggtgcagtccagttaactttttagggggtgggtattttacatctgtccagcaaagagagcagtaaaacaaacaaggccagcagcacctggcagtaccagaaacaaagagaaaaattagagacaagcagaacagggacaaacgtacacttctttgtacaaagtgcatggcattttctgtgttaactgaaacatgtcttgttaaacatatagaggacaaaggaggccccagaagctctgggtttacagctgtaatctctggagccagaccttctcttgcagcatccacagtttcttggaagaggtctctaatctacaagaatcctgtgcctgacctatcatgattcactgtgtccatcgatgtgaattagaactcatgggatggagactcaggaattgtataggcaacatgagaatgattgactttagttggatcaggtgttgatgataagatcataatctccctcaaagcttaggaagcaggctagaatctgaatggttcaaatcattctaaccgctggtagcttcgtgtttggcccagatccctgggcttgaccaggaaggctatgactatctccacacagagatatataacctttgctatgcagagcacacagccctgctcctggcgtgcctcactctttcttcccaaggagccctacttaacctggcaaggttcacatttcagactgtggagaatgcccaccaggggttaaccttgcatcttttgcttgtagctttcagatgtgtggtcatacagtttcatttagaaagcaaattcctaaacctagggatctgtgataatactgatgtcataaaaataatcagatttcagagctaaacatggactgttttagcaacaatgattaaatgttctgcatatggcaagagctccctaacgcactactaatatcactgtaaccatcatttagagtttagtaatcaccatatttaggtcatttttccaaagcaccaaggagactcagactctaaataggtttaatatctcaagaggactctacatggttgttggtgggacactgctgtgttcaggtcccaagaatccaggagtatgtaagtgaagccacttggtatttaacgataccctgagaaaatgaacaacacacacctccctaagaggcctccctttgtcgccggctatcagttcttcatctatttcttaccctccaatgtgggagcacaccttagaggacttacaaggtacaggcaggagagaattctgcttaacacaacatctaacacataataagggctcaataaatattggcaattattataatctggtaactctagaaatgaccaagagagacagaatggacattttggctgtttttccaagttttcgagccagaagaaagttgttccacacattttgaaatatcagtctcacccacaaagttgaatctgtttattctttccatgaactgtcagaatcaactctggaaaaactaagactatggattcctctgtgctcttccatagaagaagaaagattgttgttatgagcattaaatgacttagtatacataaagcacaggtgatcctaaagcacttaggatggtggcacatgtggtgagcactgggaaagaactgtaaacaagctagctgaaactattactgtgatcttaaatgcctagaatttaaatcattggttctccaaaagagaggtaagagagggcagtcataacagagatgaactgaccaaaactaatgggttgggcaaccctgtaggctgcattaagccactactgggaaaatgcaagagctagaaaagagagttcttttctgcaagatgcagcaaggaacacaagagtcaaatagcaacctaaaactttacaaaagacatcttaagtcagtaggatcaattaccaatgaatggctggagttgagagccggggaaagtcactttgtcttgcagatggatggaacgactttaaggaagcagtagggattgaactgggctttgaagaatggggaaatttgactagatgggaagggctttcaagttgagtaaatagtgtaaacaatagctatagtaaataggtttagctggcatggcagtttcaagagtttatgtgaaagaggggtggtgggagagactgggacttcacaaggtgttgacaatggaaggagagagtttgaatgtcatcttttagtcaacaagaagcctttggacagtgaagtgacctgctgacagcagcgttcaggtataccccagtgggactgaacaggatgcagtttagaaagagagcaggggcagataccagtgcactcagtgcagagtcacgggtctgctatgctccagggacccagggctcctggaatccagacagacaaggcctcagctcttagggacctcaaaatgtcataaggtccagttgatccactcaaggaacaccagtgaatgctaaagctattaggtataaggtttttggggagcaggatattcctgcagtctcggggcctcactcaaggtggcatattcattacaaagggaaatgggcacctctcagtggagacattagcatttctgccttagccacatggatggagctagtcattgggctgggatatcctgatgtgatgccatccccgaagagattcttaacagaaatacttaagtagggagctatgtaggatgatcaagtctagaggtctaatgtacaacatgaggactattgctaataaaattgtatggtatttgggatttttgttaaatatgtagattttagctgctcttgtcacacacaaaaacgtaactatgtgagatggtaggtaatatcatgttgtaaacctcaaacatacacaataacatttatttaaaaaataaactgggctgggcgcggtggatcacacctgtaatcctagcactttgggaggccaaggcgggcagatcacctgaggtcaagagttcgagatcagcctggccaacatggtgaaactccatctctactaaaaatacaaaaattagctgggcgtggtggcgggtgcctgtaatcccagctactcgggaggctaaggcaggagaattgcttgaacctggcaggcagaggttgcagtgagccaagaccgtgccactgcactccagcctgggtgacagagtcagacctcgtctcaaaaaataaaaaataaaataaaaataaataagtaaataaacaggatccagaatatagaacattatagaagacaacctaggttcacacaaaatttaatgtcattacaaaggagtggtgtcaattatacattagaagggactgaagctgggattggcaaactatagcccatgccggctgcctgtttttgtaaataaagttttattggaacaaagccatatctattcctgtacatgatgtccaaaagctgctctgaagccacagtgacagagttgagtatttgtgacaatgtctatatggcctgtaaagcctaaaatatttactctctgtccttgtttcctgacagttggatttaagccacctaacagccaaatgcagtgcatgaaacttgggtctggggggaaaataaaaaaaaatcaataaacataattttggggcaactggagatatttaaataaggtctgcatattaaatagcattactgaatttttatgttttaattttctgaggcgtgcaatggtattgtgattatgctgtgcaatgcccttcttcttaggagttgggtgctaaagtatttagggcttgtgccatgatgtctctgatttattggtaaatggtttagcaaatatatatatatatatatgtacatggcaagaagaagagaagaaaaaagggcgggggggataagagaaaaagcatgtagggagataaagcacccgtggtaaaatgttaataattggtcagtctaaatgaagagcgtacaagtgttcattatactgttctttccacttttctgtagatttgaagagttttttaaataaaagttaatttttaccaaagttaaatttgttcctctaggctctgtcctgaccttcatcccagcagcttcctccaccttccagaattcccttataatggagaaatggttgggagttagatgtggcagcctctcctgctaagcgggtgctgttaccctgtaaggcagccccagcagggccttcccttggtaacgtggggattttgcttgttgtctcttgcacagtaattccatcaagctggtgaatctgctctccatatttatcagcacgtggctgactgcagccgggttcatccatttggtgagtaaccttgaagacccttctgctctcgcttgcctgcaacaagaccctctctgagtcattttattacctaaaatttatcttgctggaaattaacttcacctcggttgtagacaggaagatgggaagcaaccacacaattgtctgggtttccaacctttttaccccaaactagttccaaatggtgagtaatgtttgcactattaacctgcatttttcagttcattgctcattggtattgtcatgggggctttggtagattttccttctgtctgcaataactatagtaagccacaagatggcagtgcttcctaagcaaacacctggaaaaggtctggggacaaggttggaagttggacccacacctcctagtaaacaacaaattcagatccctcaatttctttccacttccgccttacgaaaagccacctttgattattttgtctgatttgtacctcaaaaatgttcattctttttcattagtgactctttgaaagccttgtattaagtcaagcccctcacaccacccgaaggcagactttccccctgcttttagagagcacagccattgtgggaagtgtgtttcatgcaaacatagactgttacaactggaaggagcctcgtctagctctgagactttggataaagttgaccaccagtggctgagcctctatttgcataagggatagaaggacgcgcttagctacccacacttgggatttaggtaattatcacccaaaggaagacaggcctgggatggcagtggttggggcatggggcctcacgtagtcaccagatctagagtctcctgcccagcccttaatgctgatgggattcatggccaaaatcaaccttaatcaccctaattcttgctgtaaccaagcacgaagcacccaaatcacatatgtggaggagatagttgtctttaataagatgatgaccccaccttactacgggtattagtgaagtcccttcaggttcaccaggaaacttttgtgaaaatggcacattgaggacaaactgatgtgtgaaagaggccaggccctggaaacattttgcagaggcagaggtggaggcctgggggccaccgtctacaggccctgtgggtggatcacaggcatatttgagtaaaattgggcccgcagctccctctctcctgagagtatctaaagtacctttcctgcccacctactagccttgttggcagatcaaatatgatggaaggacaggaaagtggggaaactgcagtctcgggccaaagctctccaaatccagccacacccatttgttgaagttttgcctctgcagagttgaacaggacctgtgtcgcccacaaaactgaaaaagtttgccagcccttgatctaacgggctgtgccagtgcaagctgttctcatgagctcactttccatgcccctgtgaagattccagcagcctcaaggctgggaccaccattgccaatttgcaaaggagggagagcagggccagattccagagatgctgtttgaatcagaaataagcagggcccatatatactctttggataaactgatggaaggaggcagccccctacggaagtgtttagaatttctgtgggagaggcagatccaggccatctgggccttagaaacccattgaggaaggtcagggacggaatctctggctctttccttgaagagagtgctctaaaacctggccagaggcaatgccctgaattttagctggcttcccacattttaccagaagaagagaaaaggcctagagatatttcccttcttgctttccctctctgtctcaatcagccaggaagacatctcctgcagctgcttctccactttctctgtgtcctgctcaggagctctgcatcctgactcacagaactcagcccgggaaccacacatctcgtgtggagagtggtgtgcagtagcaagtggccttcgagagtgccgagcttccgcgtttattgcatgtatacacttcaatagcatgtttttcttttttctcccctgtcccatttgctttaggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggtaaaaaaaaatctttattatgatgttgattttgatggctgttaatattttccatgatacatttccttaaagctttgtattttagactgtattctgcactagaagcaagccttaacgttacaatcaggctaagtaaatccaaacacgatggtgacttttctgcataattcttggtgtattacacttgtcccatagatccaggcacattgcccttgtcggggacagccatttagccaggagcaaacctaattgtcttaagaaaagtgatgctgttaataagggagagtgtctaccccttagcaatgtaactcagcatctggtatgctacaaggacagtggctgtcacctgcctctggtagaagctgtcgatactttgtagagacagtttgcggtttcaagagctctcccttcccctttatgttcctcccctaacttccaacaaacactgtggctggggcctgccctaaagagaagggtccctacatcaaaggagagagagcaccttagtcttgtccaggcggacatccccatgtgagcagagtgcagttttgcaaacagctcactccattctgcagcggacacatggggtatttttgctcctttcttctaagaaagtttcactgtttgctttttaaaagtctacgcagctctttatgttgcactaaaccaccccttctaatgtaaatcgaggggatttctggccacacgttggcagttgctgcattttgtctttcaaagtagctcattttaagtttagatttttttttgccatttatgaagcgagtgattaaaatcctaatccatacacagctttcatgtatgtacaccgtgcgcacatttatatgtagtgatgcatacacctctctctgttttgtatgcatagggcctatacattttaaaaatgtatataaatgtgcacatgcatgtgtacattcacgcaagcatttctacagcatccgtgaggtgcctatagataaaaagacccatccagccagccacaggccagatgtttgttggacaaaacatggcagatttgtgtttctccttgctatcttctcctcccaggtgatttcctaaatttcccttttgagcttttcagtgtttttttttttttaatagaaaaatgtagtttttaatcttttggtgtttattttcttttgtcactcataaaagcattgattctcctctgaattttaatgacaaaggaagatcttctcttgcgaaactgtgtgtgtctgtgcatgcacacatgtgtctgtgtgtgtttagtttcactagcatgtccccctcttgcctatttttcttcagcaagaagaactagatatcaccttatttattcctgtcgcctttgtatttttctcgactgtgatttttttttgttctttagttgtcaaggtggccaatgtttgtttgtcttgtgtatttctgggagcttgctctcttcgtgcttttagttttttatgatccaacatatcaatatatacctttgcaggcctaatccttttgtgttttcagatcttagtgcccccaccctctgaacaggtccccccttttctttggcctgtctttttagtctctcttctgtctcctatcttctcaggccatgtttgccagctacgtccctgaaatcatagagttaataggaaaccgcaagaaatacgggggctcctatagtgcggttagtggaagaaagtaagtatgccaagaggttttgctgcctctgctgcggtagaatcctctctgcatgccatttttttttttttttggctcttgtttctttgtttcatgcatgtaggcaatgtttgcccgctacgtgcccgaaattgctgctctcatcctgagtcggaataaattcggcgggacttttaacaaacatggaggcagaaagtaagtcagttgcatcagaaaagatgtggttgagtgactttcaggagtccctgtggaggtgccatctgaattctgcccctccccaaccccaccgggtgcttctgtgagggaaggcccagtttctgcatggggtgtgatgtcagaggtgacccgaggacgttgccacgcttggaccaactcccattcacaaattccaagagatgtaatgaatttatcctgaaaggagtccatttataactgggcccatattttctcttctgacccctaacaagtaaacaaaactcgttcattcttccatcatctggctatgtgataaaattctggtccctcaaactagtatgatgccctcctatggtggtttgtgtgtagcaagaacacaggataagactctggcagagaagtccttgggtggcagatccaggtcatctggcctactgcaaaggcactgcggccactgggaacccagttctcctcttcatccaggaggcaccgatcttatcctcaaagggactcattactcagctgaaattccttccgggcaagaaatagtatatttctggtagtttagggtactacatgctattcctgccaaatcttttgtttggcttcccaaatgtgaatgctttcttctcgggaactattttagtgtgtgctcagatcactttatcactctcgatatcaatgtgcaggttcaatagagaccccaaggttttttcctaagtagagggcagtaccttacaacctcaagaggagaatgccatgggggagagggggctggcagcagccatcctttatttatttttttaaagctttttctggagtagtcacctttgtttgtttttggttttgaggtataacttacatagagttaaatgtacacatctttaacatataaagtgaggaacttgtacctatgtacacacccagtcactatcatcctaccatccggatcaggacacagaaaactttcatcactcatgcctcttcccagtcatggacgttcctatcatggaactgttttgttttgttttgttttcccttctcgttctgtttcaaatgaactcttaaagagcttcttttgtttttttaagaggaaataaaatcagactgggagcattgtatttccctccactgctgccttctctttttgacagtcagccgtgtgggacagagtggaccctcccctttggtcagtgagtccagtgcttcctgagctcaggtgtccaggcctctgcacaggaaatgaggaggtggacaaaagggctcattttcttgaactacccacaggacacccgtttcctttcaaaggcacaaaggacagtgggccagaggaggccagttggcgtcttttccgggaggcagcacatccctccatcttccctctaatggagccctcccctcaatattatcttaacagccctggatgaggttagaaccaagctgttctgatttctgggccattggttggatccaaaaggccaagtaagtccaaagattcccagtggtcatgtatcccatgccaagaggaaaacagcatctcaattcattttgccttgaaggtgtggacaggtctccataaagcagaaggcattctgagggcctggggctctctttatggcctccctatcttctgacgtctccgccagcatttcccaatcactgccccaagaagtcaataaaatcaattgccctgaaggctaagttgaaaatatttcttgactttcattccaggtgattttttttttttaatgaaataattttcctagtcaaatgtgggtgagctggtgggtgggctggaggccggcagctttcggtgccagctgacccagatggggctctcagcccggcactcactcactgcccccagtccgatccggtcatctttcaccctggcagttccactcaaactttcaggtgctgatgacttcagatcacagacttcctgccactctgttctggctctgtaatcttttatcaccgcttttagcctggttttctctctctctctctctttctcttttttttcttctccgtttatgaaaatgcactttgcttttaatgttctttttgggtccccactgttcctgaccctgcagacacagagtccgtcctgtcatcagcaccgggcctgttcactactttatgcattgtttcctggttcaaaagctaattactaagtagtttaaagaaggcctttggtcacttagatctttcatcagaaaatataagcttgggaaaggcacggtaataaagggccattagcaccctttgtttgatgttgtttttccagtcagtaaaacaagattgatgaaatgttatgtttggccaaattttgagttttcatttggaattcagtgttgagagaatgggctgtcagaatcaataagttttctttcgcttgggatatgggcatgtggtagtaattagcaatataaggtctttagttgagcaaccaagcatggattctggcagcaaacataatgagaaactacagttgttctatttctaacgtcaaaaagtttccagataaaattaaatgcatttgcaaaaggaaagcagctaaactttgttgaaagataaagttcagactcttaaaacagtgtgctgtgctctgagtttttgtgtatgcataagtccatgtgctctgcccatggacacacacatacatgttctctgctccccaggacccaatcaaataaatgcccagaaagaaattagaatgtatacatagttaagggatttgtttacttgtgcatattttattcagaaatgatttctctaacaatatattaacttgtcagagaactcaaggtaactcatgatctaaagctacagagacataaaactttgaaattcaaagattatttaaagtacaaaatttaggcagagaagatcagggttttgtttgtacaacacccaaattcaggatatttgagaatatgaagatttcattggcatttcattttcagttttaatcaatgtgtttggcataatataaacatttcaagtagcattctcaaagcctcttcaccatcaacactatttcaagggcctagagtgccttacccaacattttcatcacctcctgaaggatacccagtccctgcagtaggtatgggtaattgtgcacatgtgcgtgtgtgttggctatttcatgtatgttatgatggattggagcatctaagaataggggtttgggtgtccacaaccaagggttcagtgagtagctgaggcaggtaatctctctgagttggagggattagagctctctgggctcttgggctgataccctaaatcttattcataagggagccctcctgcagcccagcctgcctcccaaggccactgcctcctcctcctttcctttgtgtaaggtcaaagctgcttagagacagggaaggcctgagggctggtgacgctcccatggcctttgggatccccagctctctcctccctctcacagccccttgcagtttcccccagaggtctcctccctgagtgtgattcattccactcctggttagtttatgagaactgacaagatcgtggtccaaggtcacatggccaagggccatggaaaataatcagtcacagagaggaatccatctgctgtaacccccttgttagagggagtccagccgggagccacccagaccttgtgtttcccatgttgggacttgagtgactcaagtttgaggcaatcctaggcccaggtgtttgggacagagagaatgggatgggtttggattattctactgattcctggtagccaaatgctgacagggcacacgagaggggaatgagtcatgaaagactagatgtagccaaggtgggagaggaaagtgagtgtaattaacttgaaggaaggtcctcaggatgaagctgctgagccgccattctggtttggggaatagttgtcatggactaacccgtctcttgctccaattcaagaaagctgcctgtgaaacttaaatgctgtggcttctcttggaacatttgcctatagagacaggagtgccacacacttcctgaaatgagaatgtgaatcagtgcagcctaaagccccaggactgccttctctggcaatagtaatacctacaaatatttgcatatttcagaatcctcacattgatcctgtgagaaaggtattaccatcatctccatttggaatgagtgaagaaactgaggaacagggaggttaagtaacttgcctgacatcacgcagctagtaaagagttgggctggggtttgaacctggacagcctgcttccctgcgtcctgctgcctctccatgtcatctcttgagactccattctgctctaaactcagtgatctcctattgtttgtatcttcctccacctttccgtataaggggagccagagtaccgtgctcatgatggagaggaagagaaaggcatgagcttcactttggggctgtctcctctcccctcctgcccacccactacccctaagggtcctggccccaggattgaggggaaaaagatggagaggggacaaaaccattccttcctttatttttcccatttggttagactagaattctaattccctcttgaacacttctagcaatgaaaggctctcaaggacagacagatgaaccacacctaaagtgagaattgtgccttttttgtggatttcaacattttcttccccttcctggctccatcctttaaaggtagttccatggagaattgtagtgatctgctaaacttggacttccctgctgggcagatctcacctgcagagccttctatacccttgcagatggaaccacctgttccctttcactccttagttagtctgccgcacagcacagagcagtatctggaggtggtttcttccttatcagtgaaaggcacagtagagccccacgtgaccagttctgcagggtgcattctgtgtgtttgtttcatagctttgacttggaatattcaccctcaggagcctgtatcccgctggagggagttagggctgtctgccttcaacctcggatgtggtctccacattggaaagagccttacattcagagagatggggacagtttgtcatgcttttctatttaaatatgaaactagagtacttaattatcttctttattgtaaatgctcatattttaaagaggattccatactttagaagaaataattgagtattcaatagttgagaacaaaattcaagaactaaaaacagcccagcacagttagtgacctgcctcactgtccattcctgtggcccctctccatcggttcattcactcactcggcaggcaggcattctctgtgttatgcatcaggcatgatgctgggttttgttgggtgctcagggttcattggcgaacaaactaccctcggaacctgtcctcctggagtttacagtctcaaggaggttgcaagcactgagcaagggtacaactaaagcaaatgccaattacacatttttaatgtgtgctgcaaaaccagaaaagactaagattctgcaactgagaaaaacagggattagttacactggataaagtagtccaaggaagcgacacctcagaggaggagatgctaactaacgcttgttcaatgaccttgacccagcttgcattacccactaagctgggggagctaacactcttgcttttaaaatccaggttatgcaagccccacttgcaaacataggtcttcagttctacctccactagaggaagtcttaaaaactgattgctcgctcagaccccaacctgcctgagcagtgcttgcttgacttatcgggagatggcatcctgcgtatcttccctgcttcctgattattgggttatttttaaactctgtgtctttccttatatcagaatttggactctccttctcactcagaacctttgttccttcctgagagcgcacactattccctcctgcctggctgtcttgtatcaacgtggaattccactccatttcctccaccacactcatgtcttgtccaccagggttctagactgatttctaaaggatttggaattttaaattgtctagtgtgccagagcatggatcatttatttacaaagactcatttaatctatggccccatagcctaccctaccttaaaggaattaacacgagtcatgccttcatgtccatccattccacatgtgtttactgagggcttgctaccaggcactggggacagatgcatttctacacatccataaaaatctccaactataccacagcttttctgagctacacatcgtactatttggccacctaagtggttgggaagtccaatatcagggcttattgaaacctcttctcttggttctgagagagtcttgctacaacaccatttccctctcgactctttctgggaaggcatggcctctagcacttgggaatcggatttgagatgatttcatgttatactgacttgggccgatccacaggccttttctttccatgtttacttgtgtcttgggcaacagctattctcacttttcctcgcctgcaaggggcggactgctctcatgaggggtgtttcctataaaatgtcatttacgatttctctattgcagacatggctctggtcgaaatgtgactgaagctttgcatcctacacagacttagatccctcatcaagtagccattcagccctcattgcatgagccacgtgacttccccagcctgaacccctcagcaatgtctttggattcctagattttaaaagccataaattagcaaatcatcaacatatcaccaggaaggatcatctggtagcgattctagtcagaaggaaacacaggccccaataaccgatctttataaagatatgaagaactgtagacagacagatacagtaaataagaagacaaatagataattcaagttgacagaacatcttggactgattaggcattctgctttgattagcattaaacttcttgggaacagggaaaacaaaaaatgagcttgccctaatactttggaaaaatgacctcttgactacttctgaaacgtggtgctgaggggtagatacccaaagcgcttgtcattagatgccatgtcttctgatgtgatgtgctaggtatcccttcctgatgagaggggtcttggtgggcgtgggacatgggcacttctttcttggcatctgttttggattcctctaagccatatcttcagtccctttcaaacttgaagctctatttaaagagacttggaagcatattaaatcaatttcctgataatactgatagaatgaagctcccctcctttcctgctgtcactcttcccttccacacacttagcaaaatgttccagctattgttctgaaaacaagaatagaaatgtaggtgggagatgaactgtgtaccttaaaaaaaaagtcgtattcaagcctagattttcactctcaaatattctttcttccattaaaaaataattcgaatatgatttctcaaattataattgctgaagattctgatcaatggctcctttgattgggtgaatccttgccgggtagattcagaatctcaggaacaattgcagccatccagactaggttgccccctgttttctgtcttcgtaccatgtcattcactctgctggacttctttccagagctgtgcaaaatggttcctggtagctttggggttccttccatgctgctgtcatcatactatgaaactaaaccaggaaactttctaactggccaagtccagtgtctctttttattaaaacattatagaggtcaatacattgtgagagttgtggaaatctgattctcttgtcccaagggttccagtctccacagccagtactggtgttgcatcacaatggcctgctgtcacccccagaaccacagggactgttccaaatatgggtaccagttgctggaaaagtaatctatctcccctccttgtacctttctaacaagaggacatgggggcagttcagagatagatatgtgcccatctcagtgggagcttatatgaccttagccattgactccaaaggcaaatgtcagctagtgtatagaacagccttaggaaaactcccattctaacatattggctcaacaaacaataatttgaatccccaccatgtgctgtgggtaaaatgtggttcttgctctcctggagcttatctgagattctgaccaatcagtaccacccaaggaaacagtggcagtgaaacagaagcttgagtatgcaggagcgtcttcccagtgaaatgctcttttttcaggaattttattcattgaaatcatggaagtgtacaataatcatgaaagcaagagacattagagggaagcctcccaaaagcatttgataattcacgttgttgaacatacccattgaacagtggagagcataggtaatagcagattgccttgttcacctaaaagcttacagacccagtaaaagaggggtgcagaaagatttgggagggttgggaatccgctgatgtgatcctgaggtccactcctttccagaccccacaaaggtcctgctgtggcctgtcatgcctcgtatcatgccttctttttacttttttccttttctttttttttttttttgagatggagttttgctcttgttgcccaggctggagtgcaatggcgcaatcttggctcaccacaacctccacctcccagattcaagcaattctcctgcctcagcccctcgagtagctgggattacaggcgtacgccaccatgcccagctaattttgtatttttagtagagacggggtttctctatgttggtcaggctggtctcgaactcctgaccgcaggtgatccgccagccttctaacctgtagctccttccagtccctgtgtgactaacagatgctggaggtctgctggggcctatgcaagtatgttgagtctacagagtgaatggctagcagcttatgctagctgtggcaacaccgttgggtgtggctggagaacaaggcaaagatatgtcaagttggttgtcattatgggagggtcagtcccaacagtatgtgctcaaggaccatgatacatgattcaccaggggtgttagggagggaggtggggctcgctttgtaaatcaaaaccctctcctgggcaaaattcagagccatttctttgcttggactcattctccctctattccaccttcatccctgaagagtgaggctgacctttgcctgccttagtcttctctcagtctctgcttgtacagaagcagcattaaaaatgaaatcgggcaaatctgctttgatctgaaaaaaggaaagtgccattcagctccctgatttctctgtaagagcagagaaccatctagcattgggagattcaggtcaagggaagacttgcttattttaaaatggccaaaggccaccaagcccaaagtaatgggatgaataagatgcagaggggtgagggtgttggggagggaggcataggaggaatcagtgcagtttgtgagggttcagcaactgtggaattgcttactgaagaaagctgcagaattccccttccagagaggaaggaaggaaagaaaggaaaggagagagaaagaaacctaaatggtggtaatacttgcatactaggtaacagtgagaattaggtgagaaaccaaagtaaaggtaaacaagtctaccagttaggattctctggttgcaggcaacagaaacttatttttttgctgacttaagaagaaaagttttttgttttttttttttaaaggttagggtaccttagagattccaatgaaaaactgaagagcaagatcccagaaaggacagaaaagaaccagagatgcagctctgacactgaggaagtggaaactcgggagtagtcattacagggttttgtcatcaggttgaatcaactcccactgtgattagcatcagcccatccaagatttaagagtacccattggcctcacttgggcagaaaaccttcactaaaggtcccaagactgtatataattgggagactgtatttaatttggggaggagcaattccccaaattaaaatgaggtgctgtccacagaagagagggtgtatgcaggacaggcaaaatctaccaatgtccccggcactgagtttctcagaatttaaagacttggactgaggctccatgtaggctacaagctacaaaatatgtgtgatcatttctcaccacggtctaattatggaggtctaactgtgatttgggatggtggaggtgtagacacagatccctctagggtagctgaggttctgactgtctgcatgcgataagatgcaaagttttggcccaggtgggacatcccggtattccccactggggctgccagttgtctgtcctctgaccttggggctctgctttagaggtgcctttgctgcactgttgggatctatttgctcagacttctgccccatttagggaaacagcagcacagcctgccacatccagaacagctccattgacagctggagaagaagattactttattcacttcctcactaggagggagaatgcatttccttcctttgtgattagcaaagtactagatgtgtccatggataggaaattatcttattgctgaacctccttttttttaaaaaaattattttaacaggaaatggtgatagtcagggtttggggttgtgggactgatacacactctcatttgctttgtttttatttttctttatgtgtacagatcccttacaaacttgaaatatgctagtagattcagggtggtggaataagcctatggtctaaaaggcttgcagtgaactacctgttaacttttttctgcacttaccatgggatagagtctccaagatgcatactttgtcaaccaatccatcagttaacaaatagttcctgaaagcccagcaagttttgggggttccaagccaggtcctggggtagggtggagggatgaggcagcacagcctggagttaggcttcatttgcccatgatgtctcccctatctttactgaagtcagtctctttgagacattcagtaaaggaggaagtgggaaggtgggagttggattagtcttattttttggcagtgggggattgagcctcaagggaagcgctgggaaacagtaaccctgaaggacatgccccaaatcagggaaacctgcattaagactaagtagccaagaaaagcactaccaggtgagaaggaaaggaaaggccagcttgcaggagtgtcatggagaggtggtgatgcagacaccaagggttcaaggtcaacctaggggggcaaacgtgaagctttggtgctgaccactgtgtggtttaggtcgttgggtctctaaccccccacgccctgcttcctgtatgatacagtgctgctggttctcttgagaagtacttcttaaaattcattcccatcatgtcaggggctaccaatggtgagatgcattttgggaggagcaggacgaggaaaacacaattagaaggctcagcagaaagacagagagtctagcatatgtatttgatataaatattatagttttacagagacatctagatcaatatgtgccacatttcatctacctctttgacaaagtgagcacaatgtattcaggcaaagctgtataggattttcaatttactctgtctgatttattgtgacaagatagctctgggttttttaagttctttatactcgttccagtaaaaatggatatagtatctttaaaaataaacagcccagagctgtgcattttacattgtcttcctagagcgaggctctgctaaagaaagatctaaggcctccccgccctcgcagaacctgatcgcagtaggatttgctgccatcccttctctttggcttttttgagggagtgtgggaatggttgggggcagtggggacagtaaatagggaaatcagttaggaagcgattgcagatgtctagataaggtatgatggaggtgtgaactaaggtcggacagagaactggagccctgtgtgaggattcatcagtgtctggtgggtgcagcccagtcagcctgggcctcttcattttagtgactggccccaggtcactgagaactcgccccccagtctcccaattcccagcttaggttatcctccctggcaccagctgctttctttcatcagaaggcatgaaactgagggaggtgttgtgctctggatctggcactcatcttgcaacctgtttccacatcaaagagaagaaaggtgctagattaaacaattgccaagggctattcattcagatgctgagataaacttaagaacgtgggagggggcccaatggtgactattccatggtcacagtttcccttttcaaaggctactggctctaacaaccagtatctgaggcttgggaaaagtatgtagattttccttgtcatagacctaaaagtcatcttcagtggctctcttgatgcctcagtcactgccctcctgtcctcttctgccttctgccttaagtcacttcccctaggttgtcctgtgtacctgtggaattgagctctgaaactgaagttctggctcaacttgggcatgcaggctttcctggcccatcactgagaagagagtagaaggattgagaagaatttgtgggatttcattctggaggcagcgatgcttaaatggcaggagaagcacacccatgtatatttagtgaagatatgcacatgaaataagcaactggcgaatttatggtgaccctcaatagtgttcataatcatcaaacttcttctcatgaagtcattcttacccctccaatgccgtgacccaccgcactgcccttttcagttaaaccagcccatatttatggagccctgacccagcaccaggcactacttgctcacactggatgaataattcctctccagaaagtgccgttggatactattttggcattgaagatgcttccttgtgtttctgaggtggatcttttattctaagccatgacctgtcagcttatatctattttatgttacctttgcccaagaaatatttgtttacagatccagacctagcatttaaaaccaaaaacttcatcagatcagaaatggttattgattgaggactattggtcatcttcacaaattgagtggtcaggccctatagaaattggtcaggacaatcgctgatggtctaagaaagttcagatccacatccacagatggggagagatttagctactctcatagctgaactttcctaaatattccccattgtaaatggatcattaagattcttattatcttctagattccaggctggtgaggaagtcctgagctgtacatgacatgtctaaaatagacatttggggtagggcgcggtggctcatgcctgtaatctcagcactttgggggccaaggtgagcagatcacttgaggttgggagttcatgaccagcctgggcaacatagcaagaacctatctctacaaaaaccaaaagaaaattagccagctgtggtggcatgcctatagtcccagctacccaggaagttaagacaggaggatcgcttcagcctgggagttcaaggctgcaattacctctgattgagccactgtactccagcctgggcaacagagcaataccctgtctctaaaaaataaataaaatataatataaaataaaatggacatttgcatcactttgcagccccttagcttgctccaatcatatggcttcagttaagtttggcttagagttcctgaccggtggaacttatgatttctgcctgtaatcagactttgctaagactatcatgatactgcctatccagccagactctagtgatcttgcaaaactgtgatggtttatccactccagttcccagactaaacctctcccttggccagtggaggacccctccaacaccccctccaccatgtatccaggaggacctctgtgggtccatttctgcttgccctgaaggagcagaagctgagatatacaagcctctttcctttccaccaccaccttcatcttagtgggaactgaagtgggagacccagattgcatcctgggcaagtcacttttacttgctgtgggatgccaggcatatatgacttaaggaaagagtttcagagaggttacctgaaaagactcaggcagtgagaacacagggttgttgaaggattaggtgggattgcataggccacagaatactttatattggttacatcctaatttacagataccatatggcacttaccatttcatagtgcttaccatggagcagattacttggcccttccatgtatcatctccttagatatcaggataacttcatgaatcaggcaccagctctggcccctcaaaggctctggctttttaattgtaaaatgcaaaattggtacattgtccaagactatttagttatttagtgtctgagctgagttaacacagggctatcagagtatgaatctcacatggtagatatgtaggcatcatggaacccaacagagataactttggatggggatcttttttggcattcttcaaatcatgccctgtgaacaaccattactctgcctccaatgaggtcacaccctgctgtctatcttaacatatttgtgttgatatctctaataattgaggatgcaataaattctagttctcttcttcctgcaataatatccttccccaaactatggccctagaatcttcaaaagtcttgaaaatatttctggtaaataaatgttccccattcaccatccatccctcatgctcttgcagggccctcctcagacacaggctggcggaagcagatctcctaataccgattgctgagttagaggcagcttctccccatccatcaattctaactgcattcaaacattttcaatatgtgggctccttgataactttcactgtatggaaaacaaaatggagggaaatgattattggcacaaaagggggaggccataaatcttcaaatcagatataggacagattggaacaatatgggttctccaaggttgccatgataatgtacctaataactctccttgggcaaaaaggcaatctgctttcaatcaatctcgctttttttctgagcaaaaataccaattacgttgaaggaaggttttttttcttccttttttgataaagacagctctccaccccagaaatcatgctgtggctaaaagatatatattttcaattgtctagaatggtattggatagctagcaccaaatgaaaaaagtcaatcctttttttctcctcactcttgccagcatttgtctacttcttaagagaagtgaaagttaattaaaggcttaagggataatattgattgcattggaatatattttatatgtacccagtacattttcaaggaagagaaccctgactttttctaaggctgaataaatcagccagctgagcttttgattcaagggtgagaggggggaactcatcttttccccttgcacttctcacacatctttcctagggatgaatgatttcagagaggaggaggagatgctggctgatgttcattcagttctttgcatgctgggtaggaagaacgaatgttcaggcatttccccagacctatcattgatttgagcctagctttgagtaataaccaggcttatgctggtatagaacttcgaactttacaatgcctggcacaggaggccggctgggtggtattaacctctcagcttcctcctgcactgaatgggaataaatactttgcccacacccttggtcgcagagcagggaatcacatctggcttactttcacatctaagtgatgagaacagcctcagccacgtatctgtcctgtggagatacccacgcattggattcatgttggctttgctcctaatcttggaagtctatgtgcagaggatgttagaatggcaaagtagccctattgtcagttgcaaggaagttaggtcagtaggggaattctgtttctcattcacttcaaacatatttggcaaattcaaagtctgaaatcttattcagaacgtgcaaatttatttgaagtattttgtccatgtaaatgtacatgtgccacaagaaacattttaaaatatatgataaaatgcatatcatccaaatgttcaatctatattgtgtattctgatacactgtgtgtcacactgtcttagcctcatactactcaccatatactaatgagggggttagtcatatgggctttgggcataaaatttgggtgggtggctaagggaccttcatcaacctagcaggagagcaaagtgatcatgttaagacatctcttctgaagtagctcattgacactcttccctcaccttggtggccgctgcgtgcctgattgctaagtgcaccaccgtaacaataacagtctataatggtgatattattaactgcatcgtgcatattattgatttactctttgttctgcatcattatcctttcaccaatgagtttactgcattattctcacatacttagtcaagcaccaaattacaacgaaagggcaggctcttataatggcatctaatggaacattgcataagccatcatcactgcctcctattatgagccacctccagccaatgagctttctgccttagtggaatgtgcacagagcaattatgaagtgcaagggacatggccattctaaattttacccaggaaattaccatgctgcatgttcaccacctgcccaagtctcagagcgcagctagagactcagatgctgtcactatgagcctggggggcacagggacaggagtcgagcctcttgctacatacagtctcttcactagaagccagtggttttatctccacagtcagtccctggctttttgtcttgtggctgactcttgcatcaaatgctcactcctgactgggcattatgtggcacatataagtggccatgacattgcctggtgccaaagtcagattggccaggagccccgagcggttggagggactgtcagtctcaacagttgtggggctcatctcttccgggtgagccactacttccagaaacagaagtccaaaccaccctcaaacaaggcgagcaattccagcctcatcccttcccagcatctccccatcttgaggtaaattcctttagctctcctggaaatcccgggcaccctaaggaagcagccctctggggacgcacagccagctggcatgatcttccattccataggcatcccagccccatttagccctgagtaatgctcacttactgtaaagtgttacatgcccccattgtcggaggagttatagtggaaaaatgcaaaatttcctttttactgcttatggccagcagaacctataacgtgtcaggccgcacattagccaccctgataaaagtctgctttcttacacacaaaatcatcgtttcagcaagatttgttatctcattacctgataagctctatgtcataaaccaagactcatacagtaaatctccccggaggacgctttgtgggcagaaagggagagatatgaatctgcaagggacttgataatgcagcatttaagcacaagcataatgtcacttattgttaaatgcataaaaccacttggccaaacagttgggcttttaataggattttgtgcagcatcaggtgagaagccatatggcttttctgtctaggagtctcagcacctgctagcaccgctgctttgcctcactgccctctggggatgggagctgggcttttatggaggcggagggaggagatgaatgcttcccctgcagctgcctggcttctgctgtcttgccagggggtgggatgcagggtcctgtcgtggtgcctggcctgatctaactggcctctcctgttcaggcacattgtggtctgcggacacatcactctggagagtgtttccaacttcctgaaggactttctgcacaaggaccgggatgacgtcaatgtggagatcgtttttcttcacaagtaagagcttcctactgctgtcagaccctctgcccaaccacacaccctgcgagggactccctgaatgtctgtaagagtggaggtcttggggaatggcactggggatggggccagagttgggtaagccatgatcccttttggcctcgttggagaagatattgcagaaccaatggaaagggaagcaacacactggttcaatgatgagagcagagtctgcctctgtggaggcgattctgggaccacatccgagtttatctctggaagaaataatagtggagctcattgtgggtccaagtcatcatcattgtccccttagcaatctggcgtgtccacattatctgctgtgggatgattagctgtatggtgtggatacgttaggagttctggagtcagttggtgaccaagcaagacaccaacttaagaggaagcaggacagaaggtaatagtaataacaactgccgttcctaggaacccccagcatgggaccctagcccgtcactgtgcatgcaggctcccatttactccacaaacagagtaaaaatacatattctggactcagattccctgatctgaatcctgactcaaccaactactggctgagcaagttacttaagctccctgtgcctcagcttcctcatccataaatcatggagatgatagtagttcctacctagttgggctgtgatgagaatgaaatgaattaatccatatgaagtgtgcagagcagagtcaggcgtgcagtaagtcttcaataagtgttagctatcagcctgaaaaataacatatatttggttgtataatccacttaggaggtaggtcttatcttgtatgttttacaggggaggaaagcaaggtatctcccttctacccaatgttgaggttttcaactttgactaatcctctttttagataaaaggtagtctgccccaggaatggagagaattagggggctccattatggtgacatgtgtggtaccatggtcatcttcttttatggagatggggctgtcatggggccagtcctggcaccacatcgcaaagtccaggacaaagctaacatgtttgtgctggcttgacgtgctgttgactacccagcacgcggtcctactctgaggttccactgaggtcggcttccctacaaactccctgtttggtggatcgtcgtcctctggcatttgctcacagaatgctagacttctgacttgtcaccatgttggggcaccaacatttctcttttctgcactgatttctccaaactttgaaaaaacagaccaggctatgttagcacaggagcaggtacccacaggttccattcagtgcttagccactgattacctgctgtgtggcccatcctctactgagcgttttggaaagttctctagaggtatagtgtgtaggctgtgcccccacatgagttgggcatttcaagatgaacacacatgcaaccattagagacaacatcaaccctgtgttatccaagggatgctgaagtcattttgatcaggtggcagaagtgactggggacatctctttcaaggagcatcagtctatggtattacccgggcaggcttctgaatgaggtatgacttgtcatgggtctgaaagactggtcagattcacagaggcagccacttttctctcatccactgctttagtttgaataaacaagctggtaaggtgtggttgctcatgcttgtaatcccagcactttgggaggccaaggtgggaagatcacttgagctcaggagttcaagaccagcttgggcaacacagtgagaccccatctatacaaaaatagaaagattagccaggcataggggcacgtgcctgtagccctcgctactctggaggctgtggtgggaggatgacttgatcctgagaggcagaggttgcagtgagtcaagatggcaccactgcactccagtccctgtctccaaaaaacaaaacaaaacaaaacaaaacaaaacaaaaactggctgctcatgcttccattgctaggattcacctttgtatccctaacatccatcaatgtcatacttatagtagatggcccagttaattaacctcttgaagctctgggttaataacatacctgcctatagggttgttttgagatttaaatgaattaatgctcatcatggccaggcatggtggctcatgcctgtaatcccagcactttgggagggcaaggtgggtggctcacttgaggccaggagttcaagaccagcctggccaatgtggcaaaaccctgtgtctactgaaaacacaaaaattagccgggcatggtggcacatgcctataatcccagctactctgaaggctgaggcacaaaaatcacttgaacctgggaagttgcagtgagcagagatcctgccactgcactgcagtctgtgtgacagagataaactctaagtaaaataaaataaaataaataaatattatttattttacttatttatttataatactattttactattatttatttaaaatgttatctgccatatagtaaatgttacaaaacatgaactattattattattgtcattatggacttcacaaatgttaggcaagtgttgacttatcacggtacctggcgtatagtaggttctaactaaatatcatctcccagtgcctagcacggtaccttatcgacagtctttttcatctctgcagaattaacaaatgaataaataggtcacttgtttaatccttgtcctccaaagagaaagatgtcagtacagatcagcaccaagaaatgtgatgagtcgcatacatgtgtgtgaatcaagaacaataatgagagtaaattaagtctgtctgtggctcctcagagtgatactttttgatccaggccttgggggatgagaagtccatgagacacagaagcagagataaggttcatgatggagggaacagcaggatgcctctcccaggggaaccttcggctaatccttgattgtattagtcagggctctccagtgaaacagagtcaataggaaatatatatatcaatatatctaatacagatatatatcggtatctatatattgatacatctatctatctatctatctctagagagatttattaggaagaattggctcatttgattacagaggctgggaagtcccactgcctgccaccagcaagctggagacccaggaaagctggtggtgtttgagtctgagggccagagagtcatagagccaatgtcaaccccagtccaaggataggagaatgacaagagatgcccagttcaagccggcaggaaagaagcaaaagggacaaacgcctctgtcctctgttttattgttctcttcagaccctcaaaggactggatgatgcccactcccacaaaggagggtagtctactgaattcactgattcaaatgccattctcatccagagactctcccagacacacccagaaatcacactggatctgggcaccctctggcacagtccgcataaaatgaaccatcccactagtggcgcagcccagcttccatatttataagataggaattccattcataccgaagagaagacatttgtcctgaggtcttggccttcctaaagcccatgaacctctttcttttaccatggtactggtttggttttcagttgggctggggttttacttctcttgagtgtgagtcttttatttatggcaagcaaaagggtgactgtaggtcacagcctctccccagggctccctgtggaaattagagaggaaggagcccatggaggctgaaacccccgagtccattaaattaatagcgatttcttctctccctgtgtagcatctcccccaacctggagcttgaagctctgttcaaacgacattttactcaggtggaattttatcagggttccgtcctcaatccacatgatcttgcaagagtcaaggtaaggaggaagaggtgacttctgcttttattccatcttggtgtgggtctggggggagtcctgactctgtgctgaggggacacacctcctaggttggccacgagtcatctcctaaacacctaatgagatcaatcacataccagcaaccttgaggtcacccttccactggtcccaggacctccttctgctggcatatgcaacactacctataaccatcccacacttggactggtcataacatgaaacttgctttgctggattcctcaaaatcagctactcatcaaggaagtagaccagttatatggacccagtagctttatacaacataataatcaagtaattcctatattgaacacttaagttggactcaatatagctctgacttctattatttacatctgaaagaaacattaggctaaaatataaaataaaattttactaagcgataaaacatttgagctttcttttttccccatctaagacgcagggtgtaaaactaaacatgcagttatctgatatcattgataatgggcgaatctttttttccagaaactggtaatttagaatcttctcataaagcacacctgaggcttagaagggaaaggtacaaggcaaaatggcatctgctactttacctatgtaatatagattttgtaagcatgttcaatatttgcatgccagggggtgtacattaatataatgaattcactgaagtctaaatgctaactgtggtcaccgcataattttgtaaataatataattggccaagatgaataatccaaaaggatttggataaattctttctttatattattaaagaaatcagagatgatttgtgacataccacggaggatattatggcctccctcaaaatccaggaatgatctattaagtataacataccaagtaggacagattgcagacctgagccagcataagaattcttatgctcatagagtccagttaatcttgatattatccagacataactcaagttattgcttatgtaaaatcttatgagaacgtagggacaattgttattgttcgtggacctaatttaaatgcaagcaatcattagcacatcaaactcatggtcccctctaaggaataaacccctgtgggctcgtgtttggataagtcagtaggtatattttgagttcaactgtaacacattatttcatacatagatttgttgtcttctgaatatctgaatactaatcggatactaagcaatatggtgatgttatctgatttagagctctgatctcttcccagcctatagaaaatgaagatgtgaaaaaggtcagatgaaggacttcagagtgtacatttctgaatccccaatactcagttaccttgctaactggagagaagggatttaacccacccacctccaactcctgataggaagaattaggatgatggtgcagatggttgagaaaggaggtggggaggagactgaaaggcttaattaattgttatttaaagaaatctggaaatcctacaagtaagcaacgatgccaaatgaaaagtataattaccaaggtacatgttgtaccctccaacagcaacaagatgaaatgtttataccataacaagaacttggaacctacacttttgacaaaaactataatctctcaggctctcaggattgttttttttttttctttgcaaagcttccccaagaagctgtcaacagagagagactacactcgagcatggctatttatatgtttgtgttctgtgaattttcctttcggtgtcttagatagagtcagcagatgcatgcctgatccttgccaacaagtactgcgctgacccggatgcggaggatgcctcgaatatcatgaggtaactcttggggcgctgcggaaggccctgggcttggcagtctgtggctgttcacggcccttttggatcttctgcagaggactatctctatgaggcctttttgccccacaagccactgtacaactcaccagctgcataggcctgggggagccgaggctgtctgtgtgggttggggcagtggcacacagggtgtcaccaaccggaagctcaccctcagcaggtggcagctctagggcttacagctggccttgggtttgagattccttgagacagaactaggaaatagattgagatgggtgctggcctgaattaaagtaccatgttccctaaaggaaatgggcctgagatatcttaactaaaggcagatgcccccaggggacattttgcaatgtctggagatgtttttggttgtcacaactaggggaccgtgctgctggcatctgataggtagagcccagggacactgcgaacgaccctgcaatgcacaggtcagcccccaaaacagagaattgtctggcccagaatgttaatggtgtcgaggctgagaaaacccttactagggctttccaagtgtgtctacggcatattgattcctatcaccccaaaggggaatttagtgaccagttaggctgtttcatccagtttcccaaaattaatgttctttcttgaaaggcttttcagtgcttttaatactaatatgcatctctgagataacgtactatagaacactttccaaacctatttgactataagcctctgctcctctcccacctcccccaacccccccccgttttttttcatagagacagagtctcgcactatcgcccaggctggagtgcagggactcaatcatagctcactataaccttgaactcctgagcccaaacgatcctctcacctcagcctcccaagtagccgaggctataggaatgtgccaccacacatggccaatttttagatttttttttttagtagggacagggtcttgctatgttgcccaggctgatctcaacgaactcctaacctcaagtgatcctcccacctgggcatcccaaaactctggattacaggagtgtgccgctgtggccctgccctgccctgccctgccctcccttttttttttttttttttttttacagaacatctaggggaggtcatactgggaaacactgtgcagtgctttttgtgcacaagggttaggcctgtcaactgctaatattggccccaacaccagcaccttattcttttcttaattcagaaaaaaagcaattgttcagtttttgttccttgcataaacccagtagtcacattgtgtgacaatgaaatgactaaaaagtcaaggtattttgctccaggtagttagaggccctttggaatttgtcttttctgtagcataaattgcagaagagttaagagggctgagaggaaatgataaagggaagcttctggagagttgagctaaattcagtgggatttccgtcccactgcattcccaggaacttttacctaactgtgaacagccatctttcgggccgaaggttccccctctaccggtggcttggtttactgcctcctgggaacttacctgaggttgaaggtcaagaagttacctttacatcctgacaatgtttgcattgcctttgtctttgctttccatcagtggccccaagtgaccggagcttccccatcagtgaggtgggggaattcctccagtgcatttcagaggagccagtcctcccttaagcatctggtccttgtgtctggcaggcaacatctggcaccatcttctcttgccactcagttttctttggcaatatgcttagtgaggtcattttaaggaagtggatgcgtgaactcttctaagctttgggcttgccaggctgcagagagagggtggaacagattctggcttcacacctgggctcattcccgaatcagttacagctgcacagtggctacaccaggatcagggttgggtgtgtcacttgttcctttctttgaagtaggaaggattttcaacttttgacacctttttctgtcattggaaatgatttaaaaaaaaaaatgtaaccctttaaggaacctggcttcactgtcttcaaaattccaaatggaaaaccaaaagaagatgaagcttaatgttttgactccacagagatgtttggggctacctgagtaatagttttgaaatgggtgtttctcttaattgtagtattttatttaaaccctaactgtggtagggttaatatgaagacacataggtactagggtgactggcaggacaaggaggcatagaaattactggtcaagggcggggctcagtggcttacacctgtaatcccagaactttgggaggccaaggtgggcagatcacgaggtcaggagttcaagaccagcctgaccaacatggtgaaaccccgtatctactaaaaatacaaaacttagctgggtgtggtggtgtgtgcctgtaatcccagttactcaggaggttgaggcaggggaatcgcttgaacccaggaggcggaggttgcagtgagccaagatcgcgccactgcactacagcctgggcaacagagccagcgaggctccgtcttaaaaaaaaaaaaaaaaaaaaaaaaaaaaaaaaaaagaaaagaaaaaaagaaattactggtcaaaggtagtatcagaaatgtaattaagtagagccagaactgaggccttggctgcaaaaagaagtgggaagttcagggttaaaaatgggctttgtctttctcttatttgtataatcctccttcctcctcagtttaatgagaccaatctgcctcctttgaaattaaaatgtcaaagatccatttgaaatgagctaatgcagaaaactggctgaagctgtgaactgcaaggcagggctgacagaggctcaaagtccttgagttataagcgtgggccaacgcaacactttttcaaaaataaaatgaaatccttcaagtgcaaaaacgcagggtgaatttgtgctgggagaggctttagcgtgatccatttcctaaattcgtacgttgcagcttttcagataaagctgctccctggctgccttctctccatttctgcactaaaaggggtgaagtggggagcgctgctgggtgggaagtttgtgggggtggtcataataaatgcacttgcatttctgattaggcttaggaggtgggcctttctgtggaattccattctttagccttccttgtcacagaaggaaatgtacaatgtcacttctgacagacttggtaatgacaaaaaccataacttacacgtggagagaacttttaatgatttcaaagcattttcacatctggtctcccatttgctgctcataccaagcctgtgaagtaaataaagcaggtactgttgctcccagtgtccagatgaggaaacaggaacagagagcccagggttttcctaaaggtcgcgcagttcattagtacaatagctgtgactggaacccacgtgtttccattcatctgcgctctgcccctccctttagcaccataattgatgtggggaggacacgtgaggcctggggtgggtgcaggccatgcttaacattgagtttggactgagggcaggtaggagacaattttccaccagatcatgacccccgcaatgccttggcacttatttttaaccagcgtttaagtcatcattttctctattagctatggaaggctgagtccttgatctcatcctaaaagccctgcttagaaatcattttttgtgatagtggccaagcatgtgtcacaattagaaccatttgtcatcctgcttgtttgatttgtcattgttgtctcaagttgttaacttggagaattggactcagcagattgtttctgggctagtccctagggtgtgggagattgcaaacctctggaggccccatgatttgggctcgctttcgatgtctacgtaggcaataagctggcagcccctgctccaggccccctactccccagtacgcacatgcatacatcccatctccaatgcattccaaggggccctcaaatttttcatgcccaggacacagactgtggctgttttgtgattttgttttcacactagcaagagatatggtggtgggaatactgtttaacctggcccagtgtctgcaacccctcaggatagccctggctgctggtcctgatgcaggataggtgagccccaaaatggggcttagcccatgaaggtttttagcttcccccagaaaagaattcaaaggcaagctgatggtagggcagaaggaaacagctttattgaagcagtagtattacagctctgtgactgctcctgcacagcggggctacaccatagagtagcagctctgggcaggctgtcgtatttatacctacttttaattgcatgcagattaaggggcagcttatgcaaaaatttctagggaaggggtagtaacttctgggtcaccgggtcattgccatagaaaggcaagtcccatgagcccagtgcagatagaagcaagttctttgagctttctttctcactgtccacccagacacttaggcaatcatattaaagggtttcctctttcatggccttctttgttcctcatggtggcttccccaaattgtatgtagtgagagatggaactgggactggaattcatccatgcattacaacttgctttcaggaaaggacctggtatgtgcctgtaaagttatgtcactatgaacatattccaagagatagttgatttcataattggacaacgggcttgaaatatgaagcatttcaatcccctatgatctagtaatagtaatgttctagggcctagaggttatagggaacctcctgggtgttgccatggcaatggtaaactgacagggcacactgctgggcttgtccagtgaaaagttgcttctgccccatccctgtttcagctagtcttcaattttgtctggtatctgagccctgcctctggaatcaagtcctgcctcctacctcagtcccatgggtaccccatttggagacagtaaaattgatctttttgtcagacaccatgcataaggcagacctgtctcagcattggttctttctttttcagagtaatctccataaagaactaccatccgaagataagaatcatcactcaaatgctgcagtatcacaacaaggtaggagtgcgagagcccgctccaggtctgaagacccatccacaggtccagcctcttcttcctcattatacaggctcacacacacacacacacacacacacacacacacactctcacatgcccacatgtgcgcaactcaaagacctgggtaaagaggtgtgattgttaaaaatcttcctgggacatttctttctttctttctttttttttgggatggagtcttgctcttgttgcccaggctggagtgcaatggcatgatcttgactccccacaacctccacctcccaagttcaagcaattctcctgcctctgcctcttgagtagctgggattacaggcatgcgccaccatgccaggctgattttgtacttttagtagagatggggtttctgcatgttggtcaggatggtctcgaactcccaacctcaggtgatctgcccgcctcggcctcccaaagtgctgggattacaggcatgagccaccacgcctctggcccatttctttagtccaaacaacgtgtttgcatttggtcactggaaggatgctccttcatgtactgattcattcattcgggaagtgtctattggaacccgaggttcagaactattgatttactcttggatcccatccatacttaagttacaacaacttttatttgtatgtgctgcagtcatttacttattcagtaaatatttattgaatacatactgtgtgattagcactctccctgacacccacaggaatatcagtgaaggagaagccctattttgtgtcctcggggatttagcagttaaggtgtagaatgctccaggcaagtgagtgataggatttctctatctgagaccaggtgaactagtgagtgcataatgcgctctgtaagagtgtaatgtgggacacattcccagagtcgagatgagaatttgcagagttgaatcaggaaaatagtaagctatccagagattaaagagaaaggaattttccttgtgttatagcttacagtgggggattgattagaaagaagacaaaagtcagagtctatgctgtttccctgtgattacttctcagtaaaccagagtccagtgtctcattcaaaggcagtgctccttctctcagccagtcaataaacttccaaaaaaacagctttaggggagggaaggtggcacctttctccatttgatgcagtaccagttatgtccttaatgaaacctagaaaccggaggctgcccagtacctggagccaggtgtcctgtctgtacagaataactcgctgctgggttatgagtaacagcgtaccccctcttatgggccatattccctatgaaataggcagtcaggtgatgcagagaaaaaccccattctgccaaatgcaccagtgccatgccgttatttcttaattgctggcaagtgctggcccattttgctgtgtggaggcccatcagaggctgtcactgagtggagcctgctgtcagtgactggcccaccatccagaacggctgactgctgccagccactgcccagccctcggcaggtggctcccttgcagaacgtgttgttctccagccaacggatttggtggtgggcacccaaggtcacattcgcctgtttgtctctggaaaacccaaggacactgaagagataaagtgaggatattggtaatgtacgggtgtcaagctggagaagtttttgatggcagcccttgtaggtggaggtgaattttattagcaaggctgtgactagtgacagctcctgcagcaacgagctctccttctttcatttgtgatctgaaatttcatttagtgtgggagtgctttaagctgttgtttagatttttggctgaatttagattgaataggaaaattaatgttgtatgtttagaaggggttgtcagttccttttttttctctttccaatgagtgctgatgcagcatcttcaagaaattaaggaggattttagctgtggttattgtccaactcaaagcagctcagccggcctgggatccagacagtccctggtcagtaatcacatgatcatagcaacctgaatgtgtttggcaaacctctgtgttgtaattattcagaaacagtgaggaagatatcaaccaattcatgattatttgcttaaaacacattttgtttagaaccatcccaaactattcgagttttggggttgggcagaatcacttacagatccttggatgattagtcaggacacagggaatagagtgactttgacacagggcattttgttgttgttgttctttcatatctctcttctagagaaagaagaaaacgtccactcatcattgtttgtctttcattccttgtagaattgcaaatggacattcttcaccttgcttcacagttttgctgtgtttcctgagatgtttcctactctttcaatacattttcttcctcttccctttcaacattttttttctgcctttcttggcactttttgctgcactcatcctagatgcttagagatctccatgcattacaatttgctttcaggaaaggacctggtatgtgcctgtaaagtcatgtcactatgaacatattccaagagatagctgatttcataattggacaacgggcttgaaatatgaagcatttcaatcccctatgatccagtaatagtaatattctagggcctagagggatgtagggaagctgcctactttctctccatgtaaaactggccctgagtttgtcatcatcataattgtagacatgtgtgtcatattttatggttttaaaagagctttgacatccattatcttctttagtactcgttggaccatctgtgcattttagcatcccagggtaacttcagagcagggcatctaagctctgtatagacagcgcagctctgctgggcacaaatcatggccaccactctgcagccagcgagcggggagacagaagagcttactgccaccgactctttaaatggagccacagcccattgaaccaaactgtggttcccgagagtaggcattatagaagggctgatgctctccaaagtgtatcttttaatatcactagaattcttggagagaaacgctttcatgctggccatcttttaaatgctggccctgcatcttctgatttgagtgtaaatggctcaaagctcttcaaggaaagattggtttataacttcttggaaaagtatcactcctgatgatttacctctcagtggattttttatttttcccaaagactctagtgaaagaggcctttatctctggaagccaagtcccatgagcccagtgcagatagaggcaagttctttgagctttttttttccactgtccaccctgacacttgggcaattgtattaaatcgtttcctctttcatggccttctttgttcctcatagtggcttcccaaaattgtatgtagtgagagatggaactaggactgaaatccatctctcctggttttccaggacagcgtatttccagttccttctccatgagaggagggaggggtggtgaagtagcagaaatgaagggcagccaggtctgccagacctgctctttatattctccaagttagggagagaggatttgcctccagacttctgggcactaacactggcatttttcatcagactcaatttacttcaaatggaaaaggacgaagtttccagaaacaaaggatttatgttcctgggtcagtctcttctctttgtttcatgcacagagatttccctccaagcattcagcaggtcaccctcactccttccctgcgttggagaaaatataatatccaaaaaaagagggcacagaaccctgagataaggaacaaactcaacttttctatataatcacatggccaagtgtcaaggtggacagtgagaaagaaagctcaaaatatgcctacagaactcaaaccagacagggccatgggggacccaaggatgaaatgcctcagccttataccttagatagcacatgcggataggagagactttctctgaaaggttttgcttgtttgtttgaaggtgccatgaaggttcagagctgtctctttagggcttggaccaaaaaaatctcctttcacacacaatgcttgacttgttcattacttaaactgaatttctcctcattcctctcaggttctcagatgatattactgcaagtgagtatttctccagttataccaatgtgttctctacgatgcccaggaagtaaaagggaaagtggccatctgaagccactggagagtagggagaggaaggaataaagggtagggctagttgttggaattgagtctgcagtgtggggaaggtcctttgatagtttgacagcaattaccacttgctgtggcccctccatgagactatttaaccatgctctcatcagggagggcactgtcatctctccctggagtacccacttttggcttaggatgcacaagattgtcacagaagcggattttgcaagaaggaatttcataagaatagtatttttgaaagcagagtgtggaacccttggacttgctctttgttttcacaatggagtcttccatccttctagttcaactattgtatattgttctgaaagtgaagggaatgctcccttggtgctccttgtgtttgctgagatgtgcagagaaataataacttcaaagccatagaatcttggcactagcagagacttagaagggctctctgattcaacctcctagtgcagagcaaaagttctttccatagtaacttggagaaatacttactgagtcttagggacaaagacctttcattttttaaggtaaccttctccgtttggtagacaaattacatccttaggaagttcatttataaaacaagacaaaaatctgctttcttggaatatataccagtcagtcttaattctggcttctagaacaaagcaggacaaacctaatcttgtacacagcagcacctgaagtattcagatgtaaccatcctgtctctgtgaggacgagagccttcttcaggccaaatattactggctgtcttaactgttcctcaaaagatcttttccagacgctacctcctcttgtctttgtcacttttctctggaagttattcagttgatcattttccctctttaaatctgactgaaaactggatcaagtactctggaactagtctgaccaattcacaacagaatgaaatgttcatttcccttgatctggggagcacttctaaaaagtaaacactggctttctctgtaatgtcacatggctagcctaaaatttgaggttttagttacccacacacttaaatttagctttgtgtgttttgttttcttttatttctctcctgcctgctgccaagctaggtcttctcattttgaatttatatagttgattttttttagcctaaatgctgtacttgacatgaaagccttgtaaatctttttagtttggtcttttgccgatttttccaactctggagaaccttttgaactttgattctttcatccaatgtattttctatgactctctgcttcatgccacttaaaaataattggatgagcatgcctctgggttcttgtctcagggcctgacataagggttgaataggaccagtccatttgcaagagattggaaacgtcgacactgtgatttacctgatgttttaggccagtggttctcaaagtgtggcccctagatcaacagcgtcagcgtcacctccaacttgtgagaaatgccaaattctccagccttaccccagatctactgaatcagaaatgctggtggggggccagcaatctgtgttttcagaaactgtacaggtgattctgatgcccgctcctgatgcctgggagtcactgatctggagtattggaaaggcaggtaaaaaagaaactgaaaatatacaggcatttggcactcctacggtctattagaggactcaacttaatgatttagctagacatcctagtaacccaggctgttgggtctgtcacaagaggaaattccctctgggctctatttggctaaatgacaaacccaggggaggacttgggcttggtgggtgcagaagcaacagtccagagagactgaagtgtgatgagcagaagagttgcataaaacagcaaacatcagaccgcagcaagggaaaagaagggcaagactggatggccctgagtggttgggcaatgctgcatttcccagaagaaatgttaaacaattgaacatttaacagagcaaggtctcatacctgcttttctttccccaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaaggtaacgtctcgtcttattagagcacattagctcgggattccatttgtcgtggggttgagtagagagcacagcttaaactcaaaacagatcgacgggctctaaccacttgggttaaggagaaattccttgttacggatttgggcatgaagccaacttctttcaaaattatgtttttatttttatttggcacatccacggccattaaatgattgttcaaagcacaatcccctctttttttagataaaccacatgtttatctatcaacaaagcctccgctgttaaaacaaaaatatgatttatatacattccatatggcaacagagcgcctaaagaaaagaattatcattttgctcttttatatcaagtggctggtggacctctcactgtgtggataaatgcagaccatgtgtttgtgctgaagcccaaaccccaacagcataattcatttatttatttctgcacaatcaaggaggccagcaggactgacatgccgcggttgtttgaatggagagcgaaacaatgtactgagtcctcggcagcagtgccctttgcaccgagagacaggcggtctggatgtgttcatgtccttgtcagagctggctggacagacactccagagtccccaaggtggccatacctgctgcaccagtgcaggcaaggagagaaaaaaaaccgactctgtcctcccagggtgggccaggttaggattgtgtttccagagccttgcattgatcgcccagccactagcaagggggcttctggagcctgggataacagtcactccagtcctcatccttagactgttcttagattaggcagtcaaggtgacaaacccgtgtgtaaaacgggtctagcttgagcctttctgttatggcatgggaggcagttagctctggatctgggcttacatcttgcctcttactatgtaaggagcagaattaatagctggcaaggtgggaaattacatccttagaaagttcatgagtcagcacgaggtccataaaggaggctggaagctctgcaatcaaaggtatgagacctcctgccttttgctgtcatgtggctacctaattgactgccaagttccttgatggttttgaggaaatggcctaggttgcaataagagggatgggtgggaagcatgaggatacagatgcattggtgctcaccttgggcacctatgagtgatattatttagagcaggagtttttctaagtccttatccttcgtacctgccaaatcggcattatgtagccaactgatagttaacattgctccacataaaggaacaaattgctttggagctccttcaatcactttagcaacactgatagcaagggataccttgatttaaaaaatcctcctatgctcattatgcagccaaaggtctcagctcagcagaactctgagctcagatccagcttacaaataaagatgttgcattcctttaggtatcttctttaatccaggctgctctcatcctgcatgggtggaactgaatggaggtggcagggaggtctgtgtagctgtgtttagagacgagaccctgaagccagatgtagccacgtgtctcccagggatcttatgttcaacatgaaaagcccagactcaggataaaggactgtcaccacgagaacttctctggctctttcaatcaagctctggtggttttcttccagggcatggcccatgggaccaagcacatggtgtgtggagctgtgctctgcttcctcgtgttgatgtaacatgggctttggcagggccccaccacagatggggccccttgacatgcgtatgttttgattttgtggtgcctgcatggtaactagagctgtctgtcaaggaaattaataaaatggatgtgatgctgattcttcagtgctattagcagcagggaaaacctctgcccaaccttcctccagaccctgatgggcctcacctctaaagccaaggatgtccgctccagctcagctaatcccattgccaagttcctatttaggaagagcttgtgggaaaggctgggcctggccctggtgtaactgaaaacacattttcctctgggggttatgttaccacattatttctgtataaggccaattcccgcctgtttggaagtagctctctgaatatgaccttttgacactgagatggtctttgtgttggaattggctaaggtacatgacctggaaatcacaagccttcccctcatatatttttctcagctaaaatagagatgccttattcacatgctccccattctacattgctatctttgtgtacttacctccaaatcccagatcttcgtctcctttaggtcatggtgaacaccataatggcaccctccttggcatgttttatgtattatctcccattccagggatcacaaagccctcacttacttttgttgggggtggggggtaggtggaaaagtaaacctacaaatggattattgtttacagaaattgcttccttctccaatgacctccgtatcctatgacggagaattcatcaatatttccatggggacaagcaggcctattaggatggacaaagaaggggtgaggctttggcagcacttgatcctttgggaacaattagcatttctggaagccaaggtaaagtgttagctcaccctctcccttcccctaggccggtcgtgtctgttttttggtgcggcagaacccctgttaaaataagagaaacaagactgtaacagcaaagatgtggcacaggcagaagcacagtgactatccactgggctttttaattttattttaattttttgtagagaccagtctccctgtgttgtctaggttggtctcaaactcctgggttcaagcaatcctcctgcctcagcctcccaaagtgctgggattatataggtgtgagccacttccactgggcattttatcatgcatgagaccaaaatgccaagactgaaagtgggggtgatatgtttaataaaagaaagagggattactggccaggtgtgttggcccacacctgtaatataagcactttgggaggccaaggcaggtggatcacctgaggtcaggagttcgagaccagcctggccaacatggtgaaatcccttttctactaaaaatacaaaaattagctgggcctggtggcgcatgcctgtagtcccagctactcaagaagctgaagccggggaattgcttgaacccaggaggcggaggtcgcagtgagccaagatcatgccattgcactccagcctgggcaacagagaaagaagaccccgtctccaaaaaagaaagaaaaagaaagagggactactggcatacaggaattacaaaagaggcccagcctggaggtaccaagaaatatggagcaatgcttctttatctctccatcaatgccactctcaaagataccaaccttaggaccctaagtctttgtccctgaaaacctcactcctatgtggatatatctctgaattgatctaaactttttaggaatcttttttatattttatatacccccatatctttgggggtaatgaatttcttaactttgctaactactgctaaatattttttttctggctatttgtccttaatttactccatttaaacttcaaggcatgccctctacagcttctgcagtgctaggatttaacaaatcttatgctaattttatatctaatacctttaggaaagagactcaagctggcaatccagggatcctccagctcagcagctgctgttaaggacaggttaagcattttgtgcaataggatcttatttgaacccttgagttcctttaaggagttcgcacgaacatcctggtgcctgtgacttatctgcattcacatcatcagccagccctggaacatgctgttcatttgccactgtctgatctcctactcctagcctgtcaggttctagtgagactctccctgctgtcttctgtaaagacccaggcaatgaacttacttagcctatctgctattgcctcagccctgaataagtggccacacttactctctacttggcttcctcacttggatgtaatttaagatccattgatttgtttttgtttttgtttttgagtcttactatgcatacttagcttctcttcagcgtatgaggtttcaagttggggcatggcctgccatcttcatgaattgtgctatcattcttactaggattagctgtctttgcacatgacaaattgtgtgtgtgtgtgtgtgtgtgtgtgtgtgtgtgtgtgtgtgtgtgtgtttagagggtgattaactcttaaaattgtttttcaatgtacattgggacttccaatgtagcacatttaaatagttctcagaattgccaactatttgaagtctgttaatctatcattttatacacacacacacacacacacacacacacacacacaaaacctggaacacagtatgctctccatgattatttctttgttgaataaatcagttttgagaatgaagaaaatatgttatgtatttctagtgttgtttttttttccctatgccgcaagatttggaatttgcgggtgaaatgttacttaatatcgataacaatacacgcttctctgtcatgttttctgtttctgaatgagaatgcactagagaaatcagaagcatgctattcagattgtatcttggctgaagtggatatggctggacacacaaagtttttgtcctagcactaaccatagccaagggaatcatttaaatatttttagtctgggttatgtttatgtgtatatgtgtgcttgtacatatgtatgtatagaattagtctggtttagcagctaaaaatgtaaatcaaggacttttaataatagctaaaaaatactgattcccatgtgctaaatcccgtattaagtgctttagctgcaatatcacatttaattctcacaatgaccatacccaaacttgtcactattattatcctccttttacagtggcaggcactatgggttaagagaatttcaacaacctgcatgcggatgtgtgatttggaattcacaaactcaggtgttcaaacccaagcaaactggttccaggtttgcccttgagtatactgaaaggaaatgtgagaaacgataagggaaaactttagctagtgccatcatcttagcacaaatcttagctttctatagttcattctatgtgaactattgatgcaatagagatgccctggggacctaccatgttccagacagtgcgctaatcccatcagcatccttaggtctaggaagctctggtaagcttcagaaagcttctgttctgacttggatgtatgggcacatgtttgcatagctccattctgtgcatcttctttacctttctgtctgcccagctctgcaaaagcagaggccactgcatcataacagttaccctaggctgggctgagtcagggtaaggaatgaactaggctcccaagaagggattgacacacactgctgttttgaggaggtgaaactaattggagtctaaaccaagtggagctgaagggctggggatgacttaggtaggtgcttctgggacaaagtaagtatattagggttctctacagaaacagagcaatggtgtctctgtgtgtgtgtgtgcacacacatgcgtgagagagagagagagagatgttgattataaagaattggcccacagggttatagtggctgggaaatcccaagctctataaactggagacccaggaaagaagatggtatagtctctgtctgagtctgaaaatctgagaaccagcaaagtcaatggtataagtctagatctgaaggcaggaggagactgatgtcccagcttaagactgaccatcaggcagagggaggaaattctcccttactcctcctttttattctattcaggccttcagtgggttagatgaagcccacccacatgggttgggttgagggttgttgggggagcaatctgctttactcactccacaaattcaaatgttaatctcatgcagaaacaccctccaccctcaaagacacacccagaataatgtttagccaaatatctgggtacactgtgacccagtcaagttaacattaatcatcacagcaagcaattcttattgtctggtgggtgtaagctctgctaaccaggttgaaggaggcataccagaagcagaactcaaccttgcgtggcagggttggagttgacaagagctctgaaatggggccagggctgcaactgataaggctgggattgaggtggctctctacttaggaaagaacaactagtggtaccagagtagagagtttgtctggcaaagtaaacccacatggtggaaattagatagggagatgcaagatgttgcttactctattacccatggacaatgtcaccctaaccacagatggcattatgacagcagacttctgcacatattcctcaccagtggagagcagctcccaatacaattatactcacttccttgataatctcaattattctcattgcttttagatacatagatgacttccatatttatatttccatgaagaacctctcccctgaacccggcgtcaccgattcaactgctgctcaacacctacatttgaataccccatctcctctcagacttaccattccacaatcgaattccttttctttgtccacaaacctgttctttgctcattttactattggcaatgccatccttcccatggctgaaactaaaaactctggagtcacccttgactcatttttaaaaatttatttatttgccctcaaacaccacattcaatacagcaggaaatcctcttggttcaagtttcaaaatattcccagaatcggagcacttctcaccacctgcactcctactactagctccaaaccaccatcatgtctctcctagaatattacaccagcctcctaactggtctgtctgctctgcccttaccaccccacctccaatctatcttcaacaaagcatccagaacaaccttctcaagcatgaatcagatcctgtcactcttctgcataagtctctccatggggtcccatctcatctgaataaagtccctacaatggcctgcaggtcctaagcagtcaggtccctggaacctcattggcttaagtcctgagtgttctcctgcttcttatgttagccacactcccttgggctggtctagggatttttacttcttgttccctctggctggatattccttccctgagcagctgcttggctcccctctgtccaactcttgttgtctttgcttaatattaatttctcagttgagtctttcctctaaggcattagaactgcatttttaaaagggattaaaaatgaattttttattgaaatataataaaagtgtgcatgtaataaatgtacaacctgttaaatacttataccctcagtgctcatgtaaccaggacctagattaacaaagagtacattacaaatatcccagaaccccctgtttttttttaaataagtcaggtgatactacatgatcgggtctgtttctggattctcttgggagaattgacatctccacaatactgagttctccaatctatgaatatggtatatttcttataaagggatactttatgattcaacaacttccctggcaaatacaggaaaatcaggaagaaagtaactaagctcatacaagttctctggggcttgtgagggtctctagagagagtagatgtcccacttcatattctctaggaagtatacagctgttcttctcagcttcattgggggatgaagtttccatgtggaaaaaacagaattgcattttaggaatctgcaccccctccccctccacacaccatacatccacatccttatttactctcttggctttgttttttcccgtggcactctttggtgtttattgcctcttttccctgggacaaggtgagcactgtgaagatggggctacttgctgaatcctcagtgcctagaacagcgcctgactcataatagctactcaatacgtgtttgtggagtaaatgaatgcatcggttggcctcagcctagcctgaccagcctgtattacagacagctgggtgggaccaggaccagcggggacttgtaatttggtgtgattttggtgcagaaaacttctttctttgctactgtatatgattcccttgccaaattaaagagctttgattcaatgtagaaacatgaaatgcaaagctctttaatccttgacaaggattgtgcagaggctggttagatttggttataaagctcttcaactgccagaaaatccagtcagtgtgttgtttaagttcacaaatcaaaataaacacccatgaattgaaatgaatttgctaaaccccagtatcctatttgggtcaacgtcactgtgtacccgcttttcaccctacttagatcccattagatcagaggcttccatgcaggatgctgcctcccgcagtgccactcagtctgaccaagcccactaatgcccacctgaaagtagagtaacttctgtgaaaactatttctaataaagagagaagtaatccatgagctattaacagggattcatttcccctatggccctggtaatttctagaacattgaattaaagcgttctcagacctttacaaattctcaaggcaaacattattagcaaaaagaagcccatacagcatgttagaagatagattgccagaaaatgtcaacggatcttctgaataaaataaaagaagttgaaactcctttccccatcttcttcccttctccctccttcccccaacatgattagaaagtcatttcatgtgtcttatatgtttggtgaatcaaaagcaaatgtacatgattgatggtgacagggaacacatttaactcattattctttactttgcagcaaaatgatttgtgtaaactgtctgcctagcattaaaggtaaagcaaacttagaaaccccaaaatgttatattttcatctaatattttcctcttggttttatagctgtaatcacatatggattcttttatatgggtcttggcatggactgaacaaagagaaaggcagcacagaaagattacataacatatacacagagtccggtgcccagcgaggatggggcccgagaagcggcaatggtcaggacttaatgcgaaaatccagtagaagctgacactcaccctggcccttctcggctggcaggatatagtcactgatgtgaaataagagccatcttattgaacaagcctctggccaagcatcagtctgagctctttcagagataattggcctttaattaattgcatgcattcctgagtccacctgggtatccacagactgggtctactctgcctccccactcttccaaatttttgactttggttttttgagtgccatccactgttagtgattgttacatgaaaatcgcaaagtcctatgtaagccataaggaataaaatatcagatttccttaagtctattggttgtcgttgccctaaggtgattttaagtgtgaatctgtgtccagaacaatgatgaggaatttggaactttgaggcaactattctacacatctaggggtgcaaaacaaggaagcaccattgatttgataccgtgggtattctgttaagaactttggaattatagtaatactttacgtttgcacagcacttttcagtttacgtgatataccttttttttttgagacggagatttcgctgtctcacccaggctggagtgcggtggtgcagtctcggctcactgcaacctccgcccacctctcccccagcaacccagccgctgcagcccccaggttcaagtgattctgctgcctcagtctcccaagtagctgggactgcaggcacgagccaccacacccggctaatttttgtatttttagtagagacggggtttcaccatgttgcccaggctggtctcaaactcctgacctcaagtgatgtgcccacctcagcctcccaaagtgctgggattacagcatgagccaccgtgcctggctgagatatacattttcacttaaattctttatttgaccagatacacaaggaaaccagatacatatggaaaacatgccaaatgcaaagaacctaatgtctctgacctttcttcagttgtagaatagtaagccacaggacccatcaccatagctctttgggaggaggaaatcggaagatgacttctggttgcatggctggttggggaatggtagagctagggccagaacgctacaacatcattggcttctcagctcagcgctttccccactgttacacattgcttctccaagagaaatgtcttgaatgtaaacactgctttgttttatattcaaatcaatagcttctaagaatagaaaccactttgcaacatttgtaaaatgagcttatcctaggtttcccctcaaccatgaaaaactataaaaattaagctcttttccaaggtaggagatacatatgtctgccccattcccttggtggtagcttagtctggaaaagacccaggcaagtgctgtcttgtctagaccataatgccttgtagtgggaggatgtattgctcaagccaagggacgcaactgagtacagaagggagatgatgactggtttgttgagggacatgtaagaaagctataaagtttagtctcaaccatttgaaagaaggaagcagtaggttacagtgcagtatgatagacttcccatgtgtgaaatgtgtctgtaaaggggagtgagatccggacgggttaggtagtgctaataagatgaagaaagaaaagtatcttggagaaaaaaatatagttaatcctaatgtttacagacaccttctgatcataacaaaaatattcaagtaactcaagcaattcgagtggaggtgttggggctttggattgataagtcctcaaggttattagcagagtaatccatttgcattataggaaaatgctgaaggtacatgattccagtaagatttggaaatgattatagttttccagaagtgtttttcattttattttttaaattaacatacagtaaagttgattttgtgtatgtgtagtcatgcaaccaccaccacaatcaggatacaggatagtttccatacccccaaattccctcatgctgtacagtcacaccctcctgtcactcctaggccctggcaaccactgatctattctctgtcattacagttttgtcttttcaagtctgtcatgtaaaggcatcatggagcatgtaaccttttgagattggcttttttcatttagcatagttcccttgacatccatccaggttgttgcatgtatcagtattccatcctttctgttgatgaatagtatgacatcttatatgcaggtaccagtttgtttatccattcatccattggacaccatttagttttcctccagttggggcgatcatgaatacagtcgatataaacatttacatggaagtttgtgtggatataagttttaatttctctagggtaagtatctcgaattaggattgctggattatagggtaagtttatatttaactttaaaagaaactgccaaagtgttttccagaaggactgtaccatttatcattcccatcagcaagcaatgcaggagtttctgtagctccgcatccttatcatcacttggcattgtcaatactttttattttaaacagtctagtaggtgggcagtgtggtatctcattgtggttttcacgtgtatttccctactgatgttgaacaccttcccagtggttatttgtcatctgtatatgctttttggtgaagtgctgggtccattttaattgagttgtttctttgaatttgttttttactgtttaagaattctttatatattttggatctcgttggatatacaatttgtaaatatttgcccctaatctgtagcttgtgttttcattttcttaacttaaactttctttcctggaaagaagtttttaagttgaaatatttggagtttttcttaaaaggttaaacattgagttaccatatgactcagaaataccactcctagatatctacccaagataaatgaaactctatgtattagtttcctatggctactgcaataaattactacaaacctagttgctgtaaatatcacaagtttttttccttccttttctggaggccaaaacttggaaactgagtttcagtggagttagagtcaacatggtggcggggctggttccttctgggggctctagaggagaatctgtttccttgcattttctagcttctggaggctgaccacattccttggctcttgtccctgtcatcgcatcactccaacattgtgcttccattgtcacatctcctatttcttcttctttagccaaacctcctctaaaaagacaatagagattacatttagagcccacttagataaccttcctatcacaagatcgttaatcacttctgcaaaaatctacattcatcccacatgcaaaatacattcacctcattcccccatccccaaaagtctcaaccctgcaaaacaattcaagtccaaaatcagagctgaagatcagcaactcacatgtcccaatgtcatcatctaatcagttatgggtgagactttgggtgtgatcaatcctgggacaaaattcttctccatttttggatctgtgaaactagaaaacaagtactctgcaccccaaatgcaatggcaggacagccataggataatggctatagacagtgccattccaaaagggagaatatggaaggatgaaaggaggtaccggaaccaaacaacttcagattccaatatggcaaactccattgagcttcaaggtctaggaacaatcttctgttgcttaaaatgggcattacaaagtttgagtcctccaaatgtattctttttcaaaattgctttggctattctagtgtccttgtctttccatatatactttaaaatcagcttgcctatacctaaaaaaaattcctcctgtgttttgattggaattgtattaaacctatagaccaatttgggggagcactgacatctttactatgtcgtatcttccagtccatcaatttggtctcttcatttatttaggtcatctttaacttgttttacccagtgttttatagttttcagcatcaagattctgtacatgttttgttagatttatatgtaagttttacatttttggagctattataaatgacatcttaaaaaaattgggttccaattgttcattggtggtatgtagaaatatacattatgtttctgtattgaccttgtacctggcaatcatattgtaccggctagcacttcttgcagaatattgaatagagggagtgggagtagacatcttttctttgtcacctgtcttcaagggaaaacattcatttctttcaccattaagtatgatatgaactatagatgttttgtagatacctttcttttgaggttgagggagttccttcccatttctattttggtgagagttttatttttttcaatcatgaatggaggttgaattttgctaaatgctttcctgcatcaatgtataggatcatgtagtttttcttctttagactgttaatatggtaaattacattgaatgattatacaatattgaaccagccaccatacattcctgggagagaccctagttagtgtgattatttcttatacatgttggtggatttggtttgttaatatttttatgaagaatttgtgtgtgtttgttttttggtgtatattagtttgtacgtttcttagactgtctttgattttagtgtcaggtaatgttggctttataaaatgagttggaaatctttcccttccttctgttttctgggagaaattgtgtagaattggtgatttttttttctttaaatatttagtagtatttggcagtgaaatactactaggtttgggcctagatttttttcttttctgaaagtttttaaatacaaattcaatgtcttcaatggttataggactattcaggttaaatagttaatcttgggtgagttgtgacaattcaaagtttttgaaaaattggtctaatttatctgagtttttcaatttatgtatgtagagttattcatagtatcccattattgtccttttaatgtgggcagtgataaccactctttcattcttgattttgttatttgtgtcttctctcttatttgtcactcttactagatataaagtttgctgatctttgttaaataatcggctttggttttattatttcctgtattttttgtttgtttgtttcctttctgcttgctttagatttactttgctcctcttctctagtttcttcttaagatgaagcttagattttggatttgagactcttcttttttggtgtaaacattttgtgctatatatttcttcctggtccctgctttagctgcattccacaaattttgatatgttgtgttttcatttttgttcagttaacaatattttctaatttcacatgaaacttctttgatccatgaattatttagaagtgtgttgcctaatttccaagtatttgaagatattcctcttatctttctattattgatttgtagtctgattccattatggttaagaacctacttggcatgatttcaattcttttaaatttgttaaggtgcattttatggcccagaatgtaatctgtcttggtgaatgttccaggtgagcttaaaaagaatgtatattctgctattgttgggcagagtgttctataaatgtcaattattactagtcggctaatggtgttgttcatttcttctatacccttgctgatttcctgtctgctagttctgcatcttactacgagaaggatgctgaagtctccaattataactgtggatttgtctactttagttccgtcaggttttgctttgtgtgtgtttgaaagtctgttaagtgcatatactttagattgttacgttttcttggtgaattgacctttttatcattatatattatccctatatccttgtaattttctttgttctgaagtctactttatctgatattaatatagccactcaagctttcttttttgattggtgttttcatggaaaaaagtatatcttttctcctcttttttgtttgaaccaaacctatctttaaaacttaagtgatcttcttatagacagtttatagtcgggtgattttttaaaaatcgattctttgaatctctctttcttaattggttgcattagacaatttatctataatattattatttatatgtttggatttaggcctaatattttatttgctttctgtttgtttcctgtttcagttttgaaaattagactaatttttcaaaaactttgaactctcttctttcttcttttgaatcattttgaacattttcagaattttttttggtctgtggtatttcttatacttctttatatagtttttaaaaaattgattgctcatgggtttgtaatgtacatacttaactttttaagtctacttggattccatgatttgcctctttaagtgaaatgtagaacccttaccaaactataggtttctttaccctccccattttatgttatagttgtattatgtattacagctgttgcaaactatatcagacaatgttataatttttgcttttatctattttaaagaattcaagagaagtatagtctattatattattctaatatttattaatgttgttgttttctctttgtttccttccttttagtatcattcctgttctgtttgtccaacttatgttagcagttccttcagagccatgctctggcaacaaacactgttttctgtcatctgaaaatatctttatttcactttcattacttagggacattttggtggatatagaattcagggttcaacattttaaaagtgttgttctactttcttcttgcctccattgtttctgatgagaaatccatagtcatttgaattgtggttacctataagtaatgagtcatttttctccgattgccttctagattttctctttgtctttagttttctgttgtttgcttacaatgtgtctaggcattattcttttgggtttatcctgttggagttcattgagattcttcaactgctaggtttgtctctggggaagttaaagaagttttcacttattgtttcctcaaaaaaatttttttttcctgcaccatattatttctgctttccttctaggattcctatgatgcaaatgctaaatctttttctgatgtatcagaggaccctgaggctctgtgtgaaacttttcaatacttttttctctctgttgttcaaattgcacaatttatattgacctagcttcaagttcattgactcttccctccatcatctttgctctgctgttgagcccattcagtgaatgttttagttattgtattttttaattgtagtatttccatttgatttttaaaattttgatttttaaattatgcatcccgtcttttacttctttacaaatgtgttctttcttagttatcgggaaatagtagttgctttaaggtttttgtcagattattccaacatctgtgtcatctaggcattggcatctgctgattgtctttttccatgcaagttgagattttcctggttactcttatggcaagtaattttttattgtgtcttggatattttaatttttttattatgaaactctgattcttgtttaaattttgtaagaatgttgataattttattttggaaggtaatgacctgctttattttattttactttattattattattgttattattattattatttgagatggagtctcactctgtcacccaagctggagtgcagtggtgcaatctcagctcactacaacttctgccttctgggttcaagcaattttcctgcctcagcctcccaagtagctgggattacaggtgcccaccaccacgcctggctaatttttgtatttttagtagaaacagggttttgccatgttggccaggctggtcttgaactcttggcttcaggtgatccactcgccttggcttcccaaatactggaattacagacacgaggcactgcgcccggcctgatcggcttgattttaggctacaggttcttatggggcttctatgggttgtgacttcaatgttagttgagttttcaaagcgttggcagtgctatttggatctgtccaatattgccctcagactgggtggtggtctatattgtagtttagttcttagaatctaaatgtgctgtgtagggtcagtttcatccatgcacagcttagcgtgagccccagagtttataaacaatttagtgactacttccccatgtcctctttctatgtgatctctgcaatattttcaggttccctggggtcttcctttttgatcttttgatggaagggctgctgaggctttagttatctggctttctgtatactttctgtgattgtgttcacatctggggccaactggtagaagggcagagagagacaaaaagcaatagggtttggttttcattctctcaggaccataggttttttgggcagagaggaaaattctcctatctcctttaatctttttctggcttgcattgtcaccactgctactgccactactagatggcttggtgttggggcacaggaggagagaaaaagaaaggaagaaaggaaagaagaaagagaggaaggaagagagggaggaaggaatggatggagggagggagggagggaaaaacagtgatttcctccattttttctaagagttacctcgcattagttagttctactatgaggcttctcctggaggttttttgtccacatcttgatgatcccttccaggttctggctgcctcgaggtcaggctagaggataccagaagagaacaatggtaaattcactgctgatttggtggtatttctaattcgggtcttcttcaatctacctgccattgtttattctcaatgtcttcaaatagctgctccatgcattctgtccaggtcttagaacatcattcagtgggaaagacaggatgaactgtgataactccatcttacccagaaccagtaactcagatatctctttagccgccatatgctatgtttgccctgtacagccagaatggggagaatattgcctttaagtcagggtcatcagcatcatggctttttagcatattcaataatcattctctgtggggcaagtttcaggtagttcacctattttttttttaatcagagcctatgaatactataattcagcaaactgcattacagtggcatcctgtgcgtctcctggtagaacaatgtgaggtggccgtttcaacttcaaactcatttggctgatttagagaaacttaggggcacctgtaacatgacactgagatcaatttaggcagccatctgccatcttgaagaatggcatgcaataaaacgtttgaactgagtgtaatttttgtggtttttatcattaactgccacatgtatttcatggtaacgagtgatgcagtcccagtgattagggtttcatgttcggagaaatacaggggtcctgtcttgatggctgtactctgtatacactggaggatgggaagtggatgtaactaattaatatctatgaataagagtcatcacttcctctcttttttccataccctgtaagtagatagggtatctctgcccactgagaagtaacatatatctctgtgcccactgatgctggtgtgcagaagctctttgttgtcagtctggctgtggaagtctgtttattcctggcccccatacctgtggcattgctttttagggtgatggattctatcctttctcctttttctagactgggacaaataggtatagtttcttaagaagcttctgttgatttcttgttttggctaaaatttggcaatgagaaggacatttctatctgtggttgagtattttttttctctttctccttaaataggctagagaggcaagaacaactgaaagaggaatatttgattccccttcagaatgggattgggtattccagtctaactaggattcaattttgatcatctgaagatctcagatagtatttccctgctataagtacccatggaccactatattatccaaaattgctaccacagccctcacccttcctgttatccctggtttgtgaagtgtgaggggggttgtgcggctgtgcagtgggcagcaggatgggacagggcaaggattataagactctgattaggacgcgatttgctgtaagacctggggaaggctactgaacctctcttagctccctatttacctgctgtaaaaaaaatggaagagcttatggtatttttgaaagattatccgtatatgaaagcacctacccctcagtctataaattctctccttcaactttcttaagagatggaggtaggtgctgtttggctttctatttgtgatgagatttgagactgggtcagaactggatcactgatgggagaagatagaggaataatcctgatataaaaccaccctctaaggtggcataaaggcatccctacctacagtgcttacaattttgtgttgccaacacttttgtaaatgactgatgtcggggaaggtccctggagctctttgtggtgagatacggagtcagcagaattttctgactgaatacattttttagggcagcagcattgttcatcaacctaaatgacactggttttcccaaccccttcagcgtctctggcaattcaccctccactccctaaggctagatgattttgtctgcatggataggtgagaactaggtgcatctgtctggtttttcccagtcctctgcaacagtgaagatttgctgactattctttcccatatgttaatgaaaacccatccagcaagtgcagctttgcccagggagagctctgcactggtgttgactgcaaggagaacagctgtgtgctgcaatgagttacctcagtggatagacatgtattattgacttgaacttgctcatgggacaggtgagcatggggacagggaggggtctctttgcccaaacaggatcatagcaagtcctctccctctttccatcttataccaactgcagggtgatggcctgcctgtcagttttctggggatgctgaactacaatgagtggtaaaacattctagaaatgcaacaagaaatagaaaagtgtgcttcccagaactcttctcaggaggcagaaagtttgagattactttgaatactttaataaggtatttgggggaatactttgatacggtttttcggctaggagggatgagtctcctcctcccaaatggcatgttcaagtaatgacagatattttataacttgctttctaaaaagcatgggtctgcttgactgcaaaacttttcttttgctgagtatgcaaaattgggctcaagattgaattactagggtcagtagctgaagactctgaccagggatcattcctctctctatcaccccatctactgctctgtctgtcctccaaatacaagctggacaagtatttttaaaaagaatattttgaataagtaccctttttttttttttgcacactcatcctgtggaccaaggatatgctaggtatccattcaaaatcagtcgtggaggcaaggctggaagtgagtagcaaagccatttgataggaaggagaacgacaggtacgaatagtgtgtggggagtactaactgagagatgtgggcaagtgtcattctggtcatcagggtcctgtttgcccagggctcctttcagaaagccaggctgggtgatcctgcatcatgttaatggtgctacccacacatgatccattttctattttgggagaccatcatgtcccctcaaaatatcaacttctcccttatcatcatatctacccagagttaacttactggccgttaggaaagtccatgggtggcagagaggacctccagagaatattgctgtcttttggggacaaactcaggctgcttaatgtttctcttcaattcagagaaccactgtatgatcactgatgttccagccttttctagcagcagctaagcaataggaagccatgaatcacaggccccacatctaattggcatagttcctttgtctgagcagtagagctatcttgtctatcatcagcatcatcagcatcatcactatcactatcactcattacttataatgacagctgacatgtatagactgtctacaaggtacaaactcaataaatgccatctcttagtatggttagaacacatgctcatctgttgcatagaaagtactccacaaatgttagctatttgccaggcaccctgctaagcactttacatgcaccacctcatttcagctgcctccctaggaggtaggtactagtgttgctctcattttgcaggtgaagggaattaaggcttggagaggttatgctccttggctcaggagcacatgataaggctgggattttttgaagccagaggctgcgtgaacttaggcacttccctgctgtactcagtgagcactcaggatcatggtttcctcctcaaaggaaaactgctaagcccagctaaatacctcagcaatttataggctgcccactttcaatctctgaaccaaatgtctttttgatgaggcctaacatccactctgagaaactgcagaggggaatttctgaaatcgcttctaacttcctgtgaaaatattctctaactgacaagagattgtccagataacaatgaatacacaataaagctggcgcttctgcctttgctaccaggctcacaaataacccatttggcttcccaatcactctgatacctaaaactagcagaatttatgcttgcggctggaatggctctgttcagccagaaagctaaagtttacgactgaaccctttgctctgaaatgaaatctagtctctttggcgcgactttattaggccatattgtatggcgataggagacataagtacccagaatctgctgtcactaaaacaggactgggttggcgagcgttttcgtcctcacactcaatactgtgtcctaaaatgggaaagttgaatagaaattagggatgcaaatcagggccattttctgaaactttatttttaattgaattcaatatagtcatgatattgcttctgtatctacacaacccacattccaatggagattcagctattactggggtcactgaatcaatggagagagactaagtagataaatctggacccctgaaatattgtttaggctaattatcacaacagcccaaacacttggatacccatcttgtgcttaattgtctaaaagctttctctgtaactggctccaatatctagcaatacttcatggaaagcattctttttcatctctggttcaaatcctttaggctgtaatcgattcttctgaatctcttgtcctcaaggcatcatggagaatacttgccccttattcttcaccgtctttgggaacagctccttgctactcaaaatgtgggccctataggggaagcatcagtgtcatctgcgagcttgttagaaatgcagactcatagacttgaccccacctcaggactaaggcatgagaaactggattttgccaagacacttgggtgacatacgtgcatatcaaagtatagatagcactggactccatatttcaaaggacttttactaagtaagccctcagacacatccactggtgagaccttgtcatttgctaacagcagtggctggtgggattctcaccaaactgtctaaaatagtaaagatccttcaaaggcacaggcaactctctagttttttgtgttatcaaaagcaagctccccattcctatgtggattcaaatgttctttctaactcccttcctcttctcccagttttttttttgtttttttgtttttttattttttttttttagaaaagatcaagttgttttggcctcaattttagaatttaggaataatgaacttgccaaatatcaccttccctgggctcagtctacttcctgttgaattgttgtttgactttactttggaatccaaaaaatgaagacaaggagaagacaaggagggctgagtcacatggggaagatagaataggcatgagatggggagggacggggcttcctctcccagaggaatgcaggcaggacttctagctagtaggaataactccagttagattggtggcaatatatcagttcttgagagttttgtctttcaaattcaagcctccaagttatcggatttagaatttagaaaaccgtaagtcagttgctaagaagcccaagatgttctgtaatgaaaaatttcccagaaaatattgctcatagtaagaagttttttgggaagtgtaaaaatgacccagttatacatactccctggtagatcctaacagtgcagaaattttttccatgctcagaagcagaattgatttatttcatgccccaacactaaacgctatgaagttattgaagttattcatgcttacttatgatcagatgcctagaaaaattgttcttgtttctttaggcctctctctccagttttatcttgcttagttcaactcagcagatattaacccagcacctcttatttgcaaagtactgtgctgctccttctagaagatacagagctgagtaagacagctcttcctttaaggagcttacagtcgatacggaaatggaattccacctcattgtagttctcttcagatgtcagagaagtcaaatgctgtgatggtacttaatgctaatcaccacacatggagcacttactaagtaccaggtactgttctagacattctgtactgatcatctcattcagcccacatggcctcctgagagatgtgtgcagttactattcccattaaggcagggacagcacagcacattggtgaaatgaggaaaggcctcagagaggaggtagtttatgacttgaaagttacaggaagcactggattttgacaactgaaaaaggtcatagagagacatatttgtgatagaagcgtcaagggaaacagagatttcagggtgggaagtcaggagaggaagtttttagattagcatttcccatcttcttaagctgctccttgaaataaaggattctgtgactaaatatcacgttctggccgggcgcggtggctcacgtctgtaatctcagcactttgggaggccgaggcgggtggatctccaggtcaggagatcgagaccatcttggctaacacagtgaaaccccatctctactaaaaatacaaaaacaaaattaaccgggcgtggtggcaggcgcttgtagtcccagctagtcaggaggctgaggtgggagaatggcatgaacccgcgagggggagcttgcagtgagccaagattgcaccactgcactccagcctgggtgacagagcgagactccatctcaaaaaaacaaaaaagtcatgttctcctcttggagatttacaattcctcttaacatgttaaatactctaaggagtattgtgctgaaagtaaaataataaaattaaataaaacaagttggctttgttaaattctgtgcttcccaagtttatttcattcattcagaaactattattgagctatgactatgtaccacgcacagttccaggcagtggagattcaggtaaaaatctgtgccttcaacatttcccacattctagtaggggccaccacagaatcccctccccattctcctttgtttcagataacacctgctattaagttttgtcaagttctttctgtgaagtattagttgagaacaattctgcttttctgaagcaggggaaattatgggaagtcagatttttaagacagagtggtgccatgttgtggaccagcacaattccaagtgtggtccatggtccatagatggggactgtgagctgtttgatactcatccgtgacgagttaagtacagaagatgagagtaagtgcttagaaactttcaaagcaattggatggattaattttatatggattgtgaatctatgataaaaattttggatttgtaccttgcattggatttgtcttttcatttttttgtaattcttatttatttatttatttatttattgtctcatcatgttgtccagacaggtctagtactcctgggctcaaacgatcctcctgccttggcctctcaaattgctgggattacaggcgtgagccagtgcctggcctgtaattcatttttattagattttgcaaaagaatggatattagaaataaaagctaaaccctggtccctcacctcagatggggtaagaagggctgtcctgaaaaccctgcatacgaagctgaactattctggggttggtttggcagacgtctgactgaaaacatttacttcctgctcaatttacccaaataagaattattttcagtggtatttttaagaatccttattatttgaaggacatgtaaatatgttctttactattagcaaggttgcaaaaccaaattcctctctgaacagagagtgaataggccaatctttaaaaaaggctcttaagtgtaaacaccttttctatattggagagaaaattgaggatagggtggcaaaaccttctatgtgttaaaaaaaaaaaaaaaaagaccagtttcctgccacatatgtaacactttaaaaaataatttctcaattattattttaaaaagttctcatatcactcttgctgtttacccttcctttaccttcagttcctctggcactctgtctttccagaaataaacctggttgggataatggagtgagggaaaataccatgtattctggtacttttacatgtggtgtagtcttttaatcgccctctgaacacctcgtgtgggttgattctttttcataatgcctgatggaagaaatctcatttgatagtctgcagcccactggtctgggagtaagagatttggctcaagtccattccgaaattaatatttggagttgtttatttatttgttcatggctgaagcaaccagttttctggcattccatcaaatccccccaaaattgttttaattgacattgtcctgaagcctttggaaaaatctgagatctttttgtcctagtcacacattctggaaaatgctctctgaaagaggccataattgtggaatgccaaattgttatggagtccctgaaatccaagcaactttcagaaaggcagctgaactgagtccacatccaagaagttcagcgctgagatgcagtttggcacagagaagaaatacattctgaaaaggtgcaaatcactattctcttctgctttcttcctttggcttcaacttgatcactagttaactccaccccagaaagctgtgcagtgaggcattctctgtgctggcaccatttggacctcagctaacaagactcaaacatttcattttgtttattctatgaattgcttttaggatttgcaattatactgaagaacgaagaggctaagaaggggtagagaaggagataaccacatgccctttgataaaaactggggcaagtttgttgacattggaacatagagggaaatagaggaggagagaatctgacaagtcccatgatgaagtcttcttaataccttgctggccttaacatcgtacttttcagcaagaaatgagaaaacgcaagattcaattaaacttttccccttgacagagcatgctgttgaggaatggatacaaatgaccccccatccattttagtaaccagcccaaacattcatcaacttagagcccatcaattctgatttcatgtttagtattgtaggcaaggacttgacacattttgtggggttttcttggggggtgtggggtcatgataaatacgttttaatggcatctaagatatgccagtcagttcatatgactgcattctgtttcagacaatcttattataaaggacagtgacaatgtattgcataattgatatatataaatattcattcaaatgtctctaattcttattaagcacttctaagatttaaaactgtggatcctttataggaagaatatttactgaaaattcagatagactttttaaaaatagtaaatgtagtaagttcttgtgaatacactaaccttctactacctgttttgggcagtgttagtgtgtatatgttacgactcatctcttcttattgcagctattaacataatggtcattggtttttataatttccttttagtgctttatttttgatgtgcataatataatgtatatttggattaaaagaatttgcctgttttcaattaaataaggactagtatatgacaatctttggaattatttacatgacttcacgggtagaggtggacttttgcaagattatttggctgtaatcaacacagttattcagactttttactgggaacagaaatcatgatggctgtaacatactcccagccaggagagttgaatttttcacattcactgggctgttagcattagagaaacacagtttcactctaatcagaggaagcataaaaaataaaaggcatcattaccaacccaccattagtgacacacacagaacctgggatcaggaaggtgtgacttcccgtggagccaaggctgaggtttccagttggaaggtacatttgatgggggagctgtctgcccgtggattggtgtgaaaccatttgcttgggaggttcaactagactggatgaaaaattagataatgaagagtagataaataagacagtaaatgagaggtgtaggcaagctagttcattggctcagtcccctgttctcactgatgatcccgtgtgtatttgatgaataaggacccacagagcatcatctgctcatctttgctaggcgctcttctaaaacagctggggtttgatgtgacagccaaaggataaattgctgcctcaggaaatgctctgcctttgactgattgctgaatggctggcaaattaattctggcacctttccctaagtcattttggtcccattccttcatttttttctgctgagaagtgtgtcttcacattacagttaaaaatacattgacaacacaaatgtggggaacagcatgtactattttaggaaagaagttgtaggctaggaagtttccattttgtataatagaaaccatacttttatgctctgagaggaggcttgaaccgccctttcagctagagccaaaatggattattactccttgctagacgtctcgtaaagtcataggctacagagtttgggcttttgagtccttgatgggcttcggttttgatatttccctctttggtacttgtacacagcaaatcctccccattccccgaaatcctaacaccacaacctccctacacctctatctttgtggtgggtggttaagagtgtgaactctgaatcctgtttgtaccacggattcactttgtgactgtcagcaggtttcttaacctctctgtgcctcagttttatcatctataaaaggggaattcataatgacaataactccctttacctggtccagatttctttgttcactttcattttcttagtattaaacacaaggttttatttatttattttagagacaggatctctctctgttgcccatgctggagtgcagtggcgcagtcatagctcactgcagccttgaactcctgtgctcaagctatcctcctgcctcagcctcctgagtagctggcactacaggggtgtgctaccacacttggcaaattttttaattttttgtagagacagggtcttgctgtgttgcccaggctggtctcaaatatctagcctcaaacttcctgcctcagcttccaaagtgctgggatacaggtgtggctaaggatttaaattcaatgtattttacactgttttttttttctgtcctaagaatgcattgtatgagaaatgtacacttttgtttttgcttttccaaagtaagtcaaagataccacactcgagacttagaaaagttaccttgatagaaggtgataatttcagcccttgggtaggtataaagactgaagttctgttgctgagtttgtgatgcactatgatgtaatgactctgggttctcactcctgacttgtctgatgtgattggcctattcgtgtccttgttctggcatgacttaaggattaaatggtctcagtattaattataattactgattctcctgctcttatgttatacataagggttttaaaaatctttttaattgtgataaaatacacatacaaaatttactatcttaatcatttttaagcatgtagttcagtggaacattcacatgactgtgtgaccatcactaccatccacttccggaactctttttatcttgcaaaacggacactgtctcagttaaacgatgactcctcattccctctccctgcaacccctggcagccaccttcctactttctgtttctatgcatttgaggactctaggtacctcatataagtggaatcataacacggttgtccttttttgattgggttatttcaattagcgtaatgccttcaagggtcatccatgttgtagcatgtgtcagagttttcttcttttttaagactgaataatattccattgtaaattaccacactttgtttatctagtcatctgtccatggacacttggggtgcttccacctcttagatattatgactaatgctgctgtgagcatgagtgtacaaatatctctttgagatccttcttccagttcctttggatatatgcctagaagtggaattatgaatccaatggtaattctatgtttaattttttgaggaaccaccatactgttttccacagtggctgtgccactttacattcccaccaactacatacattgcttgagaatatgacagtgtaattcaattagcaattttagactctttttaaagtgaaattcctttaccagaaacctcaaaaacatattgactatccatatggaaatagtgttaaagatgtggaaatcttaaacagatggcaatggcaacggatttaaatgctccagcatttattcagttgattcgatgctactaggtctagtgtgtagagactatccgcaggtctacacaaggatgtggaagaggcattttgttttctagaacattctgtacttttttccagttatacgactttcagtcctcaagcattttgattagccacagaggcaaacttgcaggaaaaaagatatggaaaaatcagtaaaagtcagatatatgtggtcaggtatatcatagtcagatacatctggtgctttctctagcaaagagaaaaatatggggaagtaaataccagttttgatttaatcagaagctagaacagatcctaagattaaaaatatatgcagtcaatatttgctgaatgaatgactcaataaaacaatttttgctaaattcaaaacaaacatgaataatattgttatcctacaaaaaatgtgttccttcttatttaaaaagtttagtgattcacctacaataaaatttggtataaagaatagcttcattaggacataaaggcatgaaaattctgaccaaaactaaaagaaccttgttaaaaccatattaattgaggaataccaccaatgatcaataataaaggtttgtattttcattatttttgataatcagttgttgtatttaaattagaccataaacaacacattataaaagaacacatatgaaaagaataggctgaattattttacttcaggaatactatttgcccataaggctctagtatggggatttgtaattagtgatacctcatatagtatcctattcattaataaaacaaattatgttaatactgtttcccaaatattctatattccaacatttttttactaaggcagattaggctttcttcaaattagttagagttagtgacctttgcttataagtcaagcatatcttttattcgaaaaaaattattgagatcttatggtttggagaaattaaaaagttcaggcttagctaaacacattgcagttaatttttaaaatcataccatttagcaatagaattggttgagtgacttttttttttaaagaccccactctggggaaggccaatttgtagataaactgctcatacccagcagcactgcctagctaatgtctaacctgtgggagtaggctggaagcagctcaaactaatgaggttaacctacataatctaattgcccagactgagctaaaagcagacaaagagcacagagccagggagccttcagtttatttctaaattttttctggcttttgtatgctggagtgtcaccaagtagatggtaggtgtgcccttgcccactgttcctagctctccttctggtccacatgttgcatttctcccagtgaactgactgactggctgccagcaagatgccttttaatacaagataagcacaagccgttctaaagagccacttcctgttggcggggtggcttcctctcatcttcctcttacccatgcccccactggaagggaagcctgagaggctgcagccaaagacacacagcttgccctccttccctcagggaggcctgtgagatccctaagctcccatagcggctcaacgttctccttgtaattcaccagtttctaaagactgactccattgtaagccggtagcagtggctcatgcctgtattttgggagcattttgggaggccgaggcaggcagatcacttgaggtcaggagtttgagatcagtctggccaacatggtgaaaccctgtctctaccaaaaatacaagaattagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaaaaaaaaagaattagccaggcatggtggtgcacacctgcaattccagctactcaggaggctgaggcaatagaatctcttgaacccagggggcagagattgcagtgagctgagatcccaccactgtactccagcctgggtgacagagcaagactgtctcaaaaaaacaaaaaagaagattcactacattgtgaaatcctttcagagatgcctagcatgaagagggttgctgggaaaaccagctaaacttgactacttagaaaaaatgcatattttaatgaaatttggagcaagacctctctgaaactacattttacttttgtgatactccttttgaaatttggagcaagacatctctgaaactaacattttaccttttgtgatattccttggggggtcagaaaaatctgtcattttgtgcaaagtagaaatatactgtttcattataatatatacatgcttattataaaagccttcagacaatacaggaatctatagaggaaaaaaagtatcattctaccactcagaggtaacaactgttagtgttttgatataaagcttcctaaattctttttatggctttacaaacattcagataactataggccatctaaaaaaataggatcagattatgtacactattttataatgtgcctttttacagaatttctgtatgaacaggtatacattttcattataatttttaattgcttcttagtattccattgtatgtgtgccatttacggttatttcccatttttcatgaatagaaaggatgttcttgtatatttttttacctctgttttcctgtttctttgctatgaatacttcaaatggaattgtagtgtaaaagactgtgtacttttacaaattttgataataattgcaaaattgctcttcaaaacagttgtatcaatttccttgcccactaatgtgggtgagtgcccatgtctccgcaccattagaagtcatacagattaaagactgtgcacggtggctcacacctgtaatcccaggactttgagaggcagcagcaggaggatcacttgaggccgggagttcaagacaagcctgggcaacatagcaagactctgtctcttaaaaaaaaaaaaattgccaggtgtggtgatgcacacctatagtcccagctactccagaggctgaggcaggaggattgcttcagtgcaggtgtccaaggcttcagtgagctatgacccactgcactccagcccaggcaacagtaagaccctgtctcaaaaaaaaaaaaaaaaaaaaaaagaaaaagaaaaaagaaaaaggaaagaaatcacacaggttaaaaaagtgttttagagggcacacactttatgagtttagggttattgaaggctttatatgggtgcagaggccgtgttcctgattgctgaaaaggtcaccattatctaaccagtgcattcatttgtttgcctaagagtgtaactcaggtttcccttttacagcccaccgtcatattttaaactctccgcatgtgttcctttcctttagattgaggaagacacatggcagaaatactacttggaaggagtctcaaatgaaatgtacacagaatatctctccagtgccttcgtgggtctgtccttccctactgtttgtgagtaagtgacctttaactggatgctctttggctttcagggatattgaatgtgccccttgcaaggaagcctcccacctctgctgggtacagttggagcacttgacaattgccgagggtatcccgtgtgctcggccccatgtgatgaataggagggtgggtcattacatggcctctgcctggggaatttccactggccccacttttcttgacaggcctgagagtcttggacttgaattcatcatttatgctaacttatgaactacagttatcctgcatgccttctgtgatgtagacacatttatgaagagtggcataaacccctgcctgtctgattctaagagggcaaaacaaatcttgccagcccctcaatgaaaggaattttaatctgtcttcccatcaagtctgatcatagagacaacagagaagctactgaaataaagccattcaaagtgttttcaccctttgctgaggaaatgtggaaccaaatatacagaaggaggccttgagcccccacatagacaactgccatgttataataataacaagtcttagcttctctttccactggctcagcaggatggatcaaagccacccgccatggccactgcaggtagaatagatggtcacctatgggggatgacctcaagagctccaggtgtctgccgtgaggcatgacagtgcctcagattcctcacttagaatcctcatgtttgcaatcccaccacttttagaagctgaggtgagaggatcacttgaggctaggcattcaagactagcctgggcaacacagtgagactttatctctacaaaaaataaggaaaattagccgagtgtggtggcacacacgtatggtcctagctactctagaggctggggtagaaggattgcttgagcccaggaggttgaggctgcccaggaggttgattacgcaactgcattccagcctggatagcagtgattgtatctctaaaataataataataaaaaatctcagatgttgagtttaagatgaacggggtctttgtgccctctgaaaacacaaactccctgaggttggtgaaacattaagcctattctcctgacaccttagcaaaggatttgacaaggattcttctcactgggaagaaacaggggtatctgggagctcactgggctgaggaagaaaagccatttgcttgcacttcctgcctacatacaaaccaaaagagaggtctgaagacatcgaaacaaaactgatcaggctttaccacaaaggaggggacagtcctgggtgcccttggcctcctctgtatcacggttttctttctgtatgcaggagggagggaggcggagcgcttggtggcttcgtgtttacctggagcctcctgtcactgaacacagcaggtgcactctgtcagtccctgggcccagaccctaagcaatccaaaatggtttggctgtttactgaaatttctcaccctgtctctaagcgaaagttttaatgctaaatggactggaaaagtgaataggtaattgattcggaaggagttattttctgaaaatggatgccctattgtgactcccatgtgtgcctttctttgagagctatttctcttcctgccactgagaggagttaagcattcagaggcattgggtcctggaacactgaggctgtcccaggggatctccccctccctggagcttggtctgcctaggatacaaagccccgggggaaagcaggctttttaacagaagctagttttataaaaaggcaattgaagccttggctgtctaatgtggtggtggtctgagcacatagcagagctgccagcgcctgcgggagtcttatgttggtgagggtgtcagcaggggctccgtcaagcccccttccttggctgtagggtttccctggcctaactggtgtttgtatctaacaagagtgctccctccccaacccccaggcccttcttgcttttccacccttctcttactctgctcttgggaactgagtccgttcctcttatgggtaacttgaagggtcaggactgctccccctacaggctctaactgggatagtcactaggtatgtttgactcacgtagatatcaactagttgctgatatttccaaatagtagtatgtcacgtaaaaactagatttctggattctttagaaaatctaatgtgacaatgcaagacctgcatttcctcagaatgctaactggctccagtttgatgtagcaaaggggttagtatagtcatgtagttactcctccctgatatcttaaaccaggccagatttgcacataaatcccaggcctggccctgtggttgtgtgagtttgccaaccctgacccactgggtggtgtggaacttcactggccttcagccagctcaagagctggcactagtggctctgtgaatattccctttgattgatttttgtatttagaacatgtcccaagaaggagacaaattgttgtcagataatttagtatttgctcagtaaagtttctggaatatatatatattccacttctgatgtgagtgagaatgtgtacaacttagtgctattattcgtttaatacaatgatacagcagaggtagaaatgatcaataaaagaaggacatttaatgagatttaggaacatcccaaaacattgaagctctcctcaagcatttgattatctggaggcttaattatctgtgttttctactttaaattaaagaaaagccataactcaaagttaccagcagtttaatgataacactcttcaattcaggttaattaaagcacagccgtaattagagtgtagtgttgtatatcactgggctggcacataagtattttcattacagtaagaattggctattcaatttcaaaatgacataaaggatgccaaaatatattttaagctggttcacgaagaagaaaaagaattggggaatattctgggtatcataaagcacagataaaatatacagattttcagagcagtttctgtaattatgcgctgcgctaaaacaatatgcagccaataacatcttaaagcatggaaagaaataaatgtgctttttctctaggctggcaaaatgctcccttgcagggtgggattgggagagcttggagttttctcagaagctaggggagtcattctatgaaaagatatgggagcaggatgtaggggtgaaatttgagattgtttcccaagagaacaggaaggagagcaaaagaggcagtgggggcagaaggtcctgccaccccgaaagctatctctatcaatttcaagccaagagattctcagtgtagccttcagtctgtggccaaaggcccaagagcccctggcaaatcactggtgtaagtccaagagtccaaaagctgaggaacttggagtgtgatgttcaagggcaggaagcatccagcgcaggagaaagatgaaggctggaagacttcacaagtctagtccttccactttcttctgcctgcattatcctagccatgctggccgctgattagattgtgcccatccagagtgagggtggatctacttctcccagtccacagactcaaatgttaatctcctttggtaacaccctcacagatacacccaggaacaatactttgtatccttcagtccaatcaagttgacactcaatattaaccatcacagatgcttactccaatctccttctctgaaataggagtgctatgacttatctgtcagtacgggttaatgtcttttcccctctccctcctctccttttccttctacctttatctttctcattgaatataatagaagcacttagaaagaaagaaacacattgcgagctatatgtgtatccaagttatatttacttttaacctttaggaaattctcttatcggttaatcaccgattaatcagatatttaatgaattgggatatgtgcaccattgtgccaagcttggtgccacttctagaggaaactgctactagatttgatcaaatatatgtgcatgaaaagattaatagcaatacttacaaatgccaacaaatgccaagtaaaatattcagtttccctagggtggctgcctccagagtttactgtctggctaagggaaatagtacccatcgtcagagagatctagacacccactgataagtgctgtggtagatgcacacagctggaatagagatgctgagagttatagggacatctccctgtaggctggggggacatgggggttcttcctggaagagatgacatttgagctgtgtcttgtcgggagttttgattcagatgggggataaagaaggaagaggacattctaagtggtagggaatctggaggctgcgccacctggtaccatagggagctctctcaacacctaggtctccgagattttccagttacagcaaattgctttcctctttagatgagacaaagagatgcatcagatttattttgacttgtgatttttttgggggaaactgataacagtgtttttggtgagcacttgcgaaagcgagggtgcactcccctacccccagggagggcagaggggaggggaggggctggacaaggaggagctgcaggaaaccatgggttcagcagttgggctgcctcaagaacactgtgttctaggttctgaatctcaccgggaacctattagtcagtcattcatcatttgcaaaatataaaagcttaattgtatcaggttttacagctcagaggggattaggacaaaagatgtatttaaaatatggtatgtgtctctctctgtccctctgcagctgatggagcagttaaaattcaggtttgatgtggagtatttaatgcctggggaacttggggaactccaatcagatcttcctcagctgtgctgaagggcaggagttctgtccccaagcccaggggcaagtatggatgctactgtgctggtttaagagtgcagggggattctcttttccctcctctacctccctgcattcagtgctcccctcctaaattcagaaaatcatgctctcaacctgtgttattttgcacagacagatctttaaaaagaagccgcttggggaaatttaaaatttaagaccgcccggcgaaagctgggcctcttgcccagtgaaaactgtagctagtttaacttcagttctgtgaaatcattagtttttggagaaagacatccaaatttgaacatggagcagaaaccaggcagacccaattgttatatgatagatttctttagcctggctgcaaaaatgagcattttaagtgaatttatggagaggctcagatctctctctttttttttttttttttttgagatggagtctcactctgtagcccaagctcgagtgcagtggtgtgatcttagctcacggcaaccttgtcctctggggctcaagagattctcctgcctcagcctcccaagtagctgggactagagacgtgtgccaccacaaccggttaatttttttgtatttttagtagatacggggtttcaccatgttgccctgggtggtcttgaactcctgagctcaggcgatccacccaccttggcctcccaaagtgctgggattacaggcgtgagccaccgcacctggcagatctcattttttaaaaaatattttcccctcacagaactggctctattcatccacttgattggggagtattgtaattagggttgaacatatatgaatagagatgtgaatacagtattggtggttatttctactacagagacccaagaggtgaccttctatgagctagtgaataaaccgttgaccctaaagtctattgaaatcctcaataacaggctactgaggcagtggtgggtccagaattctctacagaagggtcagggaaggagtcctgttggaaatggggtggacgcttgggctttgactcaacactgggttcttgtagcaaacacatggttttttctttcatattatgtttctcattaataataatagcaaggctctctaaaaatgcagttgttcacactttaggcaaaagttaattgtctgtatcaagtaatgtatttataaattctagtgtcttaggtgtgctagtggagattgtgtgtgtgtgagtgtgtttgtgtgtgtgtgtgaaagagagagagagaaggagagaataagagagtgggagagagggtggggatattctgaaaccttcccactccactcctatcaaagcttcatagagaaaaagagtcttaacatttccatgaacattttaaatcacttctcttttcttggtgctgagtcttggaaatccggatgtttcaaagtttctttacctggatatttcgatttctagcggctgtcattttaaattaaagctcctgaatgtgaatcttttccattccagcccctcgatccagaagaccttgtttcccaatgtgcagtgtttgtatccgtatctacttcaattgcatgtgccaacctgacattcccaggggccctctggatagctgaagaggggctggtgctttgggtggggttgggttcagggggaatgatgacagttgcttctttcatcctccctcacctgacttgtggggtgagtcctcttcaacagccccaaacctcctctttgtattttcttcctgaaggtgcaaactctatgacaggtttccatgtttaattaacaccagcaagtaatgtttccagtaaagggggctgatttaatggcaggaacaatgtatttccctctgggtaggcagaaacagttggactctaattcttaagagcctttgttcaggaacatctgggttgaaactactgtagttaacagatgatgttggcagtaaaaaaaaaaaaggggggttgggctttgtataatgtcgttgtcaaatttggtagacctttacctaataattatcaagaaagcaatctaacttgttattataacagttttattgcagattgctggcttaagacctttttgtgacaagtggcattttttttcttgaaaaaagaagtcatttctattcccctgtaattatttttgcaaccagcaacaacttcctgcgttggacatactggggcattttattttagaaaccaataattaaattattgctagcttatggctgattttatcccatttatcacattgtgaaggctttcttacttccttttttccccttacctcacctcaccctgcttcctgatttcacaccaattctgtatatgttgaaacactgtaagttgagtaaaggcagaattagaataaggattagatggctaatgctcattcttctttaccaaaaaatggtgttgagtgatgcaagtaaatgtttaaccagagaacatcagttctgggtatactgaaagtatatatattcttgggagtgtaaggggtacataagggtataagagggtctctagaaggtcccaaggacaaattgttgtatcttagaattggacttgcatcttggcattgtggattgaaggcaaaaattagattcccagagcatatcactacttttatttccttctgtatccttcctttcccatctgtctgcttctaacaaataagacaagctaagaagcagcttgtttcatgattctatactcacttccaagctttctctgcatagactttcctagtttgccactttatcttttctccatccctccagccagtcatgagattctactccccattcatacatgcatttatttatccagactttactgaaggcttactctttgaactttgcaaaatgccagtgaggcaaagcatgcatcctgtacaggaaaaactcagtctagaggggagagataagcaaacaagtgattaccacaccagctcccctgttcattcaccttgctctgctcttccccaatggacacctccaacagaggctgcatctctgcaacaggatgcagtccttaagcccaggattgtgacattggccaactctctgtggcaggatctaacagaaacgtgtgatttgaacactcacagagggagccatagctcttgcttccagtgtaaatcatggtgtattatacttgatttgtattttgcaatatctagaggatacctattatagtagggattaaaaacttagatacctatagggttcaggcagttagcaagaaagaatgaagagtgaggccatctgagacaatagagagtggtgggaactgtggcacattggagaacaaacatcccatccagagggataagtgcttcacagctgcactcccttttagcatgtggaatgtggtgccaatgtggccctatctgattttgcaaggaaagctgaaaagccagtttctatgtgaattcacttgttggcatctatttacagttttttaaaaaacactgtacttaccaaacagaatgtgtctgcctgttgggcttgtgactgccacttcatttcctctcttctgatgagaagcatctgtgcagcacattgcgtcaaagactcgatttccacttttggctttttacataaaagtcaattgaccttgacctagttgctctcctctgtttgggctcagtttgttatctgcataggaagggcaagatcagccaatcttgaagggcttgagtctgaaaatctgtgttgtggcacggcttgcctatgttctctctgttcacatcattctatccctctcctttcctttggccagtgggccacagcttgttttgggtcaaaggactttttaaaaggggcttctataaggcattgtagaatcagcttgggtatggatttgaatgttttgaagttatggatttaaaactggaagaggactcagatctgcgggtccatcccctataaggttaaggaatgaatacaaggccacatagaccttaggactttcttgtagaggaaactcttttctttttatatccagttggtagatggtactgtagtagctaggaagacataattcaccattactacgaactgttacttcccttcttaccagcgggattaggtttataaaagcaatgaagatctttgatcccatgaactaccagagtcccaaagtggactggtcattgctcataggatattagcaaattaacctttgcacgatccatactaagtttaagatcagccttctccctgatgtttttgtatttagctactatttacattagaaagtggttacttaatttggtaatttggttcaataaacattgcataagctatcttattttttaaaaaaacaatttaagctccagaagtaacagtcccataaagggtgcatgttagcagtgctctttgggacataaattaaggatggcattttccagctgtagttggatatgtgtgttggtgtttcagcaagctgcataatcagcacaaagcccaggtcattagattctgctggcaggaatcagaaaacctgcaaatcaccaggagatcccagatatgcctggatagaagtggtcctttgacatctgactgtctgctgaaggcagtgctgtggaccacaacctcacatgtaggaatgagcaattggtttcactccctggagagcatgaggccttcagcagcactttccttgaaagcaacacatccccctatccagcacatctgattatgtcacttttctcttttaaaccaactaaaatcccccaattccacttataataagctgtagactccttgctctggaaagcaaagacctcatgatcttgctcccccctcatttcctgacctaatcactgtcacgcttgactttgctcactcagctgcagtcttactgaatttattgctgatcctcaaacactcagagctcttccctgcctcagggcctctgtgcttgctgtttctacttcctagaaagctctttccccatatcttctcatcatgctgttgtgctccctgcatcctcagaatggtcctcctgaaccatcacagatgatataccccttctgagttactctttatattcttaggttgttttattttcaacatagaacttgtcatcatctaggaatttattgtttattcacttgtatattttcttattgtctgtctctcccaatacaaaataggcttcactggagatcaagatgtagggtatcctgccaggtattagctagagaccttaggcatgttacatggactttctgatccttggtttcatcacgtgtaaaatggagctatcaatagaagtctgaataattggggtaatagcttcctcttagggatattgaggggattaaattgacccacaaggaagccttccccacactgtgacccagtatcttatcccccttacaatgctggagctaaataaataagcatcaactcattgttcagtctatcagttaatcaatattctattattcaaaatggtaatgctaattgtagacacttgtcatacatcatgtatgtaattattttgtttatgtgagcttttattctgtaagtatgtaagtgtataggttcatctaactgtattgtgccatttacatattcatgtatttttatatatttgttctatttacatgttcatgtctttttatatgatattatttattgatcttatatcttgaaatattctttgaaaagccatttagaatgctagtaccatattgcactgtactttatggccttattattggacatttaggttgttttctatttttctactccatataaataacacttactctgaaaatctttaagcataaacattttactgcaccttttgttattttcttagacttgaaacccagtaagtggaaaccatttgtttgtttagcttctctgtatcggtgggtctattcactatgcactatggagaattccaaacaagtccaggactcttaaggaagttgctctggttaaggagacaaagttcagacacatgaaacaatagggagcgaccacagccagtgtaaaattgactaaaggctcagtgatttggttacagacaaggtgctgggagagttttgagaatagaaaatcacagggtagcagtagctggagaagacccactgcttgcaagattagagttgacgtggcctgtgaggatgggttgggaagagagaagaagggatcgagagtggggaacgcacaagggaagggatggaaacaggaacaagccagcctcaaagcagtctgctctgcagtcgagagcaccaagcagatgaggtgagacagcttggatggagccaggagtgacaatgccatcgtcatgtgctgggcacttacacagaggccaagtattattaccatcattgcaagcacacaggggtctgctcggaacaacaatatgagccatttgtacaaaagaccgaaacggaatccaaataacaggtccagctggtccaaatctttccctccccctgtagttaacattttactacccgaccgagtaactaatgaatctggcccagagtaaatccccaggcacaaattcctgcttgggctctgtgtctagacagccagacctgagtgcaatttgcactttgagcatccagcaccttatcacttgcaagaaatcaggtttaatagggaagatggggaggtgttgcttccaccccctccctttggcacagtgccggtggaatgaggatcccctcggtaatgactgcattaggagaccgaaagatcgtaatagtgtgtgttatgtggctctggtcattcagaagaactgattgggaggcttctccatctcattgcaggctgtgttttgtgaagctcaagctcctaatgatagccattgagtacaagtctgccaaccgagagagccggtaagtttgcggtgacccagcagccagctgacacttttgatggtgagagtgcgttctgagaacggtcggttcacttctgctttcttgtgcattatttatctgcatggaaccagatgtaaaacctctctgaccctagagcacatttcgaggcatgccccatcagacactgcagcttctatgccagaccagcctggcacccaaagccctgctgggcattcagagagtgtttctccagggaagagggatgagtcctcaaaatatctccacctgatcatgccgacctggacttttcaccttctaagtattaaaccagaacttaaaacccctttttactgctgtgagcaaaaaagcaggtggactctggcctcctttacagcagccttggggtagagctgtgaggggagacaccaactctcttgatagccaaattacaagcagcctattgtgtaccatatgtgcttctcccggtgcaaccaaaatccaggtggcagaatatcagcttcatgtaaatgagccaggagagtggagctcagaggcaggagctctctttatttatttattttacacttaattatgtgcaaatcagactgatgagggactgggtctggttgaaatagataacatcccagtcaatatgtgagttcacactggaggtgggaagcatcgtgctaacaagaaattttgctgatggagtactgtacaccttacagataaaatagagatgatttttttgctccccagttcttgtcaatagttttggaagaaagagagctcattgagaaatgctcaagcttttgttctctgaaatgacacccacagtctattcctctatagttcatatttttgatcctgcagatgcccaaatgtagagtgcagatcccctccaacaaacaccttaataactgagcagagtacaggggaagactagacgtttccttttatcatcatttaaggagttttccttatctgggtgaataacccaatacagccagactttcaagtgtatagtctgtgtctatgacaagacaaaacaaaagaaaagaaaacactggattgtaaacagatcaatccaatgttttctgttaccttaactaccagatcagattgctcacaaagtcaatctgatcaaatgttaagctattttgaaaacccaaatcaaccaaaaggaagaaaaaaatggtagatttggtggccatatgtagaacatggctgtagcagttaacaaatatgtagatagataaatattttctttttcatgttggcaaagtgaagaatattgtttgcaaaaactgacagtcctgattattagttgttcagcagatgaggtggaattttctggggttactgtttacccatgtttttgccaatactcacttgtacctgtgtaggggaactgtatgtatcctggatttttgcaaatgatattccccgtgttgcgaaatcgcaaatctttgtgtaactcagtgttctctatttacttttgtgcatctttcaaaaaaaaatgtcatgatgtgggtgatgctgatgctgcatagtgtttttcgaccattctggaataatctgactgcaggagattgcaccctgaaccttgagcagttgtctttcacttgttgccttttggttccaaggagagaaaaagagcgaaaggctgttaatggttcattgtgaactcaatgtcactattctaagaaaactaactcagagcactccctgaagatgaaacttttcttggataggcccttcaattgagtcacaattctgagatgttttcaacaaagccatatttgtagatatagtttttagtatatatatatatatatatattttttttttcttcagaaaagggcaaaaaggacttgtttggctttgtttgggctttctttgtgcagttgccagctttaattctcaaatgtggcttggtctcagtgtggaagcacattggttcttgtggaaaaaggtgtgtttgagggaatgtggatcatgcctctgagaaaacacaggacttatcaaacacaatatccacgtgaaaacacacattttttaaaatcttccctgagataataattttaatgtttttctttatttaaacatgtcccacttctttccctctcacattttctaactgactgggtgtgaaaattcaaaggacctgtttctccttcccaccttctttaacctgtgtttaactgcctttgttgttggtttcaccccatgatactgttttcatgctttgccaaaaaaccttgttttcacatgcatccttcaagtgatttgaaacaaaggttttattccttctttccttctggtgtcagtcgatttattatcaaattgtttgattttaaattcttttcttgtcgttttgcagaagccgaaagcggtatgcactcttcgttaacttttcttccaacctccaccctctatcttcactcctaaccacaggactaaccatttgccaagaattcaagaagagagagattatatatatgtatatataatctcattcccttgtctggtgtatctatattatatatgtgtgtgtgtatatatatatatatatatatatatatatatatatatatacacacacacccctctccaactagagtacataaattggaagtagcctatttctgttcctgtttgatttgttggttcttttggatgacgcactaacttctttgcaggaaacctaagaaaggaaaggcacactcctgttttcagtcatggcaccaataatgggaacaaatactattaaagttgaacaggaggatgcttctctccagccctttgtgtctgtttctgtattgtcctgacgtgtcttgatgtccattgcactctagtgccattttgtctacataccacttccacattcccagtgacctcctcctccctgtgtcgagtttcttgtctatagagcagaattcctgtccttttatccacaaaacagagaccaagcccttacacttctatttttccttacatttattttggtgataacattttgaatattttatttcttgggcagtgctcagtatagtcttagaacactgctattaaattgccagattatcacacttgatttacagagttagtactgtttattgagacagactcatggcttttttttcctagtgtgtttgggcatatttcttaatatgaagtttctcaattttcaccatgtgatttcaccctgttttgctgctgttttacattgcatgaagcatgactaaatcatcatcaatggcatttaaaaaaaaacttttgggttaatagttccaggatagcttttcaataatgtgttatctaagacaatattgttgaaaacatactgttgagatgcctacttgttcatcttttcaagttacttttctctgtgattgtaatcactgtcatgtgtttgtgtttgtaattgtgtgtgtgtgtgtgtctgtgcgtgtgtatttgtctgtatctttttccaaaatctgattcttctgttgtttttttgagtacatgtgtataaatagaggtggcttcctgtcagtttggtattattgatatgatccaactgcaagaagttactgcaacactttgcatcttaaaggtccacagtggttgcacctctgctgttggcttttggcctttgagtccttttatcttgtggtgaaggcatgttgtgatgtaggcatgacttgtcctaagtataccagaaaatgatttggcttgctcccagaaccaaatatccagcattatcctttctagatcacctctctgttccccatcccatatggctaatatttttttgtatgtacgaaatatatttgaaaatgccatttctaaagttactgagatggatgcaggctgagtaagtcctcaccagtatctctggtggaccacagtggcagtcatttgagtctgaccaactgggagcaatctttatcatgctgtctgtgtgtaagtgaactgggcttaagtatattgacatatgaaatacacaactgtgtctccaatggtatcctaaagtaaaagtgtgtgtgtctagttgtgtgggactccagcagcagcatgtatttgaaagcccagaaaaaatgaaaagttccagaaaggtgataagatttgagatgtggggtttctctgaactgtgcctgcacatagcctgtaaactacaaatgcagtcatactctctgagaggggacacggattggttcaaacaaagttccaactgagagtcattgtatatgaacttgtgtgatcaaagaagcctcttctcaatggcatgattcatctgggcatagcatgaatggaaaccctaaatggttcttatttgcttgctttagttaatgaagtcccattagcttgctagacacaaatataattactacgttatcaagcacaaagtatgttctcatataagtcatgctattttttaaaaattgcctgaggaatggtacattacacctaccaaaaatgaaagggagaggagagaaatatatatgtatcatatttacccataatggatagaagtttccttaaacaatatctgtttcacttgaattacgaatcataggttgtcttcagaaacaggaaacaagtaaagtttacaatgattgaagacaaaactagatgtcccccagttatgcacaagtggtggagaaaggaatgcattactttcctccatcaagctgcagtcttccaacctgaccagtgtttagcgagagatacccaatgaaatgtgatacaacttgagacgcggtgctcctctcatggagggacctgatagaggcatttccctgcgggactgagccccgctagccaattgcacgtagatgtgttttatgtctaggaacccatatttctctttgaagttttgctttcaatgttgaaatcaattgccccaactttgcaagtggcaggctgtttacatattgggatatttacatattcatacttaacacatctgagagattgctagatcattggccaatcccctagccctagcagaggtgtggtcactcctttaatcggcctgactgatgagaattgtagcttgttctttgaaagaaaactgtgacctcctttccacttatttgtgaaaaaaaggaaaacttatggaactgaggctttaaaaacttattttttttattcattcaacaaatagttgaaatgtgcctgttgcgtgcaaggctctaagcctgctactccaggaaactcaaaggtaaatagaatgtgatcatgttttgtacccctctactcaactgtgggttccttacagaaaatacgtatttgctccatgtaggaggtgagtaaacaaagaataagtcgagacttaaaactagtctgagagcaaaagaaacagagacagcaagggaccacaccagccccgtgcttccagctgtcactggatgttttctgttgaaaccagtaaggtcaaagaagaaaggataatttatatgttccttgaaatgagggaaagtccacctctgccaacatgtccttgttggaattctgttaatggatatatgggctttttctcttagagattttcctgattcttcacatgacacatgttgaagtttatctctgataaactagtgaattatataaagttggagctagagaactgattcagagtggcgcacagagagagagacttttggcagtcagtagaacaaaacaaacttaacattggatactctcctaaagagatcagagatccttggaaaaatttatgtgttcctattagaaggtcaataacgaattctaaagatagtaggcaaaagggggagaaggttatcactatccagaatccttgtctttttatattttgaagaagacggggattagcattttatttaaactttctagatttggaatgtgtatagaagacttaatgtcgaaaatattaaaaacaaaaacaaaaaccagtaatgtagtttctggtgcttcagcgccaagagcatctttatgtatctagatttctttctttcattatttcaaggactggatccattctttagattcccacccagaaggctgccttagccttagcttagtatctgcaaatggttctgccttacacctcacatggggatgatttaaaccccctcacccctgttcacagggaataagagggcatcctggaatccacatgatctgtgaggtaattagagatgctttcgattccttacacaatcagccatagatttaaggaacacaggatacttcactgtgcagacaaaagtcagtctaaattagcccatcaccagatattgtgcagggataaaatgctttggatttccttgcagtcagtggaaaagtctttcaatgccaatagggcacctcctgggtcatttattagcagcagggacaaagtggagggtgatggtgctgtgaggatttttttacctctcagttttataatcacctagctcactgagagtagcaactaagaatttaagaccttctatgtgtcagtcatgtagcacatagtacatactttaactctcttagaggcattgtaagctagcgattattcacccattttacagatgagaagtgtgaggcttacctgcatttgcaaagccaggacccattttacagatgagaagtgtgaggcttacctgcatttgcaaagccagtgcatggaattttttgtgtatgtccttatacattattctgtagcgtacagttctttaccctataatttcatctcattaatgggcaaggtattttgataagaagactgtattatattccatggggtcagctagagaaaatctgtgataactttgttgaaaatgaaatacactttggatttttttttgcaagaattaaaaaaaggaacaataacccacatgcattgagccttctatacatcatctctcttaattctctaaagattattgttaccattatccacctcttgtaggtaagaaagttgagttctagggatatttagtaactggcccaaagtcaaacagctattaagtggtagtgttggaatttggacccaaattctgattgcagagccagggcatgtaaaaactgccttgcaggaaaggaggttaaaaaaatgtgcaaaatttataatcctgcctttctaaaacatcatactgaattggctttgaaagataaattcatctaaactgtatgagctctaacacttcaccctcgtgattgcatgaagtcagagggcttgttatacccatgtgaagagttggcggaggggtcattaggaggtgcttatggagagccgctgctcagtgcaggccgtgctattagtgtggactgctgctgtctgatttgggaggaatctcactgctgcctgtggttgtagggcagaacagttaaatcttcatagccttttggtattattgagtgttaataatagtcatgacacaagtacagtttcctcctgtcaggtattgttataagtaatggtagatgttcttgtgaccacaaaaaattattttgcaataatgatctgctcggaggtctcccaaccaggtgaacaaaggttcacctgggtccttcctgtatgactacagacgtatcacttcatgaccacaacacttctctggaatggtttatcagtaggaaaaaagattatgtgttaattaccatcctctatattttgattgtttggggcagctgagaacttcctttagactgattccaaatatctattaccttattaagcaacatcttttcagaacaaggaatacctctgttgtatctgttgttttattcagaatccctgaattcagtatccattaagcctgaagtcttttctcagtctctgcatcagacaatcttgtattctgcttttgatctgcagaaaattaaacttgtttgtttcatccatttattagattaggatacatttatctcttctgtcagtccaaacacaacttggtccgctaatctatttatgccactttgaaataggacaatgtatatttaggttcccacttctctgcagggcaagtttttttaaggggaggtttgcatttgttttctcaatttgcctcaattaggacatgctagacacacatcttattcaaacaccctgtacgtttttataaacagcagactggaattgttaagtatatccaactgctgacttaaaaaaaaaaactgtttgggtaaatccaattcttcctataaaggctgtacatggaatcaatttccatgtccttatcaatgtcatgaagacgttcagcttgcttccgcattggttacgggtgtcttgtaccattccctgcggtaatatgtggtgtgtgtacatgatgtttatgtatatctataggggtcccattaatgctctgtcatttaatggaaaattgttgtagcaatagcttcatcaggccaataatgcttccgtgttgaccaccaatagcagtttcaaaaggaatttattctgatggactttgcttcaaatcatgtgcccatgatggcagctagactgctccattatataaacccaggccctaataccttgatttgctttgatttcctcaactgggagcatgccagcctgggaagtaagcagtagtgcttaatgatggcattatccaactaaatgtatggggcagtggacattggactctggacaaaatctttggggaaagctttagactagtgggccccctataaacacaacagtatggtgtagccttcaaggttttattcagaacatgacctcacaaatgtatcttctctgtttgtttttgttcactgagcagtatattaattaatcctggaaaccatcttaagatccaagaaggtactttaggatttttcatcgcaagtgatgccaaagaagttaaaaggtaagagtttattttcaactggctttctttctggcccggctgtagacaccttgacccacggaagtaggcaggcttccataaccccaaaactccttaacatgtctatggccatcaactggtgtaagaaaaacttccacggactccagttcatgtagtgaattccacatctttgaatgagaataataaaattttagaactaggaagcctagttacctgctcatttattttgtgagggagaaaatgggggctcagagagctgaatgactgctcgaggtcatcctgattcctgatgattcagaacaacataacaagacaactggctccttatctagtgctctttacttaatattatctgggaaatttacttgagaattatcagttttctactactctccctgccaaatagaatttcaaaaggttgggattaatttcagatggaatatgaaactggctctatttctatttgtggcctcctaggtaagtggctgaagttgtcagcttcaattgttaagccactgtaagtgcagcacaggatttcactggcctacatgtttcatgacatttttattcgtatccttaaacctgtttaagcagcctaggaattcacagggccctttgcagcacaacatggaatattattgtatttgattctatcttatgaacttggagaaatttactagcagaaaatgtgatgcaaatgttcagacaggtcattcagctcaacagtaatattgcataaaatattttaagtacattattaattgtgaaggtctatcattagttatataagcctattgtcttcattgaatgagttcctagtcaaagccaggcctgttctaggtgtgctacattctttattgctgctcttcaaaataaccctggaaggtaagtcttctcaaacactcagagctttggtttcctcatctgtaaaatcgagataagtgatttgtccaaggccatgaggcacataagtaagtggtggagcccagagtggaactggtctttccttttctaaaatccactctctttctaccaaatttaataatactaccacattcttacagaggagggtttattacaccccagcactattctaggtactaggttctctgtatctaaaacttgttaaactctcacgcaaccccatgagataggtagcattactctttcccactttacatatgaggaaactgaggcacaacttggctaactaacttgcccaaagccatactgctagtgaggaataaagccaggaagttggagcttgcactcttaattatttgcctaggttaagcctgatacgctgagcacagaacgatgacatgtgaccgtggatacttagggtcctcttcctccccatccactctagcaaactaagccatactggctacagaagcttttgggaaaaagaaaacatgggctgttggaaggaaaaagaattcttaaactgagtgctctaataacttaaatttatttctgcaaattggggaaagattgccatgattgagttgtgggggaaaaatacctccctactcagttcacagaatctcccggttgttcaagagtatcctgagaactgggtacacctgagaagggaaattaggattaatgggactgaaccttccctctccctgtgctccaatcaggtctcctggagaagaagcttgtgcccttgtccagactgtgagacacaaaagcttgaaacagcatctcagcaccaagtacaggaggctggggagcacaggagaaccatatatcacgtatacctcccagatagcaaatataacatgaaactcccatttgtgtaattctatttcctattgcatctctcactaatgaatgtcacaaatatcaggccgtccaaaaaacaaattacctcctatattagggagtgcaatatgtctcatttcagtgctttatggtattcacaaatacatgctgacacaatcagctacaacaccaggctgtaattttccatggcatgtgatgtgtcaaagcaaatgctgtcagttaggggatctcaaatagatgaagactgcaaaaaaccacagaaaggacattggagatttgaatgaaactaaacaagctttgtaaaaatggaaaagtagattatgatgatctcgtatcgagtttgcaccctccactgcaaaaaagcaacaaaagaagttaatgaattctagcttgtagaaaccttcagatgcagtgttttagtaaatgaggagtgaaaccatcccactgcagtcttaagaaggtcacttgaggatgggcatttgggtacttgctctttcctccttgccaccaaatattttccttttaaaataacgttggaacatagactttaatataggagtcacaaaacggtggctcagtgactcagtttggcttgcacatatgatccttttgagtcacaattttaaaatacaaatgagttgccaaggtgaaaaaagttacgagcttttatataaaaatccttattactcatttctcctgaaaaattggcagacccaacaataccgggaagcagtctcaaactcactcattcattcgcccatcaaatgtgtataagtcgtttacatttagaaggctctatacaaggcaccagggaaacagtggtgaaaaatgaacaatggggagaagtcccaactctcgtggggctcatattctaggcaggaaagaattacagttttttaaaaaataattagtggtaaaagaattaatgcaactgggtcactgatttgggttgggtataagtgaaagcttctcagaggggttggtatttgagcagagattgagatgaagggaaataatccatcaggcagggatcagataggaagaagagatgggctgggaagaagttcattgtggatagggaccccaagaaggaaagtgcggctagggaatagatttggggagagtggtatgagatgaggttagagagaggcagaggctggctcctaaagcactttatagaaaggttggatctgttataaaatggaagtcattgatggctttaagctgatctgatgtatattttgaaaaggtcattcttcctgcattgtagagaatgagaggaatggggcaggagaagaggtgagagactcagcgcctattgcatagtttaggtgagagatgatggcagcttggactgacccctgagtggaggtggagagaggtgggttcccattcagactgtatttgggagagtgtgcagaaccccccaatgaattgggcagaagtgaggaaaaaagaggaatgaaggatgaaggctagagtcagggcttagattgtgttgatcttaaccaagatgagggatactagagaaggagcaagttttgggtagtaggaagttaagcattctatctgggctatgttaggtaggagatgtgtactaaacatacacacagtgatatcataaggcggttggatcttagagtctggagttctggggataagtgtgaattggagatgaatatgtaaatgtgggtgctgtttcttgtcctggcaagaaacagatgacaaacttaaatgggaaaaaggaggagagttttatgaagagactgtaaagttatgggcaaatagtaaaggaaaaccaacaagggatggccaagcactgcagagctagcaagaaaggggaagccaccttcaccctagatctgtggggtcaaggggaaggagggctatcaggagctggagagagaggctgtcgtgtgccatttcatagacctgtacaggagggcacccggggggtcaaggtggtgacctcatcccccctcaccctagtctcctgctgactccttccactggacacgcaggccaggaaaccagaggacaaggagaccatacaggccagccttgcaggacacaaagctggtctgatgatgggtgaagcaagatcaccagctgaaggctgcttgtgggaggggtacggtgagctggagcaagtggagaggagaggagagagagctgttttggagtgtgagaaagcaagcaacaggagaatggggtagatcccaaagagtggaaaaggcccctgaaatccatggttgtgggtttaaagtgaggtcagcatgttttctttcccagcgaaactccgttgctcaggtgcaggtgtgcagtaagggaggggctttgcgaggtgagcatgacagaggcaaagatgggtggggaagagaatgattcttgcaaagaaatgccacttggcagaggtcagctgagcttagatactctgcctgctccagatcaccatggacacccccgacccttgcctcatttcacttattaaccttaattgcctagccttggaggacattatgcttagtgaaataagccaggcaaacatcgcatgttcttatttacatgtggaacctacaaaagttaaactcatagaagcagaaagtggaatggtggttaacaggggctggggttgggagggattggggagatgtccatctaaaacatgaaatttcagttagacaggtggaataagttcaagaaatctattgttcaatgtggtgactatagttaaaaatgaattatataccagaaaattgcaaagacagatttttttttttttttttttgagacaatgtcttgctctattgcccaggctcccaggctggagtgcagtggcacaatctcggctcactgcaacctccacctcctggattcaagcgattctcctgcctcagcctcccaaggagctgggattacaggtgcatgccaccatgactggctaatttttttatttttagtagagacagggtttcaccatgttggccaggctggtctcaaactcctggcctcgtgatctatccacatcagcctcccaaagtgttggattacaggcgtcagccgccacacccagccaagacagtagattttaagtgttcgtaccacaaaaggtgtgcttcagtttctttatctgtataatgtatatgttaattagcttgattcaactattccacattgtatatgtatttcaatgtgttgcataccacacatataatacaattattatttgtcaattaaaaataaaaattaaattaaaaaagaatccaactttagttcatgaagtaatcaaactttatcttttcacaagtctattcaggcttattatcatgtcatcatctctttagtatagaccttgggctctggtgccaggctatgtgaattcaatctcagctttggtacttttagctgtgtggccttgggcaggtcacttaacttctctgtgcttcagtttccttatctgtaaaatagaaataataatcatacctccttcaaagggttgtttgaggatcaaatatgtttaatgcttataaaatacttagaaccacacctgacatgtagtctgttctctatagatgttagctatatgattgttaccgttattatcattatgtgttaagagcaacaaagggggagggaaaatggccaaaggaagtggacgcagagttactttccccaacttggatgctttctactttcctgttcttcctgtgccaaggcagattgattgggttcttagccacattgccactcagggtcaacagtcagctaggatttctttttattttttttttaatttttttgagacatagatgacagctggcatttaaagaaagagtggagaatttgctaggatagagcaagcattggacttggattcagaagtcctggggctggctgaatcccagcatggaatgactgggcagtccacgacaacctcctcagtttacagatgaggacactgagtcccagagatttaggctgcaggatctccaagacctcgtgtggatccaaaagtcttaacattggtttccaatgagtgccaattataaatcaagtcctgtgaaaacataaaaaggaacctaagaatcaaatggtcaagaattgtgtttatttctgcagccctggtcaagaaaaggccatgttcatagctggcattcagtttcctgttgggagtggtaaaggcaacaagccagggattttgttagttcttggatccagaaggttgtagggttgttccagtgaattttatcacctccccagtactgaaagggcacaggcctcttgtgctgttctaggcactgtgatttcaaatagtgcttgaatgatcttatttttcttatccagaatatctttgacacagctaatgcactgtggaatcacctatggacattcaagtcagattaggggattttctttttgagtgcttcatctcattctccttctacctacctattgcttcaataagctctactcacccccttccagtggtcagctgagctttgctccatagtgagaagaaaaccatcatttagtgcatgttctcagggctggatagcatgggaattggtccagtcagctttggagtaaaataagctgtgaaactccagagggggtttgacagaggaacccactgactcgtggctttcgtttttccctctctgcagacctcctcaactctgtctccctttggctgcccagaaaaggtgctttcagagtgacaagcttgatatttttatttgactgagaaacgacatacttctgccccctcaaatatatatttgaccagactgtgggaattttggtgttgtatttaacttccccaccaagggcccagggctcattgcccacatgtccccacgagtagcatcaaaggctgttctcaaaaatgaaagacgaatgagcagacacagtgtgtcacatcagcaacttttttcccagtttctttgtaaatggaagtttatgaaaaggagcactaactcaaatcacagaatcctgtgtttgaaataaatggtcttgcaacaaacatttccgtctgcaaatgtctaaacctttcaaaagattaaaggaaattaatgctggcgtgtttcattaatttggcaccaccgtggaggaaatgtggtactcatttcatttgggtggattatgaaacgtgtcagtttttccattctctttctccagggcatttttttactgcaaggcctgtcatgatgacatcacagatcccaaaagaataaaaaaatgtggctgcaaacggcgtaagtagtgtttctctccctgtcccctccctttctcattcctattccccaaattccttttccttcccttttcttattagagaaacactaaacatcgagagttttcttgagtatgtttatgtttcacccagcagtttaaagaaatatgaaataaatacctgtccttgctttgttagagcagaggatgaaaaatcaccaccatcaacacctaggaatgaaacctgtgcctagtccctgcttctttactctagaggtgcctcagtagatgtgtccagtctaacagagacaagtatgatgtataataaggaggagaactaaagccacagagcacaaagtgtttttgtatcgtgatttccagtggattgggggtccctgagtatatagggttgagagagaaactaaatctgaggacttggtctccaaaatgggagttgactctttccatttggaattcctgctagttttaataccacaggccagagttggcaactgtgataccttcagactgcccccaagaaaagaactttccactgccaaagggcttcagttgccatcgtccaaaggtcgacctcaagcatcatcgctctttggggtagactagactgggctcagttgtttctggcatattctgtctcaagtcccttctaaagcagtttgccactggggcctcttgagaaagatatagtgagtccagaacgtggaattgtgagctcctgagataccatgacttaagtggtctttgctttgagaaggttgtgccttttgcagtaattatgctgtattgcctaatagaaattgttctcaacccttgaaaaacaaacaaaaaatgatgccatccttcctatggtgagttagtcttttaaaagctccttataatcattgctttgattctcaccctaaccccatgtaattggcaggggtgttattaatcccattttacaaaaagaggaaactaagcttccaagtttgagaggatgagattgctgacagtcacacagccaacatacagggatttgggcacacctgaaggcctctattgattctctgggtgctctaacatttttttgcagaagggaaaggcaatgtgggcagtcttgggtctgatgagtaagaacaattatgaaagagtaccccataaaatccttgttcacaagcagaagccagacagaagagcaccattcctaaagtatgccactgaaggaaggacctttttcattgtactcctagagtggggtacagaaaatgtagaaccagtcatctataaatatcactctgctggagggtaaagaagttcctcaacccatggggaaaattcccttggggtgcactcttggtctagagaagtttctgcagaaatcccctcagggtggggcagcttaggaccatgggtttcctccccctgtttccactgacttaatacagctggtccccttcccccagactcttatcgagatgagtatttattgatatctcaaaacaagagcctctaatttcttgggacaagaattccccgattctgacaacctaccgagaagagcatctaagagagaacaaggcctagaatgaacctcactccccattcaacccccacagaccccatgaatccaaagaccttcttcaccaggcagtccatcccagccatgcttagttggttgtggacacagcagcacggatgagttgaccagacatctcctgaatcatttcaatcagaaggagcacagcagtctgagggttgagggaaataagagagaacaacaaatacaagaggtgaacacttctgtaaagaaacgcttgtagtgaggggttgggaaagggaggaaaggtgaggccaataacccctgacaggatatttgccagaccctcatcccacagagtatcaaggaaatagcaagactgtgattcacatattgattagccgttcacatatttttgagtatcttctttggatgagctgctatttttggtttcagggatggagtggtcaacaaggtaaagtccctgccctcctgaatcctttactctggtgaatggagacaaaccatgatgatgtaaataaataaattcagagatagccagtgctaagaagagagaagagactgcctgagggttgaggaatcctgcagtggtgctactttatagcttggaaggtcaggaaggcctcagtcaggggtgatgttgaggccaagacccaatccagatagggagacgagcaaaggtcaaggtcaggaggcaggaataagtttgtggtgtttgaaggatggaagaaaggccagtggcactggggaaagggtagtatgagatgagattagagacggagacaggggacgtggtaagaagtgtgggttttagtcctatattaggaagcctttggaagattttaagtgaggaaatgtcatcattagttcttagtttaaaagatgtccctggtgtctggatggagagcattctcgggaggaaggagtggaagtggaaggatgaagtgagaacttctctgactcttgctctgacattggaatgtccctcataggacgccatagtggaacacagcagactaaattgtccctagaaataagaaataaggatttggcctctagggtatttttccaccttggttccagacaggtaaacagcagcaggctttagcttcatcctggagagagaggcccataattgtttgaaataattttcttctcttcatttcctttaaagttggtggagctagtgaggtatataatctcccattatgcactgcaccaattgctgcaaaaggcctgcctctacaaagccaagccagtgtaacaagggcctcgcttccttctctgtacatccctgtgcctcctcccccaacctcagcttcttcatctcacaaaggcctttggctatgtaacaatcagaattgtctgaatattgctcctactaattaaaaggccatagaacagagggcaggatgcagatgtgtgtgtgaggtgagggggtggttagaataaaatgaattattaaaaataaacctccccatgtaggtcaggcaagtgaggaaattggagaagatgttttagttgcaaagaaactttaattagaagaaactaggattattagtaacacactggggggacccccatgccttcgaacagacattgcttggttccctctctaagttggagaagacagctgacccacatactcatctgtccaaacgtgttagtccaggtattaataattcaccctggaatggtagatcccatgagggcagagctcatgacagtcactggcccttacccatagcttcctaaccctccttccccaacccagccttcccctttcacttccacccctagctcctcattcactttcattcagtaaccttcaacatttcacgtcatctcatccggagaaatatcaggtgcggacattccatttctggaaatcctgtgatagtatagtttaacgtttgcatttctttccatttcttcatagctctctatcaaggaaaagagtcaaattcagctgtctggccgaggagcaagttctcagggtctactatttactcattttctttttctatataacaaaccttgtctaatgatttacatttcttcccccagactctaaaagtttgccaaagtgtggactcctagtggacaagtaatgtctagtttgatgtgtttgaaggaattttctttgacttcaaatcattgacatatctttgatttattttttttctctttgctgccttggaatacggcccctactctattttaactgcacactggtagtgatatattgtgagtaaaacgggttcccagcagcccggagtccagttccccctgtctttctctagaagagatactcttttaattttctgtacagttttagtttcccttttacttttggtatttatgttgcatgtagcagtgacatcatgccccaactccttcatcccccaatgcagtctacagagtagcctggagccagagagtccccagggagcctgctctccatccatccaccccagtccccgggctctggccagcttcgggcactgtcttatttttctatttgaaaataagaccttgacaacagtgtgtttctcttgaaggccttgtctcaggacttttaagggacactgattaggctgaagtaattaccactataactccagatgcttcatcagctggggtaattgtcatgcttgcctttgataaattatacttggtctcctttgttattgagcttggattcctctcctaaaggaaacacatatgccacatatatattcccatgttgtgatacatatatatatatatatatatatacacacacacaatatgtaccatgatgtatcagagtatatgtacattcttatatgtaaaaattcatatttttacatataagagtagagatattccatagagtgatgtatttattgcagtacatgcttctctgtatgagaagtgcttgctagataattaattggttactcaactttgggactgtaagtatctcaattgtcttactggagacaagtatttgcacagtggtaattattatctgcagtctatgaagttcccttgctttacaacaaagtttttcttttagtcagtactcagtaggacacacccagttgctttatgaatgttagtcagacatcttggaagatccctttacctgtttaaggcagaaaagctgactggaggagaacattccatttcagcaatgagcaatgtataagtctgaacaagtcaatacaagtgtctgaacctctaacttactcaaggaataggatgcccttttactcaacaagatgtggccattgaggaggagcttttaaggccagcattgagctttgggtctttattcatgtttgtaaggctctactgaaaaggagacccaatctgtggaacagttcagtccaatggctctggaatttggagaagatgtttcaaattcagtcccctcattcctttgcagcaaaagaggcaagttgatcatctgattttggttagtcatcagtgtttggagggtatagattgctcactttaaaaacaaaacacaatgatgaccttcttcaattcaatgcacagtcttgccaaaatcgactctgtggctttcttcatcgacagaaccctttaaacatggcttgagggcatggcccactttcatacctgcagagctgcatactaaattgaatggtccttcagaattggagagaaaatgtggtgtcaatcaaccaacaactctagtgccaaatacttctgccttcctcagccacaatacagtcattaggggcagaatcaactagctcagtgtgctctgtgctgctgacattaactagctttttctttctcctctgtttttggaaaaccacctggaagacctttcttcttactccagaaggtaatgggaggaattttgctaagtgaagacatcatttctcatttataggacttgaaagaatattctctgattcccagtgccacatcaaaggcctcaccttaaatcctggtggactttttcttccgtggatatttttattagtaacgttagttgctgcagagcccatgaagagtagctccatgtttcttgcttggaaataatccctccttcatttgactgattttaaaagtgaggctgtgacctgaaaagtatctattgattgaatggcagatgttttttttcttccatcccagtcttcccttgaatttgctccatttgaaatctaaaacattttccccagcagttggaaaactccacctgggcccctcagtccagtactgctttttcctgcctcttccaatccaccctggaaattaagattctgcattggaaattggctgacaatttggttgctgatgcaggtggcagatggtgctgaggataggatggaatccaattcttccttccattccaggcttggctcagaaaggccagccagcagagaacctgagtttgacagctgattatccatttgactcaaggaaagagcagtaactgagctgcatcttcaccagccactttccaacaggtttctggtctcatgatcatggcctttgagaatagaggaaaagttgtccaagaacacttctgagaagcctttttgttttaaacactcaagagtaaacaaatagttttgatgatgtccattagggaaatacttctattttgtctctgtaaatagtactatgaagttatgatggaaatgttggttgaatatccacttcactgtggtgaagaaaagcacataaaagctttttctcaaattgtgaaactgccaggacctaggtcttcggaggaaggtgagactcagggtcaaattcttagcaaccacataacctcatagaatccatggccctggtccaataacaagaaccttatgatgtgaaccagagggtaaactgagtccctagagccttgtatttctgctttcctagagttaagttggcctatcggggcagttaattgagcatgaagtttcaagagccctaagatggaatgacaagtagctttggtgttcacacttgccagagacacactcttgtctgctcccagtctcaggaagctgcagcagggctttaaaaaggagacgcagtcagctgccactgaaatagtcctcctgtgccagctgtggctgcagaccctaggctcatctcctaggacctctcaccctttcactgcccctacccctaatcatctgctgtggatcatgagaagccattgaattgaaatgacactgcatatatttcaattctcagagacagcagggtcctctttctgctccttttggagaaaggctagttccaactgcccatgaactagctgctcttccacattgatccactagatgtcctcatagatctactttgtattaccattgacatcctggggaaaaccttgtctgagaattgggatttgggaagggaacaatgggtgactacgtaagaaagaaaattagcaaacaccaaaggagagaggatgctttgtgtggccagggagtagataagaaacttacttctgtttgaaataaatcctgaaattttcaaagttgcactttgagacctaaccttgggaatttaaagtggaactcttcatatctaaaattaaccttctaacctaaatcagctctagaaaaggaaacagtcactgagaaatggaaacaaaacaccagtggttctgaatatccatgattcactgtaacaaaattgaagggttaggaagccagagagagttgagagagatgaggggtggtaatttccaaattaggaggtccatgacttaactttgatataatttaattttacaacttaagagtataattttacacagagagtgttcaattcttctggaacatctaccaccagggagacaactcctcatcagcttttagttaaagagtttgttcatgatttgtataatggcccagaggagagctcttcctggccagtactcatatccttcaagcctgatgaatcgctccaccagatgggaggtcttaccttttaagaaagtggacccagaagtctctaggtgaagatacctgacagggagtcaatggaaatggactatgccagcagtagcgaaaaagagccaccttcccagttggtggcaccttgatctagacattctgattcatgaaggtttgtcaacatgtggggctcaatagtttttaactgtttctgtcttgtctttgagcctctcattgatcgttcttgctgattttgtgtgtgtgtgtgtgtgtgtgtgtgtgtgtgtgtgtgtggtggcacttgtttgtcttttgagatttctattttgcatttggtgtgagtgtaaaaatgattgggaaggaatgacaagtaatagcatgttttcttttttatgcatatgctgctttggaatgtgactgcttataattaacagttaatcttcttatagcacatggttttttgctgcttcgattaccagtttcagcctgttcctgcatgctaacaataagaaattttagaacaatgcatggtcgccagaacggctaacaataacagttgcaaacagtccctgagagccactggtttgtcactgtgtttcctcctgaactcatatcaaggaggaggtttacatcacccattctgatctgtttgcctctgaacaaatagtttcaaaagttatttcatccccatcatccctccccttatccttaaagacggtatatttataagaactttctttctccacaaatgtgtcagattctattattgtacataaacccaaaatggcagtatggaaatgaaaaccagggaccgttgctaatgagaagcatagcattccagagtttgatgggcttctcttctgctacagcatttgattaaaaaaattgtttttcaaaatgatttatctacggtgaagcaaaaaaatcatccttgtttccctcttctgtgtaaataacaaatcaatatttccagtaaaagaaataagaaagagaaaacaagggaatgtctgcagattgtatgccagatccggatgcatttaagataaatttatgttcatgtctttaattgaagacttttttccctttcttgacttcagccgttgctgtttgtttgggatgtctgggcattcacaccatgccttctaaattcctctgattcaaatgctatagtggaacttttttattttttatttttttttggtaaaagctaaagctcaaaggaatgatataccaccattgaacagggctggggctgcatgatgatctgaacaacagactagctaggacactaaaagaacacgtcactaaaaatgtgagccaagtttacaagaatggagttgctgctgaagagatctctcattcatctcccccagtgcctgttcttcacaatcataacgttacccttgcttgacaaatatactgtatggcaagtcataaaggtcttagaacaggacttgacccatttgagagatttaaacccctcttcctggtgactgtaacattcaaagagggcaaaaccacaagccatattttaaaataagagtgcaaccattctctacaaagaaaaagaaagagtgggggaaatgactttcaaaatggaaggtgtgggtgcagggaataacacctcctcagtttaggtttaccatttggcagtaatgcttagaataaatgtgaattcttctcccacctcgtgagagaagcaggccagttcatgataagtgataagcaaacatgtttgcctgttgtagcatcaaaatgaggtacaaaaaccttctcttgtactgaaatataaattggcttgaaaggcaaaggtgaagggcattggaaactacgatgctgacttccaacaacttttataggttaccactcagtttggatccccaggcagtgcagaacctaccataccagctttagaagagctatcaatgctgcatgcaaattgcattaagatatttcacgtggaacctattcttctatttcatgttttgtcagttttaatcgattttggcgaatattttctgtataaggaaaaaagaaataatatgattaaccaatagcctgattgcttcctgaatttctatttggtggggagagaaaggcagatgcgattttcagatcctctcagctttaagcagaaaatacacccatgagtagctaaatgcattccaatagagcaacatctcatatgcttttggtgatttcttatttgtgaactgcctttaatgtcaaatctgcagcgttagtcttgagtagctgcatttcttatatggacagatttggatatttgttctgtcaagagtaaatttaaattcctgtagccatcatataaactcactctcgggaagttcagcaaaggcatccttagatactgtattaacacgtaatcgtttcacatctaatttgatgaaagcttgtcccagcctctgcctaatgcccagaaatggatggaaattagaaagcctacatattagatatttttgcatcttgcaaaaaccatttattataccaaataagcagctaatttcattgattggcagtgtgtatattttgtcctcctgtattaatcatatcaggggaaaagtgttggttacgttttttgctgtcgataatttgctcttcttcccatttgagaacccgagtgtattcagccatgcccttttcctgtggtcaccgctttacctaggggagaaaaatcatgtgcaacagccttgggagacgataaaggcaatttatattttcgctgcttttttgatgtacaaccaaactgttaccaacaatcactctgcatttttttctgggtcaagactgttaaagtgaactaagacctgtgttaaatcccttcagctcccttccagctgccttgctgtgtgtgaccttgccattaattgccgctcttcctctcctcccatccaaccacacggttatagccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctgtaagtttaacctcaacacacgtagttccatgtttgtgctgtctgtggtatcatccctgtcttgtgctgtgccctgtggttctgagtcagtcgggctgatgtcttcttcccagtgtgaactcctgtgtgctgacatgttgccccagctgcctatgtctctgtgtacgtgcctaggaaggcctcccttctgattttcttaacttacgcttctcgtaacagcatgcaggactgtgatattacagtctggtgatatctttcctctctctcctttaaataaatataaatggaaattaaagtgacagcatatcacctactgtattaatacagagatatgcagaagtgtacatgttaatatttttgaaatggctgtaaattgaattgtatcaaagggaggaaggaaagggtgtagcgagaacaagccagctctagcattgaattgcttttagtgagcttagatagtttcttagatagtttccaaaatacaacagagttttgatgcagatggatatatatatatatatatatatatatatatatatatatatatattttctttttactatgtctctctaacctgtgcctcattcctccagtgccagattttgtcttttgttctggaaacgagttttctatgtctgtcagcctgcactgggctagtggattacagagctttttctcagaatgatgactattttgaaggactgttccattaatatcttttatttttccaatagtatagcccctgtttaactaaggtatcttgcagcaattgtgattccaaatgccaacaaaaaatttaagtcagaaacctctgtgatatccctgagtccatagcacaggcctctgatgtcagtcttctttgtcatccacaagctcagagatgttaaagaacctgtcaaggctatgcagctggtagctggcaaggctgagatgtgccagtttcctgagacctcccttatccttgcttccccatggactttgctgttttcctgatacggttcataagtgaagttcctgaaagctccagtttgagaccctgggactgtgggtcttggtccaagtgcagaaaaggctgtggttccactggaggactttacttgaagtataactataactttgttttcatgttttggtagcatagaaggtaggagatggttctcgtttctgcacttcctcccttcctctttaaagcagccaacacatatattgctaacctcttgctccctgtcctctcaccttccaagtgctcagagctggttgagctacactttcctagcaggggtaggtgtacactgacgacaggaggaagaagatcactgagctcttaagcatttattcccatggaaaatgaactggcttgactcccctgtgctggtgttgaggctggtcccagcagagtgcggctgtgtagccgggatccatgaggcctctagggctcagggaaccgggacttcactgtgtgccatgccaggtgcttatgtttgggcccaaagttcaagtgcaaagcatgatttgtgcatcgagccatattagaggcatttggaaaactttgatctaggaccagagagtcattctctctgattcacgatttcctgctgctccagagcagtgccaagggacaggattcacttcaaagtaatacctaatggaggttgcattgagagggagtgtggactgccatatgggcctaaaatcttggaaagatttctgttacaatccttagatgctaccatatgaatccttatcactttattttcccctgaagagttatctgtagtttgcatgccattacagagataagctagggcacagctgcacagagaacttgtctgtctacgatgtgcagcaagacaccaagttcaaagataggtgctggggaggaagagcagaggagggcctgaggtggcatgaattggtcacatctctttgactgatggtggtgaaagtaaccacaagcccccgggttactcttctgcctaatgcacaacttctgttctcaaataatcatgaggctctaaaaccttagcctagactcagtggagaaaagaaaggagccactctggctctgagctagggccccttggtcatgtcttggcactggccaacaataccaatcacagcacactctgtgtcccccatgtagaccccatggtgcccagtgtgtgtaatttccattatatccaagagaaatcttaattagagggatttctcagctgtgcaatttaatccaaccattgatggagaccagggagaagaaaaccttggggtgggattgtcccattctctaagaaacattctgtgagtggcatgttgtccctcccttgcctccaaaatcagcccccaccagggaacacgtggagctttgggctgcgtgttgaagccttaactggtattgacagctcagggggcgatttgccttctccgtttcatcagtcgtcctgccgtcatcactccatcaaacaaaagcagatttcatccatccctgtgtgagaccactcacctttgaccattaataataagttagaaaaatccattccaatttgagcccctttttgggcctgcataagcccttcttctccaattataaaaatgtctgtctctatgtgaaattccactggcagtgctccaatagcaatccccaggcatccctcgctggtggtggagttgggtggtgcccatttgacagagcaagttgactcaagagcagtggtgagagtgggcttttcattaaatatgaacagatgtgaaatgtagagggtttgacaattagaaatggcaggagaagggcccttgaatcaaagtgaggtcagatgggcggatcagattacttctcttacattctttagttgttctgaaaatcattttgaattagtgtcagcagagccatgatgagttttgccctttgtcttttatgctagggctgtattgtttcccaagacactcattaaaggtcattatactattatggagcttgctttggtcgcagtttcccagttgagccagtgtgctttggagactgcctaattcatttctctctttcctttcgtttccctctttactctattttttttcttataaggggaaaaatttccgttttcaagggatgttaaattgaaacacaaagtcccattatgtgttttgtgaagtgggaagagaagtagctggttcccagaggaatggtaatatattaaaagtgctcacacagttctgaaaacctgccttctaacaacaggggctgcctgctcggtgcacccctctatggaggtgtggcccattactgtggatcggttgagtcatgtgctattatgatagttgtcttctgttgaactcaggaggagatggaaggccagactgtgttgaccaaaagaacttcagaggggaaggactagtttaggaaagacaaaaatcaaaataaaaggtgtcagaaaagtaaggcaaattgtgaccgataaggattcatcacaaaaggattttatttctggcaagactgaaatgttcaatatggtaggctagaatcagtgcatagagtgtcattttatgatcatcttggttttgtttccacttcagatggtcctgggcaagagtcccagctctctcaaaagacatcaggatggtatgggcctcggctttttcacaagtagctgtgttctagtactattaaatgtaaaaaatgaatgtctagcaacatacacatgcacataaatatagaagtagattccaatcagtacgatttcttcccactataattttgtaaaatggacctttctctctctttagaagtttattcttgttatttcagtcttgcctgctatctgattgctaaatgtaatagaaagggacaattaaaattatgatgcagtggcaacgtagggccatactgattcagacctgctgagacctgcctgacatgattctagtcacaaagcatcagtaactctggcacaaacaaattaatcctgtggtagaagagaagcagacctttagacttgcacttggaaccagctttagctaaagtacatgtgtgattgctcacaccaacctttcaatttactaattgtttaaacctgcacaattacatgcagccttttgcaaactactgtagctaattttaaattacacatgacttttattttgggtataaatataatacaagaaggcattcaactccgatggttaagctgagagaagtccaatatgattaggttgaagggagacgtaccaaaatcagtttagtgtaatatcgagtcttgtcagataataaacaaaaatcagcttatcctgagtagcctttggtttgtgcagacagagaattaacattgtcaatagaactaaagtcacttaagtgaactaatggcattttgaagtacataaaatcagatacaagggcagggggtggaaacagctctaggaaaatgtctataataggacacaccctatcctgacagtctccaacgcctgttaaaggagagttaatttaataagctacatttaaaaatcaacagcctataattatctcattccttttatgtgcagttttaggtgacttcctcaaattccccaaacctaaattctatttgcttattttacttctgggccctaaaatcaattactcccctctttccaccaccactaccagtgagaaaaagacagaaaaaggagagccaaggataataagcacgaatcgatgtgatcatagtttttcatgtattagttttaaagcctgttcgtctgagtctccattttctcccatcttcccatgcttgccgtgctgatgtgagtgcgctctctctctctctctgtgtcaatatccatcacacatgtgcacaccaaacactaccagagcctttgggttgtcccctggctctttagttaccctggcccatgcgtcttgatttgaccctttgtacttcattgcaggaagtaaaaacagagtggcagatcggcctaggcagccactgggtcatcccctgtgactaagacctagtgatgggcctggaaggggcttcttaagacactcttattggtagcaggtgaggctacagaagccactgcctcttgcttgattttgtgatagccacgctgagccataggttgactggaaatatgccttactgtgggccttagctcactctgtgcagtgggcagcttcttaaatcagcattgtaaggcagaaatcatgcttgggcaaaattgcctttgagaaggatcctttacatcgctcatctgtcaagagctcccaacacactgggttcttctccagaataaatagctggttgtttcagttgagtgtcaggtaaagtcactggcttgtatttggggaccttgttgtgctttcaccaccttccaaaaaaagagtatggttgaattcctgaagatgaatacactatgaagatgtactgcaggtagatgaaaggagacgggaacagtaggcaaaaggcagccaacttctcaaaagaaattctttgaaacaggattgggaaacaagaaggagaaaggtcagaatgagggaagctgacagggtcctttgtgtataccccatcatgggacacctttcttcccagggacaccatgctgtaataaatgactcggctctttaaggacaaactagaaaagatgttggcatgcctcatgtaagcccagaagaggcccttatgcaaggtgacatagaaattatgtttgcttttttatttcaggacagtggccggttctcaggatactcatcctgacagcttctaccaccaggcagtgaatgcttcctcttacctccatggtggagggcagatgtggccagttagctcctcatcttccatcctcctccactatctcaggcgacagatgccagggccagcccgccttccacttgagctttcttgtcaaggctctgccttgagcccaaatcctgacctttactgtatgaaataaagtactgatgaacaagcagaggtttgaattagagcaggcttggagcaaatgtcaagtccgtctctgcctctttcctccacctgcaccaggagcctcgattagacccagtgtggagtttgcagcgccttaggctttatgggtctggggagacataacttattaacaaagagttattaaatttttatcaattttacaacacaatgtaaatgcctcctatgaatctacattgtattcattatcatttaaaacgttaattaagtcgaagttgcatttaatttctctctaaatgggcctctgggaagacgcttttagaaacatctgtgggagcgtgcggctcacggagctggagaatcccccagcccgcattcaggatcgccccctgagttgattgctatcacgtgtctgtggctaatttgttgtgatgtgattgggtattgtctcaaattagtatcagaccaataatggtgtgaagtcactcgagagaggcttgtggggcagtggcacaggcttcactgcatcctgccttccttccccatccagacagaaacggacagtgggtctgcagcacctgtggtttccatcatgccttgggattctccttctcatatggtgcccatcatttcagttggatacttccttcatcggagatggatgcttgtcatctggcccagcacatttaggacatttgccagcatgctcttcaaaacgatcttaacatttgggatctttgactcccagtgaagcctagaagctgcaagcacagagcagccaaaaatggaaaccagaatggagtggacctagtaatcataagcaggtcatgctcattggtgaggagagacagagggaggcatactaccaacatttgctgaaaaattatgtttctcttttgaggctagcatcatgttttagtcttatctgagcatggggtcactccccaaagagatctatattctgtgtatactgcatcaccaagggagtgagacttgttgacacagcattactaagaaatggctagttggttaacttggattcatgttacgactagaattagtgtagtctctactcttactgtgtgcaagcaactctgagtacacagggaggatgtgtgtatgtgttgttgctgttgttaaatttaacacttatatagcatttgctgcattacaggcactactccccctattaccacaaatattaattaatttaacccttattatgtggtaactgctgtttgcagttgaggcaactataacctgagacatctgcaatgtgccccatttacagataaggcaactaaggcacaagggtctcatagccagtgagtctggccaagggtctcatagcctcatgtcacagtctcatgacttgccaagggtctcatagccagtgactggtggagctgggatttcaacacaggccgtgtggctccacagagtgtggagtcggttgagttgctcagttactcttgcagttgaatatgatggataagtcacttaatctccaagggaggagaaaaaagtgaggattctggtaatgaaacctcgagataatgtagagagtcctgggggggcctcctgcacagcagctggccacccaatttggctagagtttaagacttacttagcatgcagggaattgacccccctgaagggtaaaatggggccccattcctggcaggggccaggccaagggttttgttcttagtctgtaatatgatagaaagtctttagacagtgcgacactatcatattggtgtttgatcagggaagtgacctaacagaggctttgttttgggagggctgctgtggctgcaggggaggaagggactgactagaggggagctggaagcccccctctcggggaggagacaaacagaggggagcctgttgtgggcgggccccagctgttctgagaagccttcagaaggaagacttgatctatagtctgcaggaccctgcaggtgaagcacattgcccagatgcaaatccaagaagttacagtctttaaaagacagtttaattagtggctctggagcagctgaattccatgagcctaattctccccagctgacctggcagccattgtgattcctagctgggtttgctagagtttccttcttattggaggaagatttcctgacccctgacccaggactaggagacccactcggctgcatccactaccactggccttggggatctactgcttctgtttccttttcctaaccattatttcttccttattcctcatcatcttccccagttcaaatatatcttacatcttgagtgtgttgaaggtgacaggcaggcagctctcacctgctggtgtgaagtattggctcaggctgagcagcagacacaaagcaagtgggagccaccagtggggacagctggccagcgctgaggctcttgcttccagctgcaggtggtagcttcagttagagctcatgggaattattctttaaatccctgtatatggcaaggagacttttctcctcctttctcaggaagtcagcatgtctccttacatcgatggggggaaaataataaagtgcttcacatcccattcactgaaaatccactgtagttttcaaacacttaaccttctcgagtggaaatacaaaacacatttcctgtgaagtactgccacacagagtcctaaagaagtcatgtggcatttctaagtatcatgcacaattttcttttcggttttactgctttgtgcataagacctttgtctgtgtccttacttatgtcagcatccgtgattgtggcatttgtgtacaccattgacctcagggggtcattaaaactgcatggaaaagcacttgagtcctgggttccctcatggtggtaggctgtgcatgctgagaatgccaacttctggaagtgcaatgtggcaaaatgcaccaagccaaccagctgtgtgttgtccttctctctctggggctttctcccaaaccagcttgttgaattacctggatagtcaggggaccctccatcgccacatctgcttacaggggttctgcttccccagctgacctttttcccaaagggaatctaaatggacagagctaaatccagcattgtcagacccttgcatttgaaatctcagagggaattgcaaaggcctttctgtaaatagctagatagtgcctgctttggagggagattgctacacatgcccacagatttttattctgaggagacattcttttgatgtccagctcagatgagcaggactaacaaaagtggcctttcttctcagaccatctcatttggtcatcctcagggggagctaatctctcatattcaagggaaacagcaagaaaaaactcccccagccttttctagtaaatctgaaagttttcattctagccccttcaataccgcaagatgagtcccaccaaatgttcctagagctgcagagaaaaccctatgcaaatagaaaatggaatcttttgaggcagatctgcattagggatgatcgactgcactgagagacttataaatgaagtgagaaagactccagccctagagctggcactgcaccagctgtatcgacagtgcatagatgggcatctgcacaccatagagcatgggctatcttctgggaagggagctgactgcttgcattaaaatgatcttcattttggccaatgtcagctttctgggctggagcctgttggatcacactcagtcaagaaaggacccaggggctgccttccctccctccaaggtcaaaaatgtagcatgctgacatccttggctgggcttcctatattggcaagagtacttgaataggaaatggcctgaaggattccagttcagtaaatatttcatgagtaaaagaatgaataaatgaagggcttcccaacccttaaaggaattggtgatgtgctagaagccagatcgccctagatccatgaagcttcccaaaactttctaagcagcaacttactatatagtatatatatgtaaacataaaaaactgggatgtacaagaagagtaagagggaaaaatgtagtaagaaagaacaaggacatgactgaaggaactagaaaatgatcaaatggcaggtgcaattgatattctttgtgaaggataaattatgggaaagaagatctggaaacaaagtaccagaaaaaaccacataggcaaaaatccaccaatgcttccaatgaggagtggcagggttactaccacatatagagcatttgctctggaaaatcaaggacttgtgacattcacattcagttttattaatttcagcaaacctgattattttggtgtgagtcagggcagcataaaaccaatgcattgggcagggctcatgtgaggaaaggagtctgttgtagctagagaggtgtcagcatctgcaggtgggcacatcaacctgcccaaatgtagagcaacattcgaggccttttatggcggtcagggtaatttgactctgactcgaggtaggcagcttgaatgcaacagcagcacccaaatgattcctcccgcgtggaggtatccaaaagctgaatgtctcatagctattacctattaggagccattattctgtttgttctgctcaagccaaggaagagttttcctgattgttctcaaagctctctcaggctgcaccaagcattcccttacctttgaatggttctgaaatgctctctgcattttgtcaaggctgatctggccatttcttcagtgcagatgagtaaatttccacatatggcctgtaacgtatccaactgagagaacatatccagcagggatgcttcaaaaccaaagccctaaacagatgttactgagaagggatgcacaatgacctgcagagaagagagatgctaggtgaaaataaaagctgcaactatgctaggaatgaagacagggaggaaggggctcaggtcatgtcacagggtctggaagttagggcatgaatgtgaaatttgcaaggggctggttgctggaaacactgctccttcacaaacatcttctattaagatgaagatgggaaacaggcagacatctcctgtatttcctcctctctatgttaggggattctgatgccattcccctcactgtgcagtgaactgagagatcttgttggcaattacagcctgaaattctaggaaacgtcagagcaggcagatacaagggtgagatctgtgaattttctggaaactttggaagtaagtcctggtgaagtcatgctttgacatgttcaccaagtagatgctcatggctataataagagtaatgtcttatgtgtgtttgagtctttgtgcttctcaaggcaccaacatcatctcatttcatctaggcatccccagcatagacatcatgtcctactaccatgtgactttgagtaagttccagaacttcactattttttagcttcctcatctataaactggagataataaggacctatctcacagagtggttgcacgaattcagtgagtgaatatatataaagattgcctggtatatgttgaattattatttttatcatccttcattaacatatgaaattaacaaagaaacagagatgaacttgaccaagatcacatagcggatgagtggactgctagatcagaagcttgccatctcccatagtattgatggaaataataatgataagccactttaaccataactagtgcttttttttttttcaaatgactgactgtcatcaagctagccttataagaggtcatatcagctacaggcagagaagcccacagatagtggctgagagttgaacagcttagtataacagactataaaagttaaatggagtcaatttgtttaatttctaggtcatggaataattgtcccaacagaaataagccaacaaaaataccaagagacagctatatctccccagaacattgatttccatcttgactatccagtaggccttgcaaaatttgtgtgtaaaatgaggaaattggaaggtcatatttctaagtttcctttaaactctgagactctgattatcttccttcttctgattgagaaaggctaaaagtcctttttgcttcaatccttactgttataaatccttctaaaatgctgatgtctattacccaacatcgtggtaggtcctgtgaggaacaattatgtgtgtagaaacctcgtagtatatcagtgttagtcttctgtctgtgagttcgcagcttctagggcaggaactgggcgcacagggacacaccgaaagagcccagaagattcttacaggtttctactttattgtcagcttgttttcttccaaggtgtcttttattttcctcaaggaaagcacagaaaaaggccctctccctaacccggggtcctggtattatctatgctccagtgatttgggggttattagtaatcagaacattgtcagctactgaagctatcccagaccagttcatatgcagtgtctctacaaatggccctgccctcccacaatgaatgctaactgttgacctccccaaagagcctcctcatcatatttgttacaccttgttttgttattgccaggtctccaggaatgaaatcgtgtagcaggaagcatatagggccaaacggggacaccatctccaggcaaaagaggcttcctagttggaatagtacagatttgatggatgaaaataaatgtgtgtcttagattttagcccagctgttagaatccttaggtcctgggatcattagaaaactgtgacttcaggtctcatcattcctcatccccctgaaaccccttctttatggcttgtccatccctaaaataggtctggagatcgtcagcaaattcaatgtgtttttgggagagggagggaaagttggaacacaaaaagaggagaacagatggggaaagaagacattcctgtcctttcaaattccatcaaaatttcttttttgatgatggtcttgatctcaactcatctttttctgttgttattgttgttttttgagatgggacctccttctgtcacccaggctggagtgcagtggtgtgatcatagttcactgcagccttgaacttttaggttcaagcaatcctctcacctcagcctcccaagtagccaagactacaggcgtgcaccaccatgtctggccatatctttgaggtccagttggtgttgagacttcacatcatcacctttcctaccttgctttatgagtagctgggctctgtttcttgttgattttgtaattaattagatgagtgcttggagcaaggccaagactgggcccaagtttttcacccatgccttaccactatccctttctttcagcagacctgatgtgtggataggtctagggatgagtggaatgagtatcaatatgcacatttgaaattctgagttttaccctgtaacactctctctttcctcctaccgatggccaagtcctctgatttggcctccagattacatttcgaaccttttctcaccattgccagtggcactgccaagctcacatgctcatttcttcttcagctagtctgccattgttgcccttcaacctttcaattagttcctcttgccaccaaaccaccaccaactttagtattctaaagcacagactttgtcatgttatcccattttaaagagagagaccttttgatggttccttgttttttaagaggataatttccaactttctgctattaaaatggcattcaaagcctttgcagtttggcctcaaccagtttccctagttccgttctccacataagcatccatcatctaacaattctctagaagcgtcttattctcattactttacacatttctggaaccttttcctgagactgtgattcttttcctctctgcttctagcagattaaaacttacccatccttcagagcaggggtcagcacactgtcccatgggcccagtctggcctgccatccattgtagtaagtaaagtttccttgtaacatagtcactcccattcatttgctcagtgtccatggctgctttcaggctacaactgcaaagctgagtaattgtaacaaaaagggtatggcccagaaagctcaaaatatttactatctggccttttagggaaaaagttggccaacctctgctgtgaaggtacagctcaagtactgccatctctgtgaagccttcttaactagcccacccggaaaccaaattagaaaaagtgaatctcttttctgtaagcctgtaacatttcatgtaaaccccattagacagtttttatgttgaggtttttgtagaagtcaaaattggtctttgaattcttagcatattgcacacagtaaccaagacacacagtgtgaattcaataaatggctgattaacatgtaaactctgttgacaatatgtttccatagtttattaagcatgtatctcaaggaaaaaggtctttcatgagaagctgaaccagaggcaaaaaaaaaaaaaaaagtctcaaggctagagatcttcctttcttccttcttgttcctttataccttcttgaacagaacctttgtttctgaacagccaacagccaattcctttgactgctggacaactcttgaatagattgatctcaaattgatcactgcttcttctgaaggtaacacatttgttccgttgtttctgctgacagcacatggtgggctctgtagtggatctgggggtgctgatgttttctccttccatatgtcattgggtatttgagtcggggtaggaagccatggcaaacccattgcttctgttcatccacctatgtttccttattgatttgaatttatcccaaataaatttggatatttaaggcagggtgtgcacctttaattgttcagaccctagccaatggcctagaccttatctcactggactaatacacaagctaacactaggagttatatctaggcagggtaagcccccaactcgaatcttgacagccctgaaccccaccagattccccttcaccctttgcatctgtccagaattgctcctggaaaccctgtctctccagagtgagtggtagccagctgagatgggagatgggatgcccatggcctatgcctgagaccctcctagtcaagctccctgtctggataactggagacacttcgttctcaaagcaagcattgtgacatttggttctcttcacacatgtgccttacccagcttagacagatggaagaattgaatgtaaagagattctacagaatgtattggaaataacaaaattgtgtatgtgtgtttttaaaggatacccttttggttgccgcatgagttattttgttgttgttgttgttgttagagattaaatctcaataactttttggaattagaatgggcttcccatcagctgaatgggctacacactcgcctccttttcatagcaatccaagaactccactgccttcctcacatcccctgctatgttatcagcatggtagttttgcttgagatcaaatcagggcaacataggaactgtcatttttcatttaccggggccctttgatcccatttgaggtttatttgtttcaagtgagaaacacaatccctattgcatacatctattctttagagtacttttttattttatttttttatgttagagatcaaatcagagttgtaagtagtatggtcattagttatcaccactagatttcacaggctacactttatttctgttcttacaaaatcaccaaccttctctgttgcataatgatcacttccagtgaagccacaatgtgcctttcttgggtacttgggtgttaatttatttcacagtttcctttgcagatgcaatcagagtcacctatcacattcctgtttctgctttttattgtgttcctttgctatcgcgtttgtgtgatcttttcctgaaaaatgacaggtagtgtttctctgctcactgtatcagtgacatattttccacaacttctctattgctattttaaaaatataacattttatagatgtaatcttagttgtttgtaactaggttttgttataggagcaaatttcctaaatggcatgttggtttaggtacattttttaaagaaagggaaaaatattttctgcaaaatagtttcctctaaattgtaagtgaaggaaaagctctgttagtaagattataatgcattttcctgatttcttagtacatcgaaattcatgaacattatttttatgtaagtgattaagttgtggcttttaataacacgttgttagagcaaaaagagctatcccttttgatttacttgtgtatttactgggtgacttacagtgctttacatattagaattggtttgtcaacaattaacattctaggtttttatataacccatacttcaggtaatataggattattaaactacaaccagtgtgttagaaatctgcctactggtaatacaattcttacgtataacagcagctgagaaatactgctgtgtatttatgcatagattgcaagacagatggcctgcaagccgcagaagggcctgacatgcaggtccaccagcaggtggcgctgcttttctagaaataaaccctctacctggattctaggtactctcctcctcctcactttctgccttttctcttgcagattgtctcctttatttctctaaaataaatatctaaaactgttgttgctgttgtttgaagagatatacttccagtacgacaatgcccctcaattgctaaggtttatttgaaatccaacttgcctgatgcagtgcttacttgaagcaagtccaagttaaatacatgttactgtttttaaaaggtaactacacacacaatactggattcagcactgagattggattgcctatgctatctgattattgttatgtggcaagttcccattttaatctaatatctatttacacaaattaatcccataggcttctattcacctcaggataatgaggggcatttttattaaagtgactgattgatatactgaattaatgttttatataaaaatcaccttagtatgatgttctttcatcaagagttactctagaatccaggctgggtgcagtggctcacgtctgtaaccccagaactttgggaggctgaggcgggcagatcacttgaggttaggagtttgagaccagcctggccaacacggtgaaaccccgtctctactaaaaatacaaacattagtcaggtgcctataatctcagctactttggaggctgagacactagagttgcttgaactgggaggtagaggttgcagtgagccaagattgcaccactgcattccagcctgggagcctgggtgacagagcgagactccgtctcaaaaaaaaaaagtaaataataatactaataaaagagttgctttagaatccaagtcatccaaagaatattgcctttctctcggggccagaactacattttgacaaacaggatcagagtttctgttaagttttgttctgttttttaggaagacttttcacagaaaagttgatcagctcatcaactagggcatcataaatgaagagagaaatcaaatgtgcaagcaaaactatttttaaaaattattttgtccacacatacccaatttttcaaccgttttttaaaaaagacacagctatatctttttactgttttttttatggtctgcggtattcctttgtacagaatatttagtgcaaacattagcttatgtgggagaaaatgaatttattgaggttacagaaggggagaattgaaatatgtctcaggatgactcacttatttgtttatgtttttcattattaaattttcttcctttttttttttttttaaacagtgtctcactgtgtcatccaggctggagtgcagttgtgcgatcttagctcactgcaacctctgcctcccaggttcaagtgattctcctgcctcagcctaccaagtagctgggactacaggcatatgccaccatgcccagctaatttttgtatttttagagacggggttttgccatattggccaggctgatcttgaactgacctcaagatatccacctgcctcagcctcccaaagtgctgggattacaaatgtgagccaccattcccagcccttcattattaaatttctacctatcaggccgtaaagaactttggaagcataggcagtattttactctttgaataggatttctctcttttgagtttttaaacttttctcaggcatactgcgctaagggctgcaagttgaggatctagataatgtaatgtatgttcttatttaactcacccatgtgattttcacagagaacatcttgaaatgttattgattcaacaaaatcaaggaggagaggattggggaaacattttcttctcagtgaatctattttaaagcactggttttgttgaaaatgattttttgaaaatatggattgcagtcagttttcatgtaaaagtcaaaccctgacgggtttccttccagttctctgtagaggggatgggatcagctggagtagttgaagacaagaaatagccatcctgaaatcagggtaaatttacctggctgggctgtgaggaataggccttgtgagtttcacgggacccctttctgaggcattagataactttattttcctgttgaataagctctccagaaaaaaaagaaaaatgagaacttcaatggaactggacagttgccaagggcctccctgctttatttccatgcatgaatgtgtgtttcttaccttggaaaggaaagtgggctgagcgagctaggcagtttctgatagacttttgcaagatgcaaagcccacccactatcctctttgaacttcagtatttaaatcagaagaaaaatagctttcccagaggcttcagattattactaaatattgtgcaaattctatcatttggaatgtaaacgcttacactctctgccctttatacctccaactgtgccctcaaacacattttcctgctctagccaaattgactttcttacagtttatacagtttagtattttccaaccaccttgccttggttcaaactgtgtcctccacctggcatgcccttcccaccctctactgccactccttagtctgttcagcatcatgggtcaagtgccccctgagtgccaggccctgtgctccatctggggatatacgggacctctctattcatcctattcttgtttcaagtcgtcttctttttcttcctttctttttttttttttttcctgaacaattctctctctaggacttaacttattgtctaagacatttcatgtagccctcccttgacattctcatgcaacatcttttgtactgttgcatttatgtaacttatgagttcgtatattcgtatttaatgcaattatctaatttctctggctaggcttgtggttctctcttattgtgcatctttaaaaagattttaaagaaaagaacaagaaaaaggtatgcccgacattaaactcagagtcattacaaatcagagccagaagggtctcatacttaactaatgctcatccccccaggaaagggaagtgtcttgccaaggccacacagttgatccaaggcaggcctagaaccccggggctcctgatcactaagctgtgcttctcccctttgcaacatcgcctctgtagctgctcggagctatttattgggaacttttcagggcccagcattgtgagagactcagtgatatgtgaactccaacagaggagcttataagcctagctgggggagtagaacacattagaattgaacacaaattataataatgcaaggcatgagatcagaagtgccaggggattttttaaagaaaggagagaattgatcttgtcataatcatctgggaaggccccctggaggaggcagcctaggctgtcccttcaagggtggtcaagtagtcaggtgaaaggaagacatggtgggagagcctggtgaaggagtcactgcctctctaccccgccatgcctctgccccttcttctgtctcccatgtgtctgcacacgccgatcaatcccatgacctcccagcagaaattcaagggaaagaaaagaggccctcacaatcagacggcgtgaatttcctgtaatttagaggaaacagtggggttcctctgtccccatctgtctttcatttgttcttgccctgaatggttccagccttctccaattgaggtccgtttaaacgttttctggcttttcttgtttttatgacatttggcaaaacctaattatttgacttgagcacttcattggggccatatgaaacaagggacaaaggtgacagttgaatgagatgcaaggctaggggtcaggtgggggtgggaatgctcaccccattctaagtgttggttagcggctcaattgcttggggaaggagagagagtatggacccatgtgaattacaccatgtccaaatgtggcagactggtgtggagaaggacccagcagcagagaactctcattgctctgactcttcaaagccaaggcaataatcatgggtagcatttagaaagagctcaccaggaattcttttaagtgcttttcacattttcagtcaattctcacaacaacctattagataggtactctaattctcattttattggtgagaaaactgaagttagataatttgccaaatacctaggttcagacccaacaatgtggctttaagacctgtgtggttaactcttaacctctctacccactcaatgtgagtaggcatttgtggagggatatcccatgccttaaaatctttatttcggggatggtacacttgagtgtcactggttccagggccagaaatgcaaacatggggtgtctgccctatatatgggggtacagtaggcagcagtggggcatttgagcagctgataagctcctgccccaggagaatggcacccttttggaatgaagactcagtcctctacaagatttttaattagaagttagaaatccatatttgtatggacaatcttcagacttaaagattgtcccacatgtgaaatcctgtgtatcagcagggtggtgccaagctcagcacactggggacagtagttggtcctcaggctgtcagcctgcagccccctggttatgtcacataatcccaaagcatctccgaaatttggtgtccttggtccagtagggatcacagtagatcgtaggacattgaggtatggagtaactggtctgagatcagagctctaaagagggtcagagctgggacttgggcaggtggactgactcaagaagctcatatcctcatgctgttctcactcacaggcagaattctggcagcaaatgatctgaattagaagtcagccgacctgggtcctgggtcagggtctgcgtatgagtgcagctatgacgcaaaagagggtgaggccagagcatccccaagccgcttccagcccttctgttgcactccacaccttgttctccaatgcattgaccagaaaggcccaccatacactagcattataaaatattgcacaggatgtgtccgaggataaattatgatagcatacagataaagattttatagttcaagaacatctatagaaggtgattatgcccttaagaaatatactaaatgctgtgtttagtgtaaagtcataatccacactggtccttacctcccaaggttaaaagcatactgtatttctaaagtgttctggcagaatattcttcgtcgggcacctggcttgcactaaaaacccatgcattttacctttatctgagtttgaaagaaattatcagtgcacccatctggaatatatattagaattctagggggctcttgacaccattggctcaatggaagatatggtatttccggatgagccaatagtaataatgttaataataatagtggtttgtatttatataacatcttatggtttagaaaacagtttcacatatacacaattagattctaggctggtctttaaatatcacaatcattggggcaagcattaatttaaagaatgtaaacagcaaagtgaaaatggaaatgaaatgtgattgacatcttctgccagtcatggctatttgaacctgtttgggggtggggggaaagaaaaagaaagtaacattggtgtcaaaatatgtaagcaaataaaaactttcaccccaaagtggaaatgtaaatcaacattgtgttaaccaggaggatttgatgtgggatgtgaaataaagtccacgagagacctgaccccagctctcttttctgtttctcactctgggcaggtggcaaatctcagattcctgaggcagcatgatcttttctccactccttgggatgcctgacaatttgtaaatccacgaggaagtgtttgttgcaagggccttccttaacaatctcatgcaaacagcatgaagtgatcaaaagaaataagtcttgtgttagatttgccttgtccagttctgtggggtggcagaaccagtacctcaaacacctttgagaaatggtgttcagggctggaaattgggcgaggtgagagaagcttttgccctgggcaccaaatttaagaggagacccaaaacctcaggaatcaagataaatgatagtttcatgcaatattttcaaactatcaaaataaaatattttcaaaataatcaaaatttaaaaaatccaggatgaacagaatgtcataattttaagtgaagacagtataaatattgatttcaaagctgacatttaagtactgaattcactaggggtggaaacaatgaggacaccaggaaactagcagctgtagccatgggtgtgagcccttccagggtgccaggagcagtgtttggtatcttacaggcatttttttcttgatacacatcgggggacctgatttgacctacagtaaatccaaatctatttgattataaaccgtcttagaaaaagagttcctttacaggctccataaattccattacagtccactttgtctttgttaaatgtatgggttggaaattacaattcttttattcacaatgatgattttagacacacagctcagaaagatcagcattcacttaaaaaatatattagcatgcttgtatctattaagcactattgctttgtaagctccagctgatgattttattaagtagactgcaaaaggggaagaaaaatcaaggataattataaattcataaatacataattcattggcataaaatgatttaatggaatggatgtggaattatctatttcctcaagaaaataacagagatattctgattaagcctataatcttgtgtatgtgaaattctagccaaactgatggggcacattttcttttctgaaactacctttgataagaaatgcattacaaactcatcagtttggcttcctgttaacaaagagacagcagccgtctggatcattctggattcacagtgaaactgccacaccatgtatcctccaactaaagctgtgcaagtttgacaaggggcagatgaatccaggagttattgtgcagaggtttaaatctatgcggcagctgacggttgaaataatcatctatatatcgctctgagctagctggggaaaggttgaagctgtatattttcaacatatctagtctaatggttaatctgttgtcttgtacggggctctcgcagggtggactggcagcacacgctgacagcttcgaggaattgctcacggtagatgtggttcgccttgctttccaaagtactgggtggatgaatctaacttagcttgagttggaaaatgtgaaactcacctgactcatgacctcaaacacgagcggaccagcagggctaatagcaggttgggtggtagggacagtagagtcactaagctacctctgttcctcccaatgtccccagatctgtgcacttcaggtgggctccacgggtatttcttttgttatttggctgtcttggcaggttgggaagaacattgttctttgtggagactggaaagcaagggaaatgtgagaagattaaactactgcaggggtcagcaaactttctctgtcaaaggtcagcgagttaatatcttagtctttgcaacccatatggtctctatggcaagtcctcaactttgtcgttagagatggaagcagccagggatggctggtaaaccaacaactgtggctatggtctgataaaattttatttatagccaccaaatttcatatctttttagtgggttaccaaatattattattcttagattttgtttccccaatgacttaaaaatgtaaacacactcttagctcatgtgatgtacaaaaacaggtggcaggctacagtttgctgacccctgaacttgagaaagatgagaaagaagcagctgttggtgcccaggatgtggcaggtttcatccctactctaaaagttgtccctcacaaacgcggactgcaagtgctagggcaacctaaaggagtcaggtttaacttttgccacaaagccgaaagttggcttttggtgtcaggagtagggagtagggagagaaggaaaggaaagttgggaggggctgtttgtattggacttctatacattccccagccctcccagttggatgtaaagtaaaaattatctcccatctcctagtaccttcccattctccaaaccccatagcaaaaattcagggaagttctcgaatttttcttttcaattgtgcatttcctcttagaattccatcgttcatctctgtgtctcatctctaagaaactaatacctagtgatctttgcttgagacttttctttgcccttgaggtaatagagagtctattccagggaaaaagaaaagggctaaaggcaaccagaaaattccaaaaggattttctactgaatactgaacagggcggagtgttgggcaatgattctaacaggtcaagtctacagcgaagatatatgagctgcgattctagatatggggggctttggtacatgctgagttcctctcaggatgcatacagaacatagtttgagattggggttgagggcctatggcatgggtagcatgggcacatctaatttacccaattggattctagaggatccattaggcccgcagtattttgtagagaacactgcattccatgtcatgtggattctgttcatatatttatatagtattttttttctctctcctatggaggagctgaattctttcattactctgtgttgatggactcaaacttacacaattcaggtttcctaggcagtgaatagagccagaaatacaccctgtgattaacttctacataacctattgttccttaaagtctccctccccattttcctattagctccacaaaagccagaaatgcaaaagctccaacaagcctcccttccctgccctggcagcctaccatggggtgggcactccctatgcctgtcctagggcagtacaggtcacttagacattttttgaaattcttattctgcataacgatagattttttaaaaactgatacccattaggttttccaagtaaatgtgtttcctatttcctagctagaagttgtgaaattatcctgccagaataatgtatatgataatgtggttgtttgattttagagaggtgtatatgtttgagatattatgatcgttggggttgcttttaaggggcagcatctttcttcttttcctaatctgtggattaatgttagccgtgatgtcagaggttgcagtgaactaagataacaccactgcacaccagcctgggcaacaaagaccccttgtctcagaaaaagaaaatattagccacgatctttcaaaaaatagatttatagttgatttttatgaagaatactgcagtgcttatcaaacttcttagtgatatgtgctattcaaggttgtcaggcaagaaactctcattccaaggacatcacccactttaactcccctgcaccctgatactgcccactactctctgggcgtagaacttggctccattgcctggcttgcctgatcctagctgtgcttaatagctcagcctcgtcgatggacacatggcattccccaccacgggatccatcccgaaacagcagtcaagtgctcctttacaggaatcatactaccaaattcacagtatgggttgttcagctggcatgtattattatttttgtggttgttttcccatcatcgcttaaggaaacaaccacaccctcttacccgtctggttcgtgtgagaaacagccaggcaccattccatcctccaatccagagactgcgctcttgtggccatgccgtaagactttgagagttaacttgcacaaactttctggtgaaagtcttaaacagtcatatcagagagagcttaggtcagcttgggagttttgttcatggtgaattacattttgcaacacgactgttgtaaaattccaggaattttaccatcactccatacccttcattttagtaaaacaacatttgaaacacccacttttcactggtgtcgctgacggccgaaggaaatgccgtggatctgtctttctgaggagtggcaaactcacggcatttaatgttaggcactgataccacaactaagggggctgaccaagccggcagttcgagacagacagcaaaagtttatcaccaaggattgatgactcggaatataatgattattcagtagaatttgttttagcagacttcaggaaagaatgggtctgatcctgctgctaaactgagttttcggtgtctgtacatgttgtggggtgacggggaactcagtatatttttggaaattataccaagaagattgtcttctgaatttccagaagtattatccctactgatacagatgacaataagacggcaaaaagaattgcaggaagtcatcagggtaaaagaaagggaaaaaaatggcaattcagctgtgagggagaaacttccagtttgattcaaagctattcaatgttaaaattgtttggaacttttctaaaagaaatttcactatggattaatttccattttcttttctccttattgtttggcagtcaaggttgcagctagatcacgctattccaaagatccatttgagttcaagaaggagactcccaattctcggcttgtgaccgagccaggtgaaggaagactgggacccattcccatttttaataactaccctgcagccctcaacattctactttaccatgctgagctcagttgaagaagagcgatgcactactgtggatttcagcttgcacttagcttgttgggcagcaaaataccaaaagggaaaaccgtaaaaaacgattaataataattaaaacgacctcacccccaaactggcagcttgtgcaagacttcagtcggaagccctgttagctagatgcctttgtgttcaaaccactttgcatgactcttattctgagtgactccagtgtgaatatgacattactaatgacctgctaagtgtgtacagatgtgggtttctccagatgtggtgattaataacataatggagatagcggttgactcatgtttatgagttgtttgccttttattacgtttctgagtttatttgctttgaactgttttttaactccagccaataaactcacctttaaatcttaaagggcatcatccccttaaatctcactggggaaacagggcagagggaatgtgccccaggctagagctgagcatcaggtccatctaatgcaggcattagactgaattagggaaggctgggagttgcaatcattgccccatttcactccaaggaccataaagaggcttggtaaaccctgacacagtgtttgcagtctggcgcggctgataaaggaagatatttctttttttaaaaatctagtgaaatatgtaatcattttgaagtaagcccagagttctggccagtgtttctggaagacgttgcttttgcttgaaaacagaatgctgatgaaaagtcgagtaaaatgttgttacagatgttcaactctgcattaaggctgttggaattaccaccacatcttaaatcaattctcagaacattgtctggaggttatgtcattgaaataacgaatcctctttagtcaagtataagcaaacatgttaaaacatcattgtaactttaaattaaactctagcgcaaaccaggggatctgaagcctcattagacttgcctgacatttttctagcactgagtcttcccaaactgtaaaactgttagattcagtgcctattagacaagggagcgctgggaagttacaacagcacattaagtgttatacttagggatgtgcaaaaacaagcccttgaattttatgagtacttggagactggatggagttcagctcctataaaattccacgttagattcctgaacttgtttgtgttctaaagaagtcaggtttctttaaaggatcatatcttcatgtggcttccgcagcatgaaggcaagtgaaaatgccatagatggaggtgtattgtaattagccaaaatgtaggttaaataagagcttgtaaatttgcatcgtcatgaggtagtggcccactacttcaacacgtttgtctttcatgaaagtgagtaaatttaagtctcccttttaattccatttttattcctctcatgtagtcacagaagccatgaaatgaaaattatattttatagcttaactaaaagttttcctagatctgctttctttatgcagaaattgataggatccatataaaggctgataattaaatatggtttatatcctacttatgagaaagaagttatcactgcttctcttgagggacctaagccatatgtaatggtctccattacacagcgttcatatatttaagctggagacattttcccccatctcttcagggaacagatctgcatttttaggctgtgagtgcaggaggaaacctttaaacacaagtttcattttggagaacaaatcccactttaaatgcagtatgattacgatggatgatctttctgagttgcaatgaaaataaatagtttctttgcatagaagaggcataactttactaccagaatgaggtgtctcccttgagctggctaacaggtattaacttgcaactctcccatctgaagatcagtgtagcaacaaggtgtaaagataatggccacttaaccaaagaggattatttgttataggcccaatgcaaaaagggaagccaatgctcagcaaaataatcccacaggcatgctagggaggatgacttctgttcaggtcttaactcatctagattcattgtgtaactggacacaaccatggtagcatctggtgaccttgaaaaatgctagccgtggtagactaggttagataaaaacctttggatgtgggattataaccttaagaagtctaactgaattataaccttaagatgagaaaaacagaacttgcaccccgactagagtgactcacatgcactcacacaaacacacacgtgttatttgctccagcatgctacacaaccagtctaggtcaccctgaacacaatacaccaattgcaagtggcccatattaaaagatgaccttgtcttatacgtctagttagtgcaagactttctacttcattctaagatggggaaagtgcgaaagcatacctacacacacacacacacacacacacccacacaccctcgctgcctttctaccccattattgcctcagatgcctggtcccctatcctgtgaaaggaagatgaattcaggtcaagctcagagtgcctgtttgcttgccgagagatgcatatcaactctaagtgattttttcaataccatttatgtggcttgtatttatttcctttaatcttttaagtgctgtttagtctctgtgtgatttgctttggatactcatttctgataagatgcgatatcatcccagccacatagtctctgcctggagctctaaatgactgatacagtctcggcctgagcttgggccctggtgggtgtcagaggaagcaggtggtacagggggtcggctgtgggtgtttgcaggtgctttcttgccttcatctcttctggtctcactctcaccttacaccacagtcattcccttttcctgcatcagccagggtttagacaagcccaaactgacagcagaataggagagtgtaaaatgtgtaatactttgaagcaggtttggagggtagttggattattaaaatagctttggaagcatgtatcataacctactaaatttatttagcgttttcagggaagtaccatataatgcatgctctaatatgggtcttcctggataataccaagtagctgacatggcactttctcccccatctaagactcctacaccattaacatatatcaagtctcttttgatgtcatcactgctaatatttctcttcttagctttaaggtaactgctgtgcattctgagtttcagggtgctttcctcctagtctgtgttgcagtcaactataagaatccaaagatcttatttttccttcttgatattacagctttagcctgaattgtgggggtggggagaggaggactagaattttgccgctgatgcccctgggtgacaggctgggtttgcatctgctaattatcaagcagttctcttaaaaagaagcatgatgcaggctaatacatctgcaaagcttattagtgggtgtctttgggcaagagcagtagagtgtgctgtggtgtttctaagtgaagcttcacattgcttagcaatctgtgtggtttagacatttggaaaacagcttttggtttccaatcccctgtgctgccctccatccctgccccgctgctgcatcatcagagatttcattcaatggcaacctcctccttcattccggggctctcctccaacctcaccagccccggtgctcctgtcttcatgggttgaaaaaggaccccgttggcacagccccacaagccctccctcctggcagttggagggataagagctgagttgggctggggattattgagccagcatgcaccaatgtgccccgatctgattgaaacattggctgtcaaggccttgaatccttgcctcttttcaacgctctttctctggtatgcaggggttaggaaccagctaagttggttcatctggagaagcagcaggctggcagttatgctgacatttcaaatacaactttatttctgattttggttacaacaaaacgcagtctattactgggcaaagcaaagtaaccaaaattaactctaagaataatgataagtattttttttggtatacagataaatcatgatttcttttttttttttttttttcttatggcagggtgtttacaaactgttttagtctgtttaaagtgtatgttcaaaggctggagtgtaaagaggtgttgccttcaccttctctaagccggcctctttgactaacacatttggtctttgtcattgggtcctaaaagacagccatgaattcctagtgagtgactgagccttgagtgtgtgtcctttgatattttgcctgtattgcacagtctgccctcaaactgttcataatctcatgagctgcctgtatttccagttgaagatgagcagccgtcaacactatcaccaaaaaaaaagcaacggaatggaggcatgcggaactcacccaacacctcgcctaagctgatgaggtaaggagaggggctggttgcccacggtttccctcttagcccttctcttcctcccctcgccctctcctcaccctgccaggcccagagtctcccctccccagcaagcccggggtgggggaggggagcgagatcgttagatggcttcttaaaggctggagtatttattctgtcagcttgtcagcagttaatgatagagctgaaaaaattctgtcatgaaaaacagtttgaaaagctgtttgaaaaatacataggctttaaagtcttagctgtcaccatgtcctgtctgtgtgtagttcctaaacagcagtggcactaatgatggcggtaaccaatcagagaaactcgtgtggttagtttgcctgcggcagtctctttctgctggagtccctccgaggactgttttctgtacttaaggccatatgtgagatgtatcatcacaatcaaaaatgaacctgaagattaccttccttttatcctgtcgattgaaatcaaatttctgttaattgattttgactgataagaaaaagtctaataatctgtggacttgccaaagcaaagttcaaaagtaatccagttctgctcaggctaaaagcaatattaattatgaaatacagcatgcatgtacatgttccctcctttcctcccttccttccttccttccttccttccttccctccttccttccttcccttcttccccctccctccctcccttcctccttctctctctttctccctcacttctttcttgactatggcttcctctggtaaatagcaagtgaagtcaaatttcaacagcgttctgcagtttcttcttcttggcctatctgtcttttatctcccctttttgtcttcaattcatctgccaatcccagcatttttttcctccgacatcctgactctctaccacccaaatgaaacaggagtgatttcagatttgcactgctcaccctatgtggtttctgctctggaaatgcctgccatcttgacattagttttgtcttttcatggccaccggctttgatttttgaaatagaatagtggtgatttccactccccatattcaataacatttgcatgttcctggccctccacatccacctttctggaaaataggcaagggcagtctttcttcatgtggttgaggacacaggttttccgtggaagactcaccctgcccaactccttttccatatcaccatctattcctgttaaatgtttccttaaaagttctctgccttccacttcacccagccttccttgggtttggctgatttgcatgcttgtttacagtttatgaggaggaataaaatgtgccaactgccaagcttttcgtttttatgatgccagtgtcatgctagcattcatttcctatttactcacctttaggtaatcaccttatctaattctaatagttattcccatttaaagtagagaaaagcccagccactttccttcacctaaatttagagaagcaaataaataaataaagagaagtctgaaaaatctgaaacctttggagccaaattccctgtccctgtttgctatgtaaagtatggctcatttctttgatcttgagtaataataattctgaggagttatactgttttcatatgcttcaaagctgtgtcaaagttttgctgcttaagggtacttctttattctgttggctcttgggtaccaagatgacaggtcttctgtatgaggtggaggcttttttaagtcgtagccttcagcaaaacatcaaattaccaaatccagggtaacatacttctacacaaatgcctttcctgtagatatattataccatatatattaaatactttagtgttacacgctacattttatgtgcaatagaaagtgatggtttgaggtagccttggggggactttttttccacaagcagaaaaagctagtgtatatcgtatcaagtatggtttttacaggactttctgcccgaaggcctttgtaaataagtaatgatcaacagattggctgtgggtttttgaaaagcatgcctgtgtcagtttgcatgatgggggagaattttcaaagtggatcttgctttcattcgttgctggagaggggctgagggaggcagtcatcctgggctggagctgtctgtttcatggtacatcaaaattgctaaacgtgggtcaggtggtgagtggaaacttgccaagctacagaactcgggcttctcatgttggttgcctttgggctgctgctaaggcctcagttcctgtcgctgggatgtcttatcccaccagcccaccatggtctcccttcgcagcccagctggaatgggccatcccatgacaagtgagaaagtcttagacactcctcccttaccacgtctttctatgtcccaggtgctccacattctccatctgacctgggagcaaagatggacccctcctgagccctctctccatatcccttgacttccagtttacagaaagacctcagggccctttgttttacatttgaatatctggcactggcaatgaagtcatgggtccatttttgctaaaccccctttgttgattggcagaaaacaagggctctcccagctccctgtggcttttccagttgcccccgcctcttccgacacctgctttctactctccagtaaatgggactttcaggtcctattcctcatgacctgaaaaatccataaaggaagctaatgacttatttgaagtggatttttcgacatgagtttgtgacttgcagtttgagcagaatcaatcattctgaatgcgggcaggttttagtggcctatgggcagtgacaggaatagctccaagaggaactggagaacccagaatgggctaggatgggctgtaatttaccactgtggcttctgcaaataaaacagactcctgcgtgaaggctccttccaaatcatctgccagcaggagatgcaacggggactctgcactaatggtcttttccttccctttgttcttgtatcaggcttaccctagtgtttaagtgtcacttaactctgcacgatcattaggtgaacagccttgttttgtatatctggatcctgaggtagtatgtttttgagtcacctcaacagaaaacaaccctcatgtccagatagagctgaatggcgagtgtctgggccccaggctgaggacacacgtgtaatgatggataaatttggctccacacccgcagaggaggtgtgagccatggaggcttccaagtccccggctctctctgcctgttatttcccttccttcccggtctcttactgtggaattattgaaggagcctcccgtagttttcctctaaaattaccaagcacccgttgcccaattctccctacttagtggggtggtgccttgtaaggatagccacgtctttcctcatttgtaaagtcctaggggggcacaaagtttgtctctaaatagctaagtcaagagttcttaatttgggggccttaccaaccctatgaaccttcaatgaaaactctctaggaagtctttctaggaaaaaataaaaagtacacttgatccccttttaccacagttgaagcaggttaatggattcctgaaatctccattcaggatccctggttacaatcacattcagtttattccagagccacctccacatagttgcacgtacaaatgctttttggttgatgagatttctccaatgggtaggtggtatggagtaaacacctgggttctcacactgaatcctcacatggaatccaaaaagtctgtgcacttcggctgcctgcttttaatctttttctcagattagctcccatccagcaaatatttagcgagagcctactgtgtgcaagttgtcatggaagttctttaaggaatctaaagtctagcacccaaatgactttagatcccttaaagaacttccacacagtctaatagattagattagatccctgccttcaaaatgcttatagtttagcagaggagaagacaagcacataaaaacacagaattgggtaagaacaagctgggggttccactagcatgggctgtgagaatagaaagagctgtcattacctctggtttgggaggctgagcctggtttaggaggaggtcttattgaacctagttccataccatgaggagaatgctcaactaataatattacttgtctaggtttaccgagactggatgcctgtaactcactgagtcctaactacaactctataagtagttattactcttgcccccattttacaggtgagtatgttgaggtacagaaatgtaaagtctggtaaatctaggtaagttttccctaattaggatgatggaagacatagggacagtgctcagaccacagtaaatgcctgggtgtggctatagccaggggtctttggagtggcctagatggagtggagaatgtaagagtattctggcacccagtcatgaaggttttgcttgtcataggcattagggaacccctgaaggttttcgaggaggcggtaacctaacttgtgttttgggggaatcactggtggcagcagagagaagggttgggagtcctccatcaggagatttctgagacacacactacataagcacagaggtgtgaaatagaaggcccactcaaccccagcctctgccaaggccgtttgtgtgctaagccattcagggtctgctgtagaatagtagaccaggactgggatacatagttttcccaaggacacacgtaattcctgacatcagtcctgagacctagagttttcctctaaaatcatcctagttttcctctaaaatcatcaagcacccgtggcccaattctccctacttagtggggtggtgccttgtaaggatagctacatctttcctcatttgtaaagtcctggggagcacagactttgtctctaaatagctaggtcaagagttcttaatttgggggccttaccaaccctataaactttcaatgaaaacttcagtgaaagttaggatttacataggatgtatcaggtggacagtttacacagatagcacccagctgggctggcaaggataattgacaacacccagaaaaaagaaattgaacattttgaggagagtttcatgtcaggagacccagaaaatattagacattagtttcctgaatgggaggcaaaatatgatttgaggaaaacagattatcctcttgggcatctcctggtcattaagtgaaataaactcatctacttgttaagtctcatcacctctcttttgactcaaacctttcgtggggtcattttgttaggacttctcacatcagagcctgctagcatgaaagattttagtaatagaaaatggcaaaatggactgagccaagtcaccctcacaattccttccactgggcaaaagaaagaaggaaggcagggacagcttagctaagtaaattcatctcttaatgcacaaactgatagcatatgacaggcctcccccaggactggagaagaaaaaagtagttggtgtcatggtactgaggcttgggtggaccacacaggtccctggacaagttcatgctcagcagatggtcatgaccttgccctcttgtgtcaagagcatcttgtacaacctcctgtaggactgatgaacgtgttggttctcccaggctgtctcccaaacataaaggcaaccatttccttcttctgagaatgctggctgcctaacactagataacatcttaggtggcagcagggaaaataatgcaagtagatagatgcagagaaattgaaaaggaccctagttctgccagggtggctacagcctggcctgagagttttgtcagtgtggctccagggatggccgtcaagtgggagatggggagagggtggtgggcagtggtgtctcgggggtgatgatcattatcagaagagtggaagccctgttgaaggatgtgttaaggcaggagccaggatttgctctgcaaagcctcaggaagtatcaggaaatagtaatcacccaggagccaaggcacccaagaatgaggcagatccagttggaaccatttatggtgctgaacacccaactatgattccttttgaggagaccacctaaggcctaatccagccttctgtgtctgatacaggctcagacagacccgtgtggcctgatattcttgaacattgtgctcaaggtcttagtgactagataccatgttgttaaagaagggtagaacactgaattgtaagtattgcactttgcgaggactagtatttaatttgcttgtttaaatttatttgctgattagctcatgggaagagaagtcagcaagagagagtcattagtgcagcatctagtcagtaaatccccatcaagaatcaagtgttgacacaatgcctcgagttccacagagtcacagagaatcagagtaggcacccagaatgtgaggcgcctccttcaattttgcaccctaggcaccctcttgtctagctgtagtcctggctttgctgaatagaactacagccttataatctgtgtgttgttgacaattgctaacttgggtaggatttactgaagccatatagattctccatctgggcaaaactttatagtggtggttcttatactttagcaggtgtcggaatcacctggagggctttgttaagatatagcttgctggtccacagccctacacagtctaattcagcagatctggcctggggattggaaatttgcatttctgttaaacttccaggtgatgctgatgcggctggtctgggccacagtttgagaaccactcttttgaagaatcagaacagtgagaggagcttgaagtgatgggggcccatctctaagaagtgttcagactttgcactggagaaccaaatagttgcttaattaagaacatctgtctgaccactgacatgagtcctccctgctgattagttacagcagctggctccaggcgaacttcaggcagccttgactggttagagacataatttagggttgtccttcacatcacaatgccctttttatagcaaatgctctgtgtcctaattcatacgcagtccctgtaaatgaaaaatgatgcaagaaccctgattgttcaaaaacaaattgttgcaagatatcagaggtaaatgggttctcactgcacacgttttggatctccacgaaaggtttgctgagtctctgttgactgcttgaagagtgtttggggactagagatgattcatcagttcctttagttagtttgattgcatcctctgctggattctggaaatacatggaagagcaaaatagatccctgcccctaaatagttcaccatctaatggataaaacagacatggaaattattattgccgaaggagcatctctagaagttcccaggaagggaaaataacttcagtctctctggctgttcaggatgatggctttatgaggaacacttgagccaaactgtgaagtctgagaaatgtcttgttagccccatcatggtgccttacataatagatgctcaataaagtcagtatttgcagctcggataaaaggtctgtggagggatgagaaattcacctccttttaatcaagcctctcatctcccagggagaccactgtaggatgcccttaatttggatgggatgctcataatgacagaaaaggccttatcgtgtgataagacatgaggtctcgaaaatcaagcagagaaaagaatgcaattttctagccattttgtaactttcctttttcataacatttttgtgtgtttggctggttttttgtactttcatgtaaatttctgaagtccagcgttgaacccagtgccaccgaaggaactgggatttgctgtctttgcctgtaagggaaattgtgcactttaaaatatgatatcagcttcctcacagcaggtttgctagaaaagggatttgtggttttgctttaggctgttgtcttcaaggcgagctttttctgttcctgttgtagcagggcatttagttcacttcctgagattaattgatgccaagtggcatttcttgctctgcgaatcctcaaaacaaagatcttttgcaggcacacctcagagatattgcaggctcagttccagaccaccacaacaaagtgaatatcgcaataaagcaagtaacacacattttttttctagtgcatataaaagttaggtttacactcttctgtagtctattaagtgtgtacataccttcattaaaataatttactcctaaaaatgctagtaatcatctgagtcatcagtgagttttaatcttctttctggtagagggtcttgcctcagtgttggtggctgctgtctgatcggggggtggtagctgaagattgtggtggctgcgacaatttcttaaaataagacaacaatgaagattgctgcatcgactgactcttcctttgacaaaagatttctctgtagcatgtgatgctgttggatagcattttacccagagtagaacttctttcaaaattggagtcaatcctttcatactctgctgctgcttcatcaactaagtttatgtactattctaaatcctttgttgtcatttcaacaatgctcacagaatcttcactaggagtagcttccatctcaagagaccactttctttgctaacccgtaagaagcaactcctcatatgttcaagtttgatcatgagtttgcagcaattcagtcacatgttcaggctccacttctaattctatttctcttactttttccaccacatctgctgttacttcctccactgaagtcttaaagccctcaaagtcatccatgagggttggaattcacttcttccaaactcctgttgatattttcacctcctcccatgaatcacgaatgttcttattagcatctagaatggcgattctttttcagaagtttttcaatttattttgcccagattcatcaaaggaatcactatggcagtgatagcttattaaatatatttcttaagtaataagtcttgaaagtcaaaattaccccttgatccatgggctacagaatggtagttgttctagcaggtatggaaacaacattcatcttatacatctccatcagagctcttgaataattgggtgcgttatcagtgagcagtaacatcttgaaagaaatctttttctctgagcagtaggtctcaacagcaggattaaaatattcagtagatcatgctgtaaacagatgtaaatgcctgacttcaaagcttcaaaggacaggctgattcttgttggaactaatgcagctggtgactttaagttgaagtcaaagctcatttaacattctgaaaatcccataggcattaagaattatgtgaaatctactctgcctgtgctctagcaatggaaaaataaaccttcaatttgtaaaaaaaaaaaaaaaaaaaaaaaaaaaacaaaaccataatatctgcaaagtgcaatacagcaaagttgaataacatgaggtatgcctatgttcttcttcttttttttttagacagggtctggccctgttgctgggctggagtgcagtagtgtgatctcggctcactggcagcctcaacctcctgggttcaagtaattctcgtgcctcagcctcctgagtacctgggactgcaggcgtgcaccatctgcctggctaatttttatattttttgtagagatggggttttaccatgttgcctaggccggtctcaaactcctgagctcaggtgatctgcccacctcagccctccaaaatgctgagattacaggcatgagccaccatacttggccatgcctgtgttccttattagactttaggcacactgaatttctagctgtggacactggagggtgagctgagatgcaagggttatggggtgaatttctgctaatcattcacataagtggtgcattttgtaaatgcctgcgatgctggtttccctttcttggctgcttagaacactgcaacttggggtgttttgatggagaatgaacaagatatggctgcctccttaaagtgggagggtatgaggtgggcaccctgcagcactggccttcagccaagtagacctttttgttaaggctttgcctctcctctcactggctgtgccacctgagcatgttacttatctattttgtttcccatgtatacacagagcccgataataacagaaattacctacaggtgttcttgtgagtagcaaatcataaaatgtaggtaaaagttttagtgcaccaacatttggaagtgttggactcatggcagctattcatcatagtaacaacaatggtaatagcactagtagcagcaatagtagtagtattaatagtagcagtagtagaaataatagcagtagctctatatctttattattgaactgctctccctttcctgcctcctttcaccataatcagagctagtaatacatgagtgggtcctaagcaaagtataaaggatgataaccataagactagttaacacttcttgaggacatgctctaggtcagatgctgtattcagggcatgaaatatctttactcatgtaatcctcaaatggaatccattgaataatgctaatgattaacattcccattttacagatgaagaaactaaggcaatgtacaacttagcaagtaataggtgagccaagccttgaagacagacattttggctctggagccagggcgcttaaccactatggtatactgtcactaaggaaataggtggtttcctgcccttagtggtatcaacccctgaacactccatttggagatggactctataagtcagactgctcaaattagctggctagtgttcaggcttcctctttgctttaagctgggctttcattggcattgatcctcaaatgcatgtctaagttaaagacggagagaagttaccactctggcagagcagatctaacatgcctgtatgttggtggtggggtagagaaggtggttggagaggggaaggatattggccgaaaacctttagaggagatactgggtattacatatatatgtctatgtattcctgaaataatggcgggatgcttttttcccccccttaaatggacaagaaaaacttaagattcaagaagggcagccgggggccttcagctaagggatatctgatatattgtgcctgtttttcttcaaggtgggctattgtgttaattttctaggaatgctgtaatcaagtatcacagacccagtgtcttaaacaacagagcttctcacagttctggtggctagaagtctgagatgaaagtctgggagggttggttcctcccaagggtactgagggaaggatctgtttcaggcctctcttcttggcttgcagatctctgtcttttccctctgtcttcacatgattttccctcctgtggaaaagttggcccaaatttcctcttcttgtaaggacaccagtcctattggatcagaactcaccccaatgacctaattttaacttaattacttctttaaagaccatatttcaaaatacagtcacattctgaggtaccggcggttaagacttcacataaaaatttgggggagaacacagttcagcccataaaaatgaaacagcagatatatctcacatcatagagtttctattaccctaaaatagggcatgtacattggctaagtcgcaagtgacaagtgagccttgaattaattatggtgccttttagggaaattgaaaattactttgtgagtggaagacttaggtaatgtcattatgatgtgaaagacaatatctaatcctggtccttgatttcaactaactggtctttgaggagttgtgggagaggctttggaagtgggtctctatcaccttgcaaactgaagatgttgggatcccttgttcagggagatttctcatgatcctcctttccatacaacaaacggcccaattcctctgggtctccctggatcacagcagtgttgattggtgtgctcaatggcaaatgcttggactttcttctagcaatagaagctttagaaactttgatttagtccctgtggacaactgactgtacactctccacctgttccagagatctctctgcagcacaggccagcctaaggcacttgaaattactacagcaacagccatagtaaagaaatttatactgtctggccagaaacagttacagactctattgttgctggaacgaattgtgttcccagcttactcccagactgtgaaatccagtgagtgtgtaacagtgctggcccttactggagccataaattaatccctctcccacgctgcttacctctcatcttcactctagcaacctttctttacctactcagggctctccagccttctgatatccaacaatggtccagtactttcaaaattcttctagctgtgtctttctccagtgacagcacagtgcttcaaaccttcaggatcttctaggctcgcccaacctttatatgcatatgctcactgtatcccttgctcttgtggaatggctcaatgatagaaaacccactgtcttgggcaacaactcatttcatttttgaattactttcaatttttataacaatcttcctgttttggaaccatgatttttgttctctcttaatctcatggatcattcttagtctgctgtcaatcagtcatactcaatcagtttaatccatcttcaacttgactgtcattgcacatctggagacagctggaaggcctggtctgagtcttctgtaccttaggttaggtggtatggtatggggcatcttcagccatggttttaggtgccattatttggcccttttcatttgggcctcaattctctgggtgggtcctactggctattagtggatcaacactgcaacatgctgagattcctcttcatttctcatggttcagatcaaatgctaatttttttttttttttttttttttttgagacagagtctcgctctgttgcccaggctggaatgtagtggcgtgatctcggctcactgcaagctccacctcctgggttcaccccattctcctgcctcagcctcccgagtagagtagctgggactacaggcacccaccaccatgcctggctaatttttttgtatttttaatagagatggggtttcaccgtgttagccaggatggacacgatctcctgacctcatgatccgcccaccttggcctcccaaagtgctgggattacaggcctgagccaccacgcccggcccaaatgctactttctttgcaaaaccttccttaatgctacccaaataccaggatatgaacagcttttttcttggtattcttgtatcaccttgtactttgctgtaacacttgccacaaggtactgtaactattgaactattggtgtatatatatttttttcctgctatcttgtggacctctctttgactagggactttatcttaatcattactgtagcctccattccatgctcagaataggggattcttattgattgctttactgattcaattggttgctttactgattcaataaaccaaagttagaattccaggtaccatgctggtcagagagggtaatgtctttgttccgggaggtttttgatgttcctcaggtcagtctcttgggggaaatcctggattgtttatatttaaatggtccaggccaggatgagagatgtgtggggagtagagtgtagtgtggcatacctctaagacttcctggatgcctctggatgttccattgcaaaccatggcttgagctccagtgtgaaattatgcctggtttctggaaaccactaccccagttaatgaagcttgacattagctgtcttttttctttttattgaagggcgatcgatcatcaggcttgcttatttgcttttctggatgaaagttgtaggccactgttaacaacgtctgactccttcccagaaagaatcaagtataccaaaccaaaatgtatctcctcttccccaaggcacacattttctaaaagtgttttttgtcagcttgctgtttcatttgcttgcttgctgatattatgggaacatagttctgagtatcttttaaatcctaaatgcactaggggcaggtctcaggtcatcctgaggtaatactttctctccaaccagtaaacagggcaagagaatttgaacctggctctatatcttcagggcaagtctgctaatatcctcttgcaactgaaatatgttcttcatgggctggaaagagttaattttgttcattttctcaaacctcttctccatgatggcttttgtctacctacctattccagataatattaatagatatctatgcaactgttaaagactcttcaaggacaaaaacatccctcaaaatgtgctctcaccctgatctgtaaatagttcttatcagcctttttatcttaacatctttgactaagttcagtatttggaagatggcctggtggtttacatacctcaagacctctcaacaatccagacactgagatgctactcggagtgggattgttcttcttttaagatcagatatgacagatattcctatagtagtctagcatgttcgttgaagataactttgcaagttggcttcacatagtatttgtcatttggtgtagtctaaaagcaaattctcaggcataaataaaggcagtgagaaagttttctcaccttatgtgggagtggggagcatattggagggtcgtggtagttattcaaaagcttaatcctaggtttttgggccatggaagagattgctgtcccactctgtactcttgacatataagtgggaagtatcggagacatttcagaaggacaaatagtaaaaagtaaataaaagtcagcctctgcagagcgagactctgtctaaaaaaaaaaaaaaagaaaaaagaaaaaagtcaccctctgatgttgaaatatagaatttcaaaaggtaaaatcactttacaatttatggaatgtgacccgatgtatattttctgtcttgtgttgacaatattactcagaaaagatagctccatttcaagagtggttaagtatagctgggacaatgtcctaattatatggccagttttgcaggaaggaacaatgacttcccaaacccgaggtgctgaatcactatcagagataaaagcatggacattgactatgattcaaggtgcaggagcttatttattgtgctataagcttgttagaactgcctgattccattgcagttcttaaggttgtcagtgaggctctgccaacccactagacgggaggcctttatggaagcatcttccttttccaccaatagacaaggcaatagagggcgaatgttgccctgagaatttgaaacaagtttattaagatgcatctgagcttgaggctctcatctaagatatgcagcagttgggaggtgaaggtggtggggagcatcattggatggttagtgcatatacagttgtcaaggcaaggagagagggtgttgtttagtattgaaatcatgtattccagatgtgggcatttggtagtcagtctgctctgaagtgacatgctgctgaatctttaaaggcttcagccagggagagcaaaatctgattgggcaaattgctaaaatatttaaagtgcagcctgttaaagcttttactgcgaagagcatcacgtcagaagttgtagtcagaaggagcgagtaattggctttccatcctcatgccagtcagtcagcatgaggctctattcctattccttcctcttcattgccgaggctcatagcaaccctttggtgtgtctgtctgtgtgtgtgtatgtgtgtgtgtgtgtgtgtgtgtgcacgctggggagatcgaatagctggtaaaatgagaggaagaggagtgaggtagccttaaaaagggaggctgaatccacaaaatgttaggaagaccatttaggaaaagaggagcgggggaaaggcagaaatgctccctgacaaaggtcacctgcacttccagaagtggggtggtggtttggggcagttgtctctcaaaggatggattctgtaagcagaagaatggccttcagtgacaaccacttcctctgcatctttcacatcctctgagatgtaattcagggggcactttccatttataatttatcacattttccacttaggttttcctgtccttttcttcccaggcatgaccccttgttaattcctggcaatgatcagattgacaacatggactccaatgtgaagaagtacgactctactgggatgtttcactggtgtgcacccaaggagatagagaaagtcatcctggtgagtgagggactgtgcatctgatgttgcccgcttctgccccaaaccacatttgctaggaatggggtttccctagttggacagtgggataatactgtccctggtcctaattatttttgatgagtgaaattctgagcatagattgaagcagctagacctctgatcagaacataagcaatattcagatttttcaatctctgaatatattggctcctcataagagtaggtgagcacttgctgtgggaaagccatggtgggaggtggtatgaacataattcctgtggccatggcgctggtgtcagagcctgcctgtaccaattattagctgcatggcttgggtaattcatttgactttttgcacttcggttttcttatctgtaaaaagatgagatgagaatgaccctaactcatagggctgtagtgaagattaaaatccaacagatgactcagtaaagttacctcttattcttactattattaaatgctgtgaggaaagctgaatgctgcctgtattgttattggtttatagcaatgttttgtattcttatagataatagccttgtgcatctgtgagctttcttagtgcatgttgtagacagggaaatgcatgatgatgcatgacataatgatgacaataatgaactacagtccccttggggaggctggggctcagagccctatttcgtggaaggcttgtgaacatcttcatagcagcagtgggctcacccagtctctcccaggaatgtcagcataggtaacaatccattctactctctgcccttgttctattaacagctttgggtcttaatgcctacactggctttcctacagtttattgtcttgctaatccatgagaaatggattaataatcaggaaagtcagatggaagggttctttctcccttgggcctctaatccccagattggtatgggtctgttcctttttgtcagccaggaaaatcctatcatttctgatgtcaggaccacccttcctaaacaaggactgttctgggtcctcggaatggctttgtatgctaacacactggactttcccctatgctttatctatgtgtatgtgtgttctcagcttaattataaatgagcattaacagccaatacagtatcaagctggaggctgtctcagaggtgggaaagttgcaggcaagagcacagaaagtcagaattcttagcaaacagctgttgtccaactgaccaggagtgcaaattgttctactcgcaaagctgcttcacgtatgtacattctttttgttttgttttgtttttttgagacagagtctcgctctgtcgccaggctggagtgcagagccctatcagctcactgaaacatctgcctcccagattcaagcgattctcctgcctcagcctcccgagtagctgggactataggttcgcgccaccatacccagttatttttttgtatttttagtagagacagggtttcaccatattggccaggatggtctcgatttcttgagctcatgatccgccaaccttggcctcccaaagtgctgggattacaggcgtgagtcactgcacccagccatatatgtacattctgatgtattcatggcacttttgccctggtggcctaaatttagcctgatgttaccacttgtggcaggtcacaggctggatgccgtatctgggacctagggttttaatgacttgcctggatattggtgtagtatgcatgccaactgatattcaatcaacatctcctgccagcataaaaaagtttaaggaggtgagttactacttctatcctatgaaaaataacatcatttaacaaaacatctccaggaggcctactatgtgccacacaccattctagttactggagatgcaatccctgacaacgactgctctcacagagcttgtgttctagcagggtggggctgggggaagaggagttatctctttgtgttctagcagggtggggctgggggaagaggagttatctctaggtagacaaatgagtacttaataacatttcagatatttataggatgctttgaaaaaagtaaagcagcattgtaggctagaaagagactgggaggtgctgtctggaaagtatgatccaagaagccctctctaaagtaacacggctagagataagaatgacaggtagggccagctacatgaggatgctttgaggttgtgtacccactgggcacgggaaactaactactttggggatttgaagatataagagatagtcccaattgtaatttcctggattaattagagagaagatataaaatgtaacccatgaaacagtgtatttaaagctaagtggtaagaggtgcaaaatgctattgaaatgtaggggagaaggactagggtgtgtttaagtgaccaggcaagtcccgtcatacacacataggttgtgcttgggttgggcctggaaggatgcatgggaattccagatacatagagaaatgatcagtttctctctctagtgtgctttaaacccggcaaaatcagacacaccggggctgaggctctagaattaggatattcataaggttctctgggtgatgtagctgtggccagtctgaggatgggtgttttgatcccagatcgaagttcctggggtcagcatctgtgcctcggccactcaactaactgtgccttccccacctccctattctagaattcacttccaccctgggcccagtttatattcctctggcttgttgaagggagctagcctcccaggtgacctggccaattacaaataattaggagccccatcacataacagtgctttatagactggttggctgtctcctggtggcacccaggcacttgcacttccgtgcggcccagataactaactccaggtcttctgcaggaagtggggatatgtgatgtgagctccccagtgggtcttccttggtcacagtttctaaggcatttcttacagcttatgtctccggtttccctggactattgcagagggaaaccaataatggtgacagcccctgctttattctaatgatcagagagtgaaagctagtttcttcctctccttgggggttactgtaataaccctgacattgttgtgaattgcaacattggcatttatacaatcaatgcagtggtcaattctagagattaaatcaagcagagtttgatatgtacagtggacattaatatgcctcccccaaagcattgtaagccacatggggccatccaggcatgcagtgggtggacaggaatgggaggcattgaaccagaaggagaggcagagaaaggtccacggctggcctcctggcttcactagctcagtgaatcaaagggccagcagtgactaaacatttgtatttcctgggaagttggggttctcctctaatagagtgactgtgttctttcatttgtctcctttgtagatagaggtttggagttggaggaagacactggcctgttgctcttactaatctctctctagccccttgtaatgattatttggggagatcttttctctgaatgatttaagcaaaacaggcccctccagaaatgtccctggaaagtccaaggcagcattggacaggggtcagcaaactttttctgtaataagtcatataatgaaaaatttaggtttttcagggtataagatctctgttgctactgattagctctgctgttgtagcataaaagcacccataggcaatacctaaacgtatgagcatggctgcattccaatacaactttatgggaatttgaactttatgtaattttcacagattatgacattgtcttcttttgattttttttcaaccattttgaagcacaaaaacaatttttagctcactgaacatacaaaagaatgtagtgggccagatttggcctgtgggtcgtagttttccactcctggctttaggtagcatgttccacctgctgatgcacggacatctcactgataagtctagaattctaaagtcaaatttctcccactgagcccagtgcaggcatctgaccattttatcatcatctcagcaagcaagccagaaaaggcagctcatttaatcaacaatttcatggaaactaagacttctctttccaaatagcataaatattccttttcctttttattttacctcctgaaaattattatgaaggtctgctcacacatatttatggcatacctttcttaaatcttttgtcaaagaaggtagcaatgtgtatggctatacatttggacagatttattacaaaaatataatacatatacacgtgctcaaattatagctctatatggcatgtatataacattgatgaaataaaaataatagcacatagtaagctctcagcaaatatttgcttgattctttgcacaaatgatttatttcactccttacaacagccctatgcagtcttctctctgactcttacccacttctccctgttgtagactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctgtaagtccaaggtcacattattgatgccttttcttcttttcattcacaaaagaaaatcccggatggatataatagttgtagctttgatcatgcctgtgcttcttcatctgggtatgggcctgaggactcagcacttcccctatgctctgtcaaggaaaatccaaaccctgggagaccttattaaaaggaatttgcagccaagttcagtccctcatcagggatgaagtttagcttgtatcaagtatattaaccatatcagcgtctaaacactctcactcctgcctatacaaaacctagagcattgttatattatgatgtttatagtaaggatttgcttacagaactatttatagcattatacttatggcatttttaatgcttgaagaaacattgatctgtgccaccttctgtttttaactaaataaatgcaaataacagagttctttatttctgctgtacagaaggccaactccttctgcagctcagccccaacccctgttcatttagaagtccagcaacgtgttcatggttgtgtttgtgtgtgtgtccgtgtgtgcatgtgtgcatgatattcttgactgcaaaacattaggacttcagtctgaaaaaacagtctgggactccacaatttagtgtgaggatatgggatttaggagtcatgtaattaactacttcctaatcataatgaatgcatagtccacaaactctcaaaacattgtagagaattatgcatttcaacatttgatgtaattctccacatcacaaattcatgcaaatctcacttatcctccaaatatttttcttgtaagttcacatccctgaaactgagaaacaggggccaggtgcagtggctaatccctgtaatccctgcattttgggatgctgaggcgggaggaccacttaagctcaggagttcatgagcagcctgggcaacatggtgagacctcttctctacaaaaagttaaaaaaattagcctgatgtggtggcgtgtgcttgtagttccagctacttgagaggctgagttgggaggatcacttgagcctgagaggtggaggctgcagtgggctgtgaaagcaccactgcactccagcctgggcaacagaacaagagcctgcctcaaacaaaaacaaaaacaaaacaagaaacaactgaggaacatggatttctctacatgttaagaagtctgggttttcccccacttacaaagctaaaatgtattatttctgttatcagcttccaaaacctcagaaatggggggaaaaagagccaagtaatataattcattaaagaacacacaagaatctatccacaagcagtacatgttactcattagatgccaccatgtgcctttacataatgcctgacacaatagggactcaataaatatttaaaggagtgagaaaaagatcggacagttatcttttggatgctgggccaaaaacccactgccttagtgagcacaggcagttgaaaatagtcacctatagacaaacagtcatacacagaggagagcataagcatatatatgctttgctcattccagaaatatggtcgatttgattatatgattccatggttatctttctgtcatgtgctcctccacatagtcccctgacctctgaaagtgtctttgtaaagggtttattattttaccaggatacatgagtctgtgtgtgtatgtgtgtggagagagatgggtatatgtgtgatatttggtatttgtgtgtgtgttttgtgtgtttgtgtatgtttcctcctgtgtgaccttttttgtttgtttgtttttgtttgtttgtttgttttgagtccaagtttcactcttgctgcccaggctggagtgcaatggcacgatctcggctcactgcaaccttcacctcctgggttcaagcgattctcctgcctcagtctcctgagtagctgggtttacaggcatgcaccaccatgcctggctactttttttgtattttcagtagagacagggtttcaccatgttggccaggatggttgcaaactcctgacctcaggtgatccacccacctcggcctcccaaagtgctgggattacaggcatcagccaccgcgcccggctctgtgtgcccttgtacacgttcactcatctttcttcatgtatatgaatgagctgtcatctttgcaggtcatttcaaaccctccaaaatttaacatactcaagcacaatagattttcacaaaatgggccttcacctatgtcttcacagagtttattggttaaacagtaccctgcctatagggccagcccagagaaacataagcgatttctatgtatgtcatttgtatttcttgtagtttgaaatcacgtgtgtacaactgcacagggatcatcttatatcacaattacggctggcttccctacaagatgaaaattaaaagaatatggatgcaggcaattgaagcttatgcactggcaaaatgattcaggaagttggttggacttgttttgtaccaagagatcacaggagaagagggcattctccttctctcaaaaagacgctgctccagagcttggaactagttgtgtctcagcagcaaccacagtgctaaatgccccttcctccatagttgcacaatattttagggcctgagaatagaatcatgactaccagtgactcataaaagagggtagataggctccatctctgcagccaagtctctttccaaagccagttctccagaaagggagattagaggaggacattcccagatatgtgacagttggcaaacccttggtctacacaatcagtgagttgaaggtaactcaggtcaccacacaggcaaagaggaagctagattcaagctagaggaccaatgaagctggtggccagacaggagccccaaaatgatgccgcgtggccactggggagctatggcatggggtggcctgatgattttgctgtggcttcacctgaagacacagagcatgtggaggccatggccctgtcctaacctaacccttctattttccctatgcttgcattcccggactctgttgttacttcctggatctgggatttttccactgtcttttgttgttattttttatgttaaaaaatctgtttactggcttatttattttttaaatgtacctgtaatatacaaatatgttcttgttataaaatattcaagcaatatagaagtatataaagtgaaaagcaaactttcccctcacccccacgaatcctatttcccttcccagagggaattaccattattagtgtaatggctatttttcctgtgctttccttccaaatttacatacatttatatatatgtaattttattttgtgggtttttttttttacataaatgaaactatacttttttttaactgctgtagaactttttttttcacttccccctctatcttaggcttctaaaccaatgcctgcatggagagccagctctgcctctttacctcctgcatacattttcactgtgtgcatgtccaaaagtatatttctccattcctatgttgttggacaattaggtcatttccctgtgtatttttttcttgctgaaaatatgcaataaaattatatgatctgaagcttaactcctttccatatctcttttgcattgcacacattaattccactccatccatagcctccaaattgagccgcacatccaggcccacctcatcactctgtgctcactggccatttctccttggctgcattggaactgctgtcttttgcctgagacagaagtgacccgctattaaataaacaggcatttgaaacccacccccttgttacattctgaaagccagaggttgccacaggacagttacttaaatcaagacaatttccaggcaggaagaagatgtagaaccctggcattattcctctcccgcgtttgttagtaatagcttgattgagtattgagaacaagcttaaaatgctgccatcagcaccgactaccctttagattagcacacagctcctattcccttgaatgtagttaggccagcttaatgtcaaggcataaaaaagatacttgttaaataatttcccaaagctccgactcaatctttaatttgttttcctctttccctctcctctcacttttgctcctctctctctctctctgtctctttctccccccatctctgtttttttttctttcctctatgccaaagggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaaggtaaggacagcctgtaatacttctttgctgtgcctgcaggggacaggggctggcaagagggatatccttcactcagtaattcaaagaggctcacatcagcctgcctggcagtgaaacctgcggtcaccatgatggctttcaaaggggcatctgctgcctcttctttccattccagaatgcaggcttgagacctggtcacccacacacagactaggttgcctttccagaggataaacaagcctttaaatagccaccccctcagctttcccaaggagtggcttcatgaccagtgtcatcagctaaatgtcagagcactgaaaagaagctggctgcacaattctgaccgtttccttccagtatatgtttttgccattgagctgggatgggaatgaagctttgctattgttagagccgcctctaggactctgctgaccaagggatggtaatctctggagagtggcaactctatggacactaaaagtcatttagcaaatggtgacacttgtcagaccacacattttcctataggaggcaaagcagccttaagtgacacacgtctgccttcctactctgcccctagtctttcctgtcatttgctttgggaccctgggcaggtggttacaagtaaagatgtctaggggtctcagaaaggcaacacagcaaaaccttcataaaaaatgacctctgtaatcaggatctggcaggataggatgcaaagcattttccattgagtgacacctccgtgtaggctagccatgaattggaggatagttgttacagacgagctgccagagggtggcattggctgcctgatggggaccagaatcccatcagtccaggatggaagggtgtaggagcacagcccatgagagctatggctactgggatatgaagcatcaccttattgatagcttggcaagtgtctgacctcctccccatcatgccaggctttctagaagctcagctgaatcatgcatcctggacctgtgagctacattattttttgtcaacttgacatcaccaccactgccttctaacatttgcttagcattgcagaaaagccaggaacaatagttcctggaatcctcttccctgcatggctctgggctagagtcagctggtgggagatgggcactggggtgagatttggaaagtggaggagaaagataggctttgattctttggaggcaactgcagccagaccctggcagacccaggttcaaatcttctatcagatgagctttctgggagccagtgtcttcactgctacagactgagagaggggctggggcttctctgaggatcttgagattcacagcagcttctggtcaagcttaagagaaccttcccctttggtggtgcatgtgaaatggcttctgtccttctgacatcaccctgatacagcctgaagcctaattttgacctctccatgccaccgtcctccctgccacacccaaatctaaatcttggtatccacctgctcagctgtgcccgcaggacagcacaacatgtgaaggcctaggagaggctctgagcttactcccagctgcatcctgaagaggtagagcccgcatcctgtgcggcctgcccgggtagcacaggcgagaaaggatgtgagaagacagtaagctgaccttctaggagttgaaagaggcaagccggcatttggttcctgcctttaagcccttgactttcaatatgtgtcctctctgccctgccccagtatgggtgtctgttgggggaggctgttagagttacagaacctcatgggccatcccagacctgctgggtcagaatctgcattccaacaagatccccaggcaactcaaatgtgcccttttaaagcacagtaaaccttcacatgaacaggatgtgaccaacccttggtagatgctcctcctctcctggggaggagtgaaccatcaaggggaaaggaaaacagtgaaagcaatgattctccctttaagtacagacagaagccagcaggaggaggcaggaaaacactccctttccccaacatgcctgtttcctccaaactcgatcatgattttccagggccacagattagaatgtcagtgtataatttagttacatacacatctgatatagttgttccttccagttctcttaaacctcatcccagcctcttagatcctatataaaggccaaactggtaacaattcttccactccccggtgcccaaaagccttctttattcttttatagcacaggataagcaagaaaaataggttttgacaggagatatggaggaaagagaaagggagcttatttttcctccaaagaaaaaaagggcactctttcttttgtatacacacatgcacacagttatggtctgaatgtttttgtaccctccacctactccctgccaaatacatacattgaaatcctaaccctcaaggcgatggtattaggtggtggggcctttgagaggtgtttaggtcatgagggtggagccctcatgaatgggactggtgtccttataaaagaagcctgaggccaggcatggtggctcacgccttgggaggctaaggcgggtggatcacctgaggtcaggagtttgagaccacttggccaacatggcgaaacccaatctctactaaaaatacaaaaaagttagccaggcatggtggcgggtgcctataatcccagctactcgggaggctgaggcaggagaatcacttgaacccgggaggtggaggttacagtgagccgagatggcaccattgcattccagcctgggtgacagagcaagactctgtctaaaacaaaataaaataaaccaacaaacaaataaataaagtaaaagaagcctgagagagacccctcgtcccttctgtcatgtgaggacactgcgagaaagtcctcaccagagactgaacatgccagcgccttgaccttgaactttccgttctccagaactgtgggaaataaatatctgttgtctatcagccacccagattatggtgtttgttacaggagcccaaatggactaagaccgcacaaatgacagaagaaggcaaaggatgtgtttctatgctcagcagtgattctcgtagacccctggtcagcagtggagaggagcatctgtctctcactagccagcagtctgttctgctccctaagagagagtgtcaaagctctaggcccaccaagactttatgtcccattgttttcttgtctgtctgtctgctcctctcttgtttttgaatactgttctctggtgatactctaaccttgtaaaggcagtggtccagtgggagccatcaacacagagaaatcgctccttccccagagctcacctctggctgcagacccagcactccactccttgggctcctcccagcctgtgagctgactctgtgagctgagtttccctgcttttctatatctgagacccttttgactaactggagtgcccactggcctgagatacttttgtcatccttcatctgggcatttggcatgatcaagctccaagggaatagggattatggggaacaaaaaggatttcatgttactctccattttttttcttttcttttctttccctccttccctccctccctcccttccttccttccttccttcccttccctcccttcccttcccttcccttcccttcccttcccttccctccctccctccctcccttctttctttctttctctttctttctttctttttctttctttctttctctttctttctttctttctttctttctttctttcttccttccttccttccttcctttctttctctctttctctctttctttctttctttctttcgaggtagagtctctctctgttgcccaggctggaatgcaatggtgtgatatcagctcactgcaacctccacctcctgggttcaagtgattctcctgcctcagcctcccaagtagctgggattacaggtgcgtgctgccacacccggctaatttttgtatttttagtagagacagagtttcactatgttggccaggctggtctcaaactcctggcctcaggtgatccactcaccttggcctcccaaagtgctggggatttcatgttactcttatcattttggaaaacaaatctaacttcctctgagtgataactacacagatttctggccactgacaccttgctttccctcttatgtattctatggtcctttatggaacctcatgctctgcattgtctgaagaactgtctccatgtctctagaacctcactgggtagaaatgtggactcaggacaaatgtcatgctcttgggccagaatatgcatgcaaccctatggaaagctgtcctaagatgatataatttagcatgaaaaatgtgcattcacattgagaaagtagagccttcattggacagctgccactgcatgttattagggctcctagactaacaaagcctcttttttctcttctgttctcttttcacactcccttttgatgtcacttttctagcccacatggtgtcagaactgacccagcctagggattctggaccagacactttctgaaaagacccaagatgtgatggcttgttgtcaaaaacaattacagaaaaggtggcatatcccaagccagatggtatatccgatgtgacagttgggtctatgagatgcagttttaatatacagcaggcaaaactgcagtgacaattatataaagcagatgaagctgcttcttgctggtcagcaaacatcagctcagaaccactttacagctctttaccagcaactaagtgcctttatttacagagtgcctgtcacttccctttggctggagagctggtgtattatttagcacgcatttatctggggaaaacatttcaatttaaatcagctggtacaacagtggctcttgccagactgtttccctgtggttcaaaaagatgagaactgagtctgatcttggaagaaagggtgagcagagggaggcaatgtccgctctctgagctgcttcagttcatacctgaaaagagggagcatgccatggcatttcccattctgctttcatattgttttgaaatgatgatcttgtagttgcttcctgcttacccttccatgaaaggtaactcctaaggaaaagaaaaaggaataaatggctgttctccatgcatcaggcactctaaaggcccagaacacaaaggtgaccaaaggttgcttggattcagccactcactatgcttgcaggattcaggtgagtggaggaggtatccccataaacaatgacagtccaaggaaacaaggacgaggctagaaatagaggaacacaaagggatccttggtttaggtattttgaggaattgagaaggctttcaagaagaggtggcatcggccaggcacggtggcttacgcctgtaatcccagcactctgggaggccaaggcaggtggatcacaaggtcaggagatcgagaccatcctggctaacacagtgaaaccccgtctgtactaaaaatacaaaaaattagcaaggcctggtggcacgcccctgtagtcccagctacttgggaggctaaggcaggagaatcatttgaacccaggaggcggagcttgcattgagccaaaatcatgccactgcactccagcctgggcgacagagcaagactccatctcaaaaaaaaaaaaaaaaaaaaaaaaaaaagaagaggtggcatctgtggatgacttgaatgcatgtggctatggagcacttgaaatttaggaattaaatttttccttttaatttaattttaacaaatataaaaatttaaagtgatccatagccagtggctaccatattggatggtgcagtcctagagtgtagacttgtcttgctaagggtttggatttgggggagtcatcaaagatttataggaaaagagtaattaattccatgcttgaaaaagataacaggtggaggcaaagtgagctggcttgagacggagcgaatggaagtgacggcaaagattcctggggatgtgttagagggacagggacaagtacaatttggccccaatacagggtacatataaggcagcagggagagatgaagttgaaatgtgggttgggcattgaggaatttcttttctttcttgagttaggaagctgtaaataattttttatgtgtttatgagttaggaagctgtaaataattcactaggcactggggagctacagaaggtttcaaagcaagagagtgatgggattggacctgagctttagggagatggatctggcagccctgtgaagcattgtttggagtggaaaggaagaagatgcaaggactctggttaggaactgtggctatccagatggaagcctgaaaccttggactggaaaaagaatgggaggttctagaaggagtcactgtacatgcaaaacagtctgcatggatgtgtgtttccttctgggggtcagaggatggcagagtggagggacaggctgcaggagaaagcagtgttgggaggattgggttttagtcatggtttatttccacggggacttagtggaaaatccagatgggcatgaaaagctgaagggtggaaatgaagtccttaatccaggaaaagtttgcttctagcaatctggcccattgctcatgctctaggagcaaaggagagcctcagagagagggagagaggcaagagaattgcaggacagaagtataccatctcagaaagagagggtagaggaaaactttggtagaagccggagaaccaaaagctgagcctgtcccgaatgtcccaggggagggaggagccaagatctcaaacccaagacatatgtccactgccttttttccatattttatgctttatagacacacagacacacacacacacacaaacacacacacacatacgcacacacacacacagctttcctcccgccctctttgacctgaagctatagttacactaaatgaacatccacatataagcggacaccctcctttctccacatttcaacaaaggttaagagcctcaagtagggaatgacatttttctttggaagtatggcagcagtccttggagagatagcattaattgggggcatagggtacaccttccctatcctaaagtctgagatgtcttttactgttccaaagaagaaaatgtgatttctcttttatctttgtgtgagacagtgtggattaggatctctaaattactggatgacaaaaagcagaacgaaaagggccttcctaaagtggaactctgggatgaaatccacaggacagaatgcattgaggacctctgcatgttaattttcaaatgatcagtaaagacaggctagataaaccttggtgataaaagcatcatttcttttgagcagtgactgtttcatctttgttgggataggagggaatgtgtcaagagctgtgaagatttgaagcagaaatttgacaaacaaacagaaaaatgttgtaaagaggacggccagaatggggcagtgcctggacaacatgtcacttgccaagtggttaagagaacaaagccagcaggcttaaagggccatttaatcttctgctccattggacaaaaaccagggccaatggttaataattaaggagaacaggattttagcccaacataaggaagatatttccagaacagcatggacagcctgcaaatgcagcgagcctcctatccctgactgtctctttgctaaaggagagttactgacacgctctttgtgatgggagggagattggtagagagatgagttctgtggtcctttataactaaggatatccagcatgttcttgatttttattacatagggatctgtgttttatatgatttgcattgtaactccagagggagagctatggtgtttgtcaggattggggtcatgagtcttttagtggaagcattcatgtccttcctgaacggcactgtctttgtgttcaaagatggggagcggacggcattggggtgagcagctgcagatctggcttttccattaattggacagaccaccccatcttcaacttccacaccacccttccacacctgcctttttcccagggctctgccttctcccacttctacaagcctggctttcctgacccccaggctgctcactgtttcttgcagacgcacctatacatgtatcctcacacacatttcccctccttgaagtcagagaagaattttttcagctgctcccatataacatttcattaccacaatattctctctcaattctgaaatggtgataggggagaagccatttctctttatacccactaaacgaacaaagctcagcgctaaaatatttttcttccattgtaactgaaactgctgttggcttccgtcccaaaaaccagaaagacaattatacttaactgtttagagatttataaataccacactggagtagcctctaggtagtaactttagatatctaccccaataattttcttttattggtttgtgatttagatcttatcttgagtcctctataataagagtagtacatttcattaaaagagcttactaaacaataaagaaaatctggcttagggctctgagcagatctcaagtacagaaaggggcctgccctgttacatttcttccgtggacatcccaagatgaatctcatcacaagaatctcaggtgcagatgtatttcagcaaagcagcaattgcagctgttttctaaatgacttcaacttaagagaatttttcctatatagcatatttcatcacatgagagatcctctttaaccctgccatttactattctagtaatgtattcctagcaagagaaacaaggaaaaacaacagcagcagctataataagagactgagaaacttggactactttttgaactcatggagggttttatgccctccatgcatgaaagactttcttggagagtggatgtgcagaagaaaaagtaaaaacagacagaatcatcttttccttccaaatggatgcagagcagattcatgtccccactcaggctgtgcccggcttgtgacaactgtcgtgaagggaaatcttagcttcagagacagaaagcagattttgggtggtcttggggttggactgaacttatggttttagcatctggctctcacatgccagtttactcctcaaaatttgtgtgcctggttaatgccttttttaagaaaatgtaatttttttttcaggtgagccatacaccagacacattcctatgtaatatcttatttaatctccctgacaacctgctgagggagagttaccaccttcattttacagttgagaaagcagagattcaggggaattaggtacctttcccatagccttatagctagtcaagggcacatggagttgatctccaaacatctgatttcaaagtctatgcttttctcggcacatcagcctgtctcttaaaaggcaagtgttatcctgatgagaatgggcctgaagctatacatgtactttcaagggtcatgggggcacccccaggacaaacactcaaggggatgaaagtgctcaaggtgtgccagcctcacttctaaactggtccttgcacctaaggggctgaagtttgttttcaacggttcttgtctctgtgaatccccattttttgagccccttgaccctagctgttccaacaatgagagatactaggattctgttggcttcagtctttcttgctactaccactggacaaatgagtaaatctgggggcaatgtgaagcactgtgcttagcctgtctctgtgaacagtatgactgttggagtctttcttttctgtttttcttgtgaatatagatgggacttcggagctgtaaggaagagagtggaatatttgagacctagctgttactttctttgtgaagacacttaaataacattttcaggttttatttactccttccatgctcaagcggaagtttccgtgacagcagatgagaatgaagagaccactgtagcgcccaaagcctaggctcagaaaatggtccagagaaattgtcttatagtggggaaaccacagctgtagaatcagagagaagtaaaggaagtcttgtaatcccatggaccctctaagacacctcatgaaattctggataaggataggtcaactaccttatcctgcatgtcagtttggtttgcatcctatgcatgaggttagtgcccctgttgtctccatagtctatgctgtcatagaagtaatggggtctacaggcaaaagggacagaaacataaaataagttgtatggaatgactttgacacacatacttaaggatacagggcttggaacatttcagtgtattccttgtgcagagtgtgagccatttcattcaatacacctgctgtgaagatagcacacatgcctcaagctggcagataaatctagccagctattcagtgcatttttgtcttcacctattctctataggcaatagctcatgtgcagtcttaaaaactttacttcttttcttaaaagcaacaagagcgaaattccatctcaagaaaaaaataaagaaataaatggccctgaggccagatgcagtggctcatgcctgtaatcccagcacactggggggccgaagcaggtggatcacctgaggttgggagtttgagaccagcctggctaacatggtgaaaccccatctctattaaagtacaaaaataagcctggtgtggtggctcacatctgtagacccagctactccagaagctgaggcaggagaatcacatgaacccaggaggtggaggttgcagtgagccgagattgcgccattgccctccagcctgggtaacagagtgagatcccatctcaaaaacaaaaccaaaaacaaacaagcaaaaagaaaaagaaagaaagaaagaaagaaaaagtggcactgcaaagaagccaactgatttataaatgactttagttctggatttattgaacatttaaggatatggctagtccttaaatgcttcaattatacttcatggaatggtctggaggaaaattattttctgaattccagaaaagcaggatagtccttgagcatcttgttacagatctccaggagagatgttctaccagatgttttcagtgtcccatgcatgctgccacacaatgtgttatgagaaggcagaggtggctttgggctgtggtagtcaggaaagactccagagtaaagggaccagaatttgaaaataagtgtgattaatataaataaaggttccgacaggcatgtggaaagggctgaagctgagtaacagaaggcacagaaacaggaaaggccgagtgtttttcacagagggtcacctggctatttgtgtactaatggtataaccaaggtacttaaagggctcactatgtcaaaggaaatgcttgtaggtgggtgcactgttaacctgagtagatcctccaaagaagagcctgttctattgttttgctgacctcttcatgctcgccaactgccagaaatctttctaaatgcttagcacagtacctcacacctagtagacactcagtagaggtttgtggaggggatggatacatgaatacatgatttaatcctgctatctgttgtttgcagcctgttctctcttaacgtgccctcaaatgagataaagcagccaaatacctgtattaaaaacctacactttccctccaggatttagtctcccttcatttgacaactgggcactggacaagggttacagagatcaaagatgttgcacttgtctggaggagcctttatcagatggccaggttgtctctaatataaactgtactattcccttaacctttactaatagctcctggccctcaacctttgactggcctcgctgaatgtactattacacagtaccaacccagggcccaaggctgtaggactgagacctccaaagttcaacaaagggcagaaaatatctctgctttctgctccagggagctgtgaatgcttcctgagagcttccctggccatgtagaaatgaacattcctctcagcggtagactggagcaggaggaacttggaagatgtgttttgttgctctagttcatgatagtgaatcacaaacatggctgtcagagtaatgatgcagtcatggagggttaaggaacagcttttaaatcctggttctgtccatcatgagcaatttgacataataaagattccagatttcatttcctcatctatatatctatatattaaatgaccccaccccaaaacaccgagggatcagtgtatgaatacaaagacataatggctgcagaaaggttattaaacatcaaaggctgtagaaatagcactttgcagtcaagttcagtcatggcacacatgggtctggaatgacagcttgggtttgaagcccagatctgccacttactaggcctgggaaaattactttacctctttttatctcaattttctcactaagaatactaaatgcacctggcttatcaaatgactatgagaattcaatgagatacaggactttctattgtccatacagtacctttaagtaagccagaaaaagtcactcttttctcaagacaccttattttcatctgctgaaaaaaatggtgataatctactaatatgtttgaacaatacacttttctgtcatctgctgggaaaaaatattgtcataaatatgcaaatatacaatgcctattgatatgagtggtacccacttagattagctactgtgtagtgcccaaccttcacaaccatacatggcaaccctgaatgaatggctgttaaagcacttcctacctaggatgggagaaatcaagcaatgttagctatttttgttattattattacaattttactattttatttcatcccctcctactcccagattaacaaatcataagttaggattatccacttgtacctagcagccagaattactgttgatctgtttgtctgtaaatatgcatagaaaatagatgatgatagaaaccaacacacctttggaaggtgagcagaccaggtaaggtagactaacaaaagcctacagaggagttgaggaaggactagggcagatgaacagtgagcatggggcgcttcccctccatagacaggctagcatggcgccatgcaacgcagctgctctctgaagcagagattgggacagctcgctgacagaaaacctcatacacttccaacctctggggtttggttgtggtaggagccctgatgttggtgaagtgacacccttccagagcaggacccatgctactccacctagtcaacagatggcacttggcctccctcctttgcctcttttttttttttttcttaaaacagtaattttgggtctcagccagaaaacctatagcatattagttctcaactgggaaaggggtcttgtacctacccctttaaatagctaataatgaatcttctctgtgaccctcctcctacctcttcatagacacataaatatttatatacaaatttaagagttttgtctaccctaatgattttcttcccctccaggtttattgaaatacaactgacaagtaaaagttgtatatattcaaggtttacaacatgatgatttgatatacatatacattgtgaaattattaccaaaatcaagttaataaacacatccatcatctcccatagttactattgtgtgtgtgtgtgcccgggtgtgtgtcatgaggacacttaagatctattctttttgcaaacttcaagtgtactacacagcactatcaactatagtcaccacactttacattacagccccagaatttattcatcctataatggcaagtttgtatcctttgaccaacatctccccattccccctgaccctcaccacagtccctggccaccactgttctactttctgcttctatgagttcaactttttagattccatgtataagtgagatcatacagtatttgtccttctataactggcttatttcacttagcatgatgttctccagttcatctatgttgttgaatgacagaatttctttcttttttatggctgaataatattccattatatatatgtgcaggtacatacacaacacagaccatattttctttatctactcatctgtcaatggacaccagtggtttctatatcttggctattgtgaatagtgctccaataaacatggaggtgcagatgtctctttgagatactgatttcatttctgttggatatatacccagaagtgggattgctaaatcatgtggtggttctatttttaattttttatagaaacttcatactgtcttctatagggctgtaccaatttacattcccaccagcagtgtacaagggttcacttttctctccaacctcaccaacacttgttatcacttgtcttttcaataatagcaatcttaacaggtatgaggtgatatcttattgtgatttgcatttttctgatgattagtgatattgagcaccttttcatatctacttgttggccatttgtatatcttctttataaagatgtctattaggttcctttgcccatttcttaatcaggttatttattttcttgctactgagtatatgagttctttatatagatgggatattaaccctttattggctaggtggttttaaaatattttctcccgttcagtagattggcttctcactttgttgattgttttctttgctgtgcagatttttagtttgatgtagtcccgctttttaatttttgcttttgttgcctgtgcttttggtgtcatatccaagaaatcatcgcccagaccaatgtcaaagagcttttcccctattttttctcctaggagttttacggtttcagattttacattcaagtctttaatccatttgatttttgtatatgctgtaagagaagtgttcagatttattcttttgcatgtaaatattgttttctgaacatcattattcattgaatagactgtcctttacctattgtgtgttcttgacatccttgtcaaagattagttgcccttaaatgggtggatttaattctgaactagcccactgtttttcaaccttagctgcacattgcactcacctggggaacttttaacattcttgaaatgctcaggccatactccagagcaattaaattagacattgatgcaggcatgcattggtgattccaacgtgcagcccaagttgagaaacaccagcctagccccttacttactcaaggaaaccatctctgatccttgtatcaggcagctgatttactaaagcttacatttccatagaaatttatcttggaaatttatttatagaataaatcattctcctaggcatgattgctaggagatttggaaagcatataatgggcattgtgaaaatgcaagatacatgagaaattcacaaacttccacatggttcccagcagggagctagtgggagctgggaaaataaaccagggggtgtccatttgagaggtcaaggcaggtgggcacaaacaattctttgaatacctaatcagcataggaaatggaagaattttgaaaatcaatcaggccatgggcctaaaggcaagcaaggaaggtaaataataataacatcagggttgaggtttcacacttaatctataaaactacttttaacaggcccctaggtgattataaattcgtggtggctttctctttattgggattatatgggtctattccatatttccaaaggaagcccttcctattatgcaggtgtgtctccttatttatttatttatttgcatttaagatattgaaacttttttaaaaaaaactcatttctgtgagcattaagtatataccatgcaaggaagcaattgtctctatcttatgaaatattaaatcaaaatgcttcctgttccctcatgtcccagagataaatacagcagtactttgaagcccctcttggagctgttttgcctgcaaatttattgttttgtctccattttcagaaagccctgttttctatgaagtatagcactctaggtagtttttaaggcgcaaactcctctggagttgcctgtgtcggcaacaactcttatgtagatggcacacgagggatggcgcgttgatcggctcctttaagatgacaaatgggcagagagtgttattgtctttgattgcatgccttacatcatctgtatgtaggaataagagggccatactttatctttagccattttataaatatttaagtccttatagttgcctaaagatattaaagcatattttacagtagtcggaatataaatattatatatagcacaagataccaaagtagtttaatgaattcataattttctgctcacatttattggaatgtgttttatgttccaaaagttccatttaaagaataagataccattctactccctgacaacacaccaagcattggccagtgttgggggcggggtctgagttccaatgtggggaagattctattaggaagcatggaggcaggaagtctcttccctggaatatatttcttctctctttaggtctaaatatgtgtgtgtatgtgcgtgtgtgtgtgtgtgtgtgtgcgcgcgcgtgttcgtgtgtgtgtgtgtgtgtgtgtatttttctgaataaataattctggtgcttatttaagtcccgtagcatttcaaaaagaaaattttatatctcctttcttctgtttcaaggagattaattcaaataacataagtaagagcaataaagataaagtttgcaattttcccgtcctcccatctccaactcccttttgtaaacagggatgcagattctatttgccagtatacaatggtgatccagggtcttaatgtgggtagtgacttcccaatgcattttgaatatttctcctgaaattaaagagttccaagttgcattttccttttcctaaatgcaaaaagatgacagggagaatattactgcacctcttttcaattttccagtgaaatataaaggctttcttctttaatatttcacaaagttcctccagttcccagtgggagtctatgctgggtaatgtttgctaattaccaacaacaaaactagacatacaacgttggtaaattacctgaccctttcctttttaatgagacaacaaggatttcgcgaagtggtgttgtttcactggttaatggtgtcagcaatgttgtaattgtgggttgagacacattagctgaacaaccacatgtagaaagggctttctctcgacaagctgtttggagactagaaccatattatcattaagcctatgtcatttgcatgctgctaatcgcttactttattatcctgcatatccattgtctttctttaattactctttaaattaaaattaaaaatagttttaaagcccacaatgcccgagatagcatcttgattatgaagataacttcaagaaaatggaacaactggttatatattgcctggattatgagagtcccatcgttatgtactgtgcctgcaggcctcaggggcctaattgcggtggtttctcttcctttagcccatagtgtttgtttaataaatggttatttatggccttctcagccattagagcaactttggagaaagtacttccttctccttggtttgagaagtgaagttttatcctctgggcaaaggtataaaactgaatcaaaaaaatctggatgtacactagagcttgtgaaggagtctgtaaggagatcctctggattccctttgctagcttattttgttggagatcacgtttaaaatttggggtcatgaaagagacataaatctcaaagctgagagggccttagagtcattcctattttacagatgaagacaccaagggccacagccattgccacgactgtgatcgcatagcagcaaatgaatgatttgactgttagcaaatggaaaggatgcagggctcctggagggaggatcatgccttaggggctactcctgagagaggatatgatgtgtacctggagttgtgatgtgcaagctacatggttgttgtggtttaatgtatttggtgcgcatctcttgtatgaaatgttgatatgtttgttgataccgacaatgtgataggattctggaagagagggctcctgtgttccacttccttaaaagaacaaccccatgaatgactccacagacattcctgaatattgagtagctgaacacagaattatcgtggtttcaatattatgtatgatgcacggtaatctaaagggatttgggacattgctacaacctcattttatggatgggagaactgagtttggataagacattgaatccttctacattctcacagagaggtaggagttgacctgggactaaaacccatgtgttttgttttctctgtcagcttacaaccctgttgttgataaataatagtaagttagtactgatgaagtacatgctctgtgccaggtgctgttgtaagcagtttccctgtattattattattaactcattcaatcttcatgacatcttcctcttccaatttgcagatgaggaaactgagacacaaaatttaaataaattgccccagatcacaaattagaaacagaaagaggcaggacccaaactcattcagtctagccacagtgttcaagttctagaccacaaatggtatggcttatttcaggtagtggtcaaaagttattgaccacgctgtacagagagatgctcagagtcaaaccagcatcaaaccctcatctagtgaagattcgtgtgtgtatgtatgtgggaatgcctgaccccaagatccaagatcccagtttcctattcatctgccagcataaacgtatgtacaggaaacacttcaacacttaagaaaaaaagattctttcttttaaagaaccatcaactgtttggaaccttggtgctatcttgggccaggcgtcttgtctctagaaccattcagagatagctggctgaaagttgttgatgcgattctgctttcctgaatttcatggcaaggccttggatcacttggcaaacccatcttttacagctacttaattttctgtgtgcttaagatatggatgttatactttgctcgtgattttggagttctggtttctgctgtgctggccatcaattcatactaaaccaaacaactggggcccatttggcatttggtattttaaatgtaaaaggacatttgaactacatgacaaatgctgaaaaacaaagcccatagcaccaagaacataaagaaactgtttataatgaaaaagtggttacattttcagtcaatctatcactttaatgagctcttcacgtttctttgattaatgcttgcaaaaggggagaaaaaaattgatgtaatggaaacaaaatggtatatagtcttggcagcatgaggggggatgtctgtgtgttttattagtatccccttgatatcattgtcttgtaatgtatatatctgccttttccctggcatagtaagcctctagtttactggaaatgtgatccatcatgaaagaggagatcccatgttagtggcaaaacagcctttgtcctcttgtggtggcagcaaagagggagggtcccagaacaggaattaagaataaataaaaacaataaagaaaggttagcataagctgtgccatattgaaattgggaagtccagtgggtatatgaagataaaacagaagaattaaagatgcttaacaacatttaaacattaatatgtagtaatttgtatatatttagtaataattcatacattttaaaataacgaataaaggggatggaaaaaaaggcagaggaaaacatcttcataaagtaactaaatgtgagaagttattcaaggcagacgtcctggaagaggtaaagaaacgacaggagctgggttgggagggaagagggggaacagcgtttctgaagtgggtaaggctggtgggagcagggatgggcatcagcaggtgccactttccctctgtgttggaaaccagctctgactgctcctcccttcccctatgtgcatggggcattgtgggtttcttgggctcttcactgcccatgtgtgctttatgtaaatggcctctgctctgagattgagtagctcttacaagatggtgggaggctgaaataacagagaactaggaagcctgaaaactctctctgggccctgttcttttaaagcccctttgctttgtaaccttggcctgatcacttccatctcagaacttcagtctccttaactgccaaatcaagtggatgttcaaagacctgtcagacccttacagatgaaccagctgtgtccatccatcatgttcatcagctgctctcaacccatagagatcacatgaggtttcgagatttcagggtctttaacatcaatttataatttaaaaaatttttttcattacataaataaaatgtgtttattttagaaaatttagcaattatagaaaccaaaaagaaaatgcacattccctgtaattttactgctcagacataagaaagttgacatatttgtcttatttccatagatataaatacttttaccctcaaaaaaatggatcatacatgtcagtatgttacctgtggtttttcacaaacattttatcatgaccatttttctgtcgtgaaatgtttttctgcattatttttagtggatgcatacttaaccaatttccctaaaattggacattcatgttgttttcagtggaatgttgttacttaatacctatgaatgaagaccctggcagccaaatttttaatgtaaggaaattatggctgtacacatatttttagaagtacaattgcttaggccaaagtggaggtaaaattataagtaatttgatccacactggccaagcaagtatgtctcattatattttattttttgagacagggtctcaccttttcacccaggctggagtacaatggcacaatcttggctcactgcaacctctgcctccctggctcaagcaatcctcccacgtcagcctcccaagtagctgggaatacaggcacaccctaccatgcccagctaatttttttgtgtttgtttgtttgtttgtttgtttttagtagagacgaggtttcaccatgttgctcaggcttgtcttgaactcctgagctcaagcaatccactcacattggcctccaaagtactgggattacaggcatgagccactgcatctggccttatctttaaattgtaagatgaattaagataaggtaaaactgagaagttgagatgttgtggagaaagcaatgataccatgagctcttgggtaaacggagacattagaccgggtgaatattaggtttctctccaaatctgtagttttaggtgtgtttgagttgttactagctttgtctttttcttccttcctccccttaaccaacccttctgagaaacatcttacacagtaagctctttaagcgaattctttttttctttttttttttttttttgagacggagtctcgctttgttgcccaggctggagtgcagtggtgcaatctcagctcactgcaagctctgcctcccgggttcaggccattttcctgcctcagcctcccgaatagctgggactacatctttaagttaattctaaggaaagagactgtctgcttggagagacaagtcctgtaaatatatttgtttcatgtgtgtgagacttgtctaagagctgaatatattttacgaatcttaatgggcaaataactatagagaagttttgtttgtttggttggtttaatttgctttggtttgggttggacccaaaatgtaaactctaaaaaggatggggcactttattcagtgggtggagtcaacttgcaaaggtgctaatcaaagacagtctctaaaaaaatgtaccgctaaaaatgtcactgttagttactgtaaatagaaagaaacaaggagagtattaagccaggtcttgtccctggtcactggagacaagcaggaaaccttaaatgaagatgcagtcatttgtttcagtagaaaatcaggccagcatgaatcatttcaccgcgaagagaatggagatttttctcagttgttgtactagttgggacattttggcacaagtgaaatccaatgcaaaaaggcttaagtaaaaacagagacatataactggaatgtctctggttttaggcacatttgtgtgcaggaacttgaacaatgacagagctctatctcattctctccacctcttggttcatttgccctgttttcattcaccccatggtgggctaactgcttgccagtagccccacacctgcagactcctgactttgcaaccacagaacctttaccatcttttacataatgtcctggggagaatacggacaggccctagattgaggaggacagactcatctctaaactgatgatgtggccaggattatgcaggaccatcagcggccctgtgaagtcaggatgcctggcttcatgttgccacttctgtttccagggtgggggcggagtttcttccctgcacccccaacaaacactgtggaatgggtttcttatgcatagaaggagttaaaaaggaacagaaaacagcagatatcaactatcctggttctgctgctaactggttctgtgaccttggatataataacttctccattctaagcctcagtttcttcatttgaagaatggaggaattgattagaggattttgaaaactctcgtgtttctagcatagaatgattgctgaagaggcaaaagacaccttatggtttggctcaggagtcacagaattatctgtttatacagtttccaagcactgtcattaggctttgtgcgggggagtcacaaattggcaggggcatttccccgcttccctccttgacactgacctccagcaccttgttgggggctacctctaccctgttggggtggcctttggggagtttcaggagaagctgctgccttggtaaataatcttttttttattgagtaaacatggtcagctgcctggccttcctgactctggattctagcttcataggaagccactgaaaactactgtgaaaaaatattacaaggttaaactgaggtttttcctttggctggatttttcttgcagtcatttccaaaaacctgtttcccaaatcaacctggtgtgtgtggattttcttcccctacaagttagaaagcaattgtgcttctatacatggaattttctttacttcagctgctgaagcattcgttggaatacatactgcaaaaatgactgctgtggctattaccgtagttgctcaggggagctattcagatgcctcatttattggagcttaatagattaaaagtccaaattgagtctcatgatataagcctaatcaagttctaatctgcataattttcccataagcagcaatgggaaatttggataatttatgtttcagcagttgccaatcatgtgttaaatagcattgttgcatttacttatcaaaatatttttattgatctgcacttcatctgacatttgcctttgaggtttttttccctggcattaacaggaaatttaattcatctcatagatgatgtaatatgagatgtttctcttgattttaacatgtctttatagatcatttttaaaggtgatctttcccttttacaacttcatattgaatacctgtctcagcaaacctagatgactcggcctaatttatttccctagtttaacgtagcatatggatttctaaccatcatttatatgcacacaataaaagataatttggcccaccatttgaaccaattcctttatgttaagtctatcggggtgggagaagcacttaccttcatttctccatctattctaggggagatgattgataagaatttccatctccctctctccctggaaaggctcagggatttaactagggaagatttagaaagtactttgtgtttcccccatggaaaagtactgtaataaagcatttattatatgtactgagttgtgcatgctgccataccaaagcaagttaagcataactacaatgggtcccagttgttatctgctattgtttaaaagtgaaaacaataaaaagtaagactggctcaggcctcagacttgcctgccagggacagtacctagaaggagaaggccagcacccaagtcagggatgcggcacagcctgcaggtgtcaggagtctgaggtcagactgcctggctgcggctcccagggacacttaccaattgggtatgcttgagccagttatgccactgctctgaatcttattttcctcttctacaaaatgcaaatatcaacagtccctaaacacacagggactgttatgaggaataaacaaggtggcccatgaaaaaacccttagcccagcctggcacataagaagcaatatggcgtggtggcttagaggagacactgggacttgtttatctgggttccactctgagatctgctaattcctagatgtatgtcctggggcaagttgcttaccttctctgtgcttcagtttcctcctctgaaaaatagtagtatatacataggatggttctgagaaccgaagttattacgtgagcaaaattcagtacatagtaagcactcagtaagtgttggctattttttttctttgggttctagttcagccttccccctctcttcttcattctcaattattaaccagtttaggtctagagtattcttgcctttgctttgagtctcataaaaacaatgccattgagcctttctcattttccaatgcacttgggtttacagtgtcctggaacccttttccagccattacttgtgtatatcttgtctgagccatagtccttctttccttatgatcacataaggaatattgtgtgtatatatatatatatatatatatatatatatacacacacacacacacacacacacacacacacacacacaatgctcattgccttctcattagtattctaggattttctgtgtgtgaaaaatcttttttaagaatctactaaatacttcttcagttctttatccatagggaaggggaagtgatccacgaatacttattgtatacctaataaaatattaatattggtagccagcattttttagcacttgcctcataccagatattgtactaaatgttttaaatacattattttattttatccttacaattgtcctatgtgggaggtatttgtggtttatcgatgaagaagcagactaggagagagtctgcacaatgcttatagtgccatggcttataggtggaggtgccagaatttgaatccaggacacctgactttacagcccatgctgttaacaatttcattctatttcttttctatgtgctgggcattttgtagataatctgggaagttcaaagaaatgaaaatccagtctctgacctaaagttcttatacagtatatagaatgagaatatctgtcataggataaagttggtcaagcacttatgtctcatgctgaatgaataaaataggtaacaaaaacctgccacaccagccactgaagattggagtggggagaaaacttacagtgtaaggagttcaggtggtctttggaagttatttattttatttttattgtttccagaagttattggggtattggggtacaggtggtgtttggttgcatgagtaagttctttagtggtgatctgtgagattttggtgcatccttcacccaagcagtatacactgccccatatttgtagtcttttatccctcgtctccctcccactcttaacccctaagtccctgaagtctgttgtatcattcttatgcctttgcatctccatagcatagctcccacataccagtgagaacatatgatgtttggttttccattcctgagttacatcacttagaataatagtctccagtctcatccaggtcactgcaaatgctgttaattaattcctttgtatggctgtgtagtattcactcacatatatatgtgtgtgtgtgtgtgtgtgtgtgtgtgtgatgtgatatatatatgtgtgtgtgtatatatatatatatctcacagtttctttatcctctcattgattaatgggcatttgggttagttccatggttttgcaattgtgaattgtgctgctataaacattcgtgtgcaagtatctttttcgaataatgacttcttttcctctgggtagataaccagtggtgggattgctggataaaatggtagatctacttttagttctttgaggaatctccacactgttttccatagtggctgtagtagtttacattgccgccagcagtgtagaggtgttctctgttcaccgcatccatgccaacatctactgtttcttgatattttgattatggccgttcttgcaggaataaggtggtatcacattgtgttttgatttgcattttcctgatacttagtgatgttatatacaaatggccaacaaacatatggaagtcatttttagcacaaaacttgcctcccatggccatgatcaacaaagtgctatgggtacatggctaaagaatcaggagcccatctggtgatagctttggctgtggatgatttaaacttcagtcttttcctgattgaggacttctcattccatgtctctaatggtgatattcttagtcatcttttctggcaaaataagtggttgtttctaaaattaacttcccaagtgttagtttaactaatgaagggagtgtttcccagtttcactgttctctagctgtagatctctggagtatattccatgtgccagtgtgttcacatgcagaactagggcgttgtttaatgtagagagacttcaggtgctacccatgatatagtcatggctgcaagcaataatgggaaggagagcaagatggtcagagattgggccacaatttagacctgcccctttatcaaatgcagctatgaggaatgcggtggacaccatcctatggcatcaaaggccggattgcctcattcctttatggaaggtgcttgaatttctcttctctccaaagccatttaaggaatctggggcaatcctgccgtttctgaccataattttcccatatcagtacccctaagaaagaaacaatgctaataaattatgttcacctttaacataactctacaccagggaaaaagaagaagccaactttgctgttattgttgccttttgcttttaaaaatgtgtgactagaaaagtagggaaacaaaaagaggcatgaagttttcttagcaataaaagcacacttttttggggagtcatgcataggggagagttgggccttcaacagagagatgtctttggacacctaccatagtttgtcagttgcagatgctaatggaaccaggcctggtgactgaaggggaaaatggaatatgaaagcaaaatgaaagaagcctatgaagcaagcatgtcatttccaaatgaaggtttcatgcaaaggaattgagtcttttcacagctgaaaatggaatctttaaataagataaaataaaaggatgccgtggcttgttgcgagttctgtaatgaaatacagttttcctaataccgtgtgacctgcatttctccctgctttatgggtgctattccttgacgtacaaacccgtattttctcaagtcagcatttgatgatggatgtcaaaatacaggccatgtattatgcatatagcattaccgatttaaggtgtttacttgtcaagttgaagaaattcaaaaacgtcacatccactgaatctgcacagctgtcacttccagtttttcatgtttttgaatgaaacttctaatgaaaacagtttagttttccccttcaccatcctagaagaagaaaacagctagcatttaaaaatgcgtgtttttggttatgtggttggctgaaaaacatatattcgaaagtttgaaaagatggacactacaatgtcaatcaaaatgacttacccttttcatagtgtattaatgtaaagaatcaatttaagtgcagtcagggaatggatattaagtaaaactttgtctttctttttgaaagtatggcactcagtgataagaaatgtatacacgggagagcagaaagtaagaaaacccttttatatttctctggcattttatgcattatgcacctccaaaacaacaggcaattattgagctcccgtatttcattcctgactcacacctagccaaaatgccagactcaacacaatcttgtcacattgctggaaagtgagtcagatatctggtcacataataatctatttggagttttatccttggaaatttagcaagtgactttgttcctaaaagtccctaattcattggtaagcccatgtagcattccgctgaaggaaaaaaggagaaaccgaagtgagtgtgaatgcttgcctatcatctaaatgtaattgcactgggtcttgccacttgcgtggagctgccgtatgcttcgttagaaaaattaatttttaccagatgaatgtaggaagtaaataggtttctaatattgatatgtgtccatgcaaaaccttaacgaggcagacattctgcctagccgggatatttctcactctcactaaactgaaagttacagttgttccaacctcatccaggtatgtacttggcttggacctgggacccaaagaagcccaaactgcaaaatcagagaccaagcaggctgctttccaattttcctgtgtccacatataccttatgtggtctgtgtttggcacactgggaagttcaagggatcagccataagcaggtggcatatacattagtcaggaggatttagatgcaagtaaactccttctccatttagcttaaacagaaagaaaaaaatgtgaacatcttattatattgtgtgtatgtatatgtataaatacatttgtgtatgtgtgtgtgtgtgtgtgtgtgtgtgtgtttatgtgtataaaatctcacatagggagaaatcctgaggtgggatggctccaggctgcttgccccaggaactccaggacagctcttcctgtcattcacttgagccaatatcactaagttagttatgccctcagctggtgcctcagttcctggcactacaggcacataaaaccgtgctcagtaaattaaaagagaatctcttcctatgtgtttctttttaagagcaaggaaacacttcctgaaagccccaggaagatttcctgacacctcccattggccagaactctgtgaaaactgaggcctaagtcactcaccagcaagaggataagcaattgattggtttacggtaacagtcaggccaggttaggttatgttgtggtaacaacaacaacaaacaaacaaacaaacaaatctcagcggcttaaagcaacacagctttattcttgactcactcagtatgctttgtgggtctgggtaactgtccagggctgttgtctagccttcatctccatagtaacctgtattctcacagttgccatggcctgggaagagagagatggctgtccaatacctgaaccagcagtgatatgcactgctctgctcacttttcatgggccagagcatttcatgtgtcacatggccatacctaacttcaagggggcacaggggataattctcctgtgtccctggaaagagatgggagccaagatctatgagcagaataaataattggtatgaagtctggattttttagggaactatgaagtgagttacgattatttataatggtttcctaccctgtccttctaaagaattaatcatcagagtttatcccgggaatactaattgttgacctgtgaataatgcataagctacatttttggggttgtatgtatatagtgtactctgattatttccaaattttctacttctctgatttttcttcctcctctgtttccttcccactagggttcacacctccaggaatggatagatcctctccagataacagcccagtgcacgggatgttacgtcaaccatccatcacaactggggtcaacatccccatcatcactgaactaggtaggggtcaatgtcagctttggggggagtttttgttctgtctttcaaaccatacaggatatgaggaggttggtttatttcttagccctttcaactttgtagctgctatggggtttgttttgagggggctgggaggaaggtatggggagaaatatggcagattaccggaagggaaaactgatctatctttcttctgagatgaatagacagtttccttcatgctggtcactgttttcaaaggagcatgagatgatggatttgcgattggggcattcaattgggaatggagaggaaaggaggaaaggcttagttcacggattctttctggtgatttttactgtaagaacctcttttgagcattctgtctggacagctcctacaatctgagtcctccactgatatacaaagcctcggatctaagccaaacccattttgggaacaaggtagaagccctgggctaatgtgtaataacttgacatttaacgtatcgtagttgaatatctcagccaaaagccattttcagcaaatgccattctggcccccaaaatgatggggttttgagggccatgttggttggacaatagaatctaacttctaacctggccatggcactccctgttaccattagtgagtgtgcaaaactgtagagtggcctcttcccccaagacaaatgcaaactacctgtggtccggggtccctttacttgagaatgtttcctctgttattccctcactctcttctttttctgtactttcctccactccctttccccaacccttaaatgctgtatccaattagctaaaccgggcaagttgcctttggtatcagtcaatcaggaaaaaaacagtgggacgcacattctaatgataactgaactgggtaagaagcactgttttccttcacatcagtatctccttttgttctgttgttggtgtttccaactatcatcagcttgtttttatttcaccggctgtaacagaaaggctaccccatggcactgctttgaatgtgttttatttgtggctctggttggaatcgactgtcttgttctggcctttcttaatgattttttccccacacagcatcagtaaacctttgatcacacccatctgacctggcagttgtttccaaagcatatttgctctaattcattttctctggcctgagccttttttccccacttttttttgtcaccccgctctcccgccttctcccttctactcctcttccaacatactgtcagtttgaatgacatgtcttcacagctcttagaggaagtcaaaggagaatatcaaaattttaagataagaaacctaagatggcactttccctccagctgtttatttttctttattctgactttatttgccttttttttttttcccccctactagggcatttctcagaagctctggttctgaagccataaaaacacctggtccctaggagaactttttttactaaaggcagatttcaagaagggtgcggaggataaggttagcagccacccacgtgcagccctgcactctggcccccaatcccagcccagaatcctctctgggagattcacaatggactcaggtggacgataaaggcctccagtcgtgactgcatttgttaggttcttccccacttccccgtgacttggttaataactccatgaagggcacccatcagcagcaagtctcagaactggggattgatcttctaaatagagacagcaaaagtgctgctcagcagaggggtggatagagaggtgggagcacctgccttcacatgactcacaaatgaaatgaacaccccattttcttggcccaaaaatatatttcaaaataagggagcaggctttcaacacagtaatcttgcttgcgagatgtctagaaaccaaggaataaattgtccaccactcagcagtgcattattgtaggtatagctatttatcaggacaaattcactcaggtcagggagtatcacactattttctgtttccaaccataggaggggtatctttttcatgtttagtgtagttgtttaaaagccctaggtttctggattgctctcctcagaactggagggcaataagagacccagggctcatgtggtccacgcctctggttggaaaattaatccaaacatctccatctcacaaacctacagcagcatttcagaatcctcactgccgggaatttcattttctatttggaattcacgtgccgctgactaactaggatatcttaatttgtcattagtagacgagaaaaggaaaagcttggtgccccaaacctaaggcaacaattctggtatttgattagcatcattgactctcctgaagcctttgtcccacaccagatttcttccttgtgttcagagaatctttcaggtgctcacaccacccttgtcttctgccttgaaacctatttctctagccactataccaccctcctcagaccatttcacctcccacatcccccacaaatacttcttatttatctacatgttctgagatgtgttctgcattatgccaggccagtataatgaattttaagagacacagagggcaccaaggccacacaagctttcaaagctgtgtagcacattccacttttcatctacttggagactctcaattgatgttagcatggcaaaggctcctcagagtctcacaagaaaggactgtgttacagctgtttcacctgactattccaattgtatttgaccacatatgctttggggtgattacgtgggtacctcttagcacccacataattactgttctgtgaaataggccttgagtagcattgcttgctctccttctgagactgggtatttcagaacggtatacaaggtattcactggaccctggctggtctcttggagcgcttttcctatgaccccagatgtctagctcactggcaatcgggagtcccctccccctacttggagtcacttcacctccatatctggtaccaacccttccccatcttcctgataagaggtaacagatgctgtgcttttcggagcattgccacacacaccattggtggctattacaagtaactaaaactgcattcttccatatgtggtctccagtttacattttctgattcacaaaacagaaagactaaacagtggcctacaacatccctttggacaagtgaagggaggtgaggaaaagctacctcttgaaagacccctgagcaagaccttcagtgtttccaagagaggcagagggaagctgggtattttcatgctataatgggtggacaggtatttaatgtcagaagggagatcatgacagcagctggtatttatcaagtcatggcatgatccagatgctgggccaggcttactgggcaccatcccattcgtatgagcctcctgacagcctcatgagagagctgctgtaactcccccattttacagaaacaaactaaggtatagaatgatgaaatgctttgcccaaggaagttggcagcacaggctggactgaagcccagttgtcagagcctggattttggactttcaccactagcctgcaattcaattgctgcttaaacaatggggacccaaatgtgaccaattttggaagaacagagcaaagattttccccattagaatttttctctggggaaacaagatgatgtcattttaaaatactaattccatgcctagcctttcatgctagtatcatttattctgcttcatacagtaaacaaaagttttttttttttaaaaaagaagagttatcaagaaagttgcttaaaaattaaaacaatcactctagaaaaaagaattagctgttgatacatttagaaaggaatcagggaaaggaaacctcatctgttctcttcctaaaatcacaataattatttcagaaattttgagtgcccccttctcccatccccccaccgacttttcccctattacttgctctgcaaaactgataatttccaaagccaagatgggaatggaaattaatttgtcatttaatttttaataagttaaagacatctgagtgacacaactaatcagcctgcacgtacatgcgggaggagtccttgaggaatcctcagatggaaatgaaatacagcatccaatgctgcatctgcttgaatgcaagcatataaaagattgagctgtttaggatgggaaagggagaacgtgggcgtccccatgcaactcaaaattcagagcaagtccttgtcagcaagcagcaggagacagccaggcatccatcccacctggggtttcctgtgtattaaacagggcctattgggtgtggacctagatttagggcctgggaccccgggaactacccaggccaatcccagtgggtaggctgcgggttatgcctgtggctgaattccttgctatctgcctttgctgtgctccccttccagcgctctttactcccaataagctgctttcttttcattgtggctaaaatgactatcccagcatggctgctcatcattgaaatatgtccatctctcaaaggacttggttaccaaaaaacactggaaagtgtttttaggtcatgatcctaaagctatgccaaaggactggccagcacagtctattggtcctccagtggcctgccgtggagcaagcctgcttgaacttattgctctccaggtctcagacacttaaacagtgacacaggaacagtccattgagtcccactgccccccttacccaaagatccatctacagcttattccatgcttttgtttccttctcaatgacttcagtatttctaaaccagtagcctggtctccctctggcttcaatgcctgtgtgtggtcttcagagctaattcttattttatgctttttctagtgaacgatactaatgttcagtttttggaccaagacgatgatgatgaccctgatacagaactgtacctcacgcagccctttgcctgtgggacagcatttgccgtcagtgtcctggactcactcatgagcgcggtgagttatcctgttccctcctcctcactcaagggtggaggatgtgccaatagagcacctccaacctttgaggccctgggctgcactggggccacagtggagagcaagactcctagaagctcacaccttagaaggggagacccacattataaaaccatcacacaagtaaatgtttgattataaattcctcaagtgcaaggaaggcaaggcaggctagaaggaaatataggtgagggcttgacctggttttggggatcccagaaaaattccccaagggagttgtacattttatgctaaaatttgagccataaagaggggagatcttgggggaagagcattctctgaagaagaaagaaagcaaatgcaaaacctggtgttgggggggacctgaggctctcaaagaaggcaaagaaaccctgtgaggctggaccatggggagacaagggtgcaggaggatggccaaggttagacctgcagaaccttgaaacacattttcatggttttggactttttcttaagaataatgaagaggcactgaaggattttagttggagagtgacataatcaggttcatgctttaaggggattgccttggctgttgtagggaggatgattcagaggtacaagatggcggcaggaggtctgagtaagaggctgtcatggcttggactaggatagagctggtgttgggatcgagggaggtggatggagctcagtggtattgggcagtacaattaataggacttgggaaaagattgagcatgagcagaaggtggagaggacagtgggtcaaagatgactgccaggcctgtcactgagactgaagtccttgggagagaaccaggcatggaggcaaggcctggctggaaggagggaggagttagtggcagagagaggacagtgggctggcccagggatcaaacacagctttggtttcttttataacttgatgtgcatctagcaatcaggcatttgttttttcacttttgcaaccgaaaaacaaataacgattaaaaaatgggtcccaacattatggagccatctttcactgcaaaaggcaaaagtaggcatttagaatgagtcataacctgggtattatgaagtcttcccactgagcatctttatttattatgtagaaaatcttcttcattttggagttctcaaattctcaatttgtgaaaatgcagacataggctgaacaaaaacttgacctttggagaatccatgataaagagcttttctgaacacattaaaaccataaacagaactcagagtttttacacacgtatatttcttaaagtgctgaaagttattctcctgaatgtgctaaacaactgatatgctaattatgtactggtctcatctattcattaaataatgctaatcccagaaggacctctatttgaggaaagaaaaaacataaagctttttaagactaatttgggttattctgtatgcctgaacattgtccaactgcaagcatatcttatttaaaaatcagaattttggatttaaaaatgactgtgaaatgacattcgtctgaattaaggttaactgggcttcatgccatgccatggctttccaagccaacaaggagataaaatggtccttggaaaagggctcccttggtttcctggggctcatgatctttcttatggcctgatgataccaaggctaacctttctacctgctagtgatgttgggctcagtttgggcaaactccttgagcaagccagaaggaatgatagaagcctcaagatgtgttcctaagaagaccatattctcagtcataggcctcatattctgcaaatccagtttcaaatggattttggtaattcatctcattagaaatttttattttagttctgatcctaattacagagatctcagaagactgttctaagagctggttaaactatttacagtagaatttttttttcagaactacaaaatactctgataacatttttaaaattccaaatttataaaattgtttatgtttctacatatcagatatttagtatgtttctagcaggactggctacataatttgcaaggtcacttttcatgaattattaagaatttcaaaatggtgacagcagagtattaaaacaaaagagacttggggctgggtgcggtggctaccgcttgtaacccagcactttagaaggccgaggtgggcagatcacttgagcccaggagtttgagaccagcctgggcaacatggcaaaaccctgtctctactaaaaatataaaaaaattagctgggtgtggtggtgtgcacctgtaatcccagctacttgggaggctgaggcctgagaatcgcttgagcctgggaggtggaggttgctgtgagatgatatagcgccactgcactccagcctgggtgacagaatgagaccctgtctcaaaaaataaaataaaataaaataaaacaacagagatgtgtctgagtacagccctgtgcaaccacataggctgaacacccatgaaaccagccctggttccaaggaataaaatcggtttgagcactggagaacttcttttcaacacagccaaaggggcatatggtagccacagggtggaggtgggggcccatctggatttgagttgcacaagcatctatatcatcagtaggtagtcagttcttggaaattcaaatgagaattcaaagtgaattgatttgaaatttttaaacaagccatctctcatctcctttgaaatgcacacaaaaatgtttgggatagtgtgactaaggcatgtttggatgcaatagtatgggagcagcatgtcttctgcattctagcctaggataaaagggtatcaggaatctggtaactgtcattgtatttatcatcaggagcatcatttactaagggcccagaactgtgcgaggcactttagctacactatcgaatcttttggacaataatgtgaatactcttggtttaagtgttgaagcaagacatatttaagtaagtcattgatggtaacttttcaaatcattaatcaaaatgcctatcaaattattccaggtcttgttttcattgtctaggatgaacaagcttcataatgaggtcttgagtagggtctgagtccacaaatctagttggatccagacgttttggtaaaatgttacctgtgatttctttgcattctaccccaaccttaatgtatgaaaaaacagattagtcaagtgccaaggcagtaactagaaggaacaaaaagggctgtcatgaatataaattgagaaagtgagactcctccaaacagcaggagacagaggtaaactttcattgcaggcattcactcataagcaacatcacaacatccacacacaaatctcttcagctgttgacagtctccttattctagcgctcctccccaaattgtcatttaatcatgtgtctaaacattctctgaatattgtccttcataacccaactcctgctgcttactgcttcatttgttaaaagaataatattttgattcatcacaggcattcctggaacagatcaggatgttacagacatggccctgtggctttatctcacaaatcaacagcagaaacacaggatgagagggaataattaggtttttggatatatgtctctaagaagatcacaacttagaaatgtatttttcagaatgataccatcttgatgcacacagtcgcaccaggtgaaaggaatcctctctgtttttagggatgagactcacatatgagtattcagatttctttttcatccagctatcactttctcccaaccccagccccaacttaagctccacttggaccctgaaaagtgaatactggacatggactcaagcgccagatggcttagatctggattccagaactgctgtttactggctgggtaaccttaacctccctgtgcctcagttttctcatctttaaaatgaagatagtaatagtacctatgtcacagggttgcagagatgagtaaatgggtaaaggttgtaaagcgattagagcggtgcttagcacttgacaagctctgtatgtatttattgttgctagtgtttttaatcaatacatttattgggcacttactggacaccaggcatgattccccatgctgcggattcagttgtaaaaaagaaggatgaagaccttgccttcatgttatttaaactttcattctagtgggttaagagtaaataggtaagtgaataaatgaatagtgtcacataaggataattgatttgaagaacatgaaatagcttgaatgggtgtggagacctgttttaccctcagtggtcagagtaaaattatcctaggaggtaacattgaagctgacactgaaaaaaacagagggagagaacactataaaggccaaagctgcacagtggtgacaagctgggtttggtttgttggaggaagcagttggaggccattatggttggaatgtggtagacaggaaggcaatcaagaaggcaaggccgctggccacactgagtattccgagtacaatagaccacatctggccaagttctaagtctggaatgagacacttcagacttggcgagaggatcctccttcttctgaaagccaccagcttcctcctaatgccactgtttctggatacgctggctaggacagtgagctcatcactgagttgattcctgaagcgcaacccttgattatttttttgtccaacaccccatcctcatgcactcattttagaagaagaaatagcacaatatattggcatagtacttggcttgatatcttgtttctaataaaagatctgtaatagaagtctcgaaatgtcacattgcagtctacatctaccccacagacaacttctgcatttatcaagtttttatttttaaattgaatttgttgccaatattttaaaataagattttatataaaatcggggttcctgccttctttaaattagagtcagaaggcagagtcccagattcccgtaaagcagctattggcttgagctgagcagctgctccctttagccacagtccacactactctctattgtatcccaccaggcctgcttcattcatgtcccttccctgcttggttcatcccactgtcctggccttaccagcctcctgcgttttgcttctaatcttatgtgtctgcattgcaatgtctgtggtcagacagcatccttggccttccggtcacttgcttgtcctctgagttaggaggttgtgcacatgatgtccattttccttgagccttggacctttcctaaacagataccaatcacactgaaccatcgttattgaaggagcagtgaggagccacctccttctgaggagaaaaaggggaaccctactacaagagctaatgagttccaatgcacacaagttgggagtgttgtcgttttttttttagaaaacaagatttaatgaagctttaggtttgcagggcctacctaatctggaaaaataaagaaaaagcatattataacagtgttaagagaaagagcagagaaaagcagaggccccttttgctagtgtacgatacatctgagaagcgtgaatgccagcctatggagagacccatgcgcaggatcccccaggagctagagagaaatttcaatgtgagccagttaaggcaggtgtgtctttgctctgcccactgcaccacaatgcccagggcaggagtttgcatgtccagtgcattcatattttcagaacaaaggcagtgacttggaggagggaaactgggccatgaattaggacttgtagcttctggtcctggctcaccggcagcccttgcacattttttctactgttaaatgggaatgatgttactccttatgactttctgctaattggagaatggcaaaggcatataaaaatctttcacagagcagatacgtatttcttaagatcacatgtaattacaaagaagcagatttttttggtatatatgcatgtacatatatgtatatatatttatgtgtttgtgtgcacttatcctctctctttctctctttcatgaacacacatcttagataatatttgggagcttagtgggtagatgagttggggtacccagaagatatgattccatgttctcatctttaatatcagagagctggcctgtttgccagaaacgaagttatatcagtaagactggagggtgtgaccgtctggaatgtgggttcacatgatttactgtctttcctgtactttcattaagggccaaacccttgaacctggtgttatggagaggcctgagttctctatcagtccaagctaacctaatgccatgtgattttagttacataaacaatttattgctccataaccctatttcttacactccactcaagagcctccatttcaactgctcacacggagacagagggcacatggccgtcccgaggcagaggagctagcagtggtgtcagtcgggtacatggaggtatgtcctgctagactcaggacagaccactgctgtcacatcaggccaggcaggcctggggtagggaaaaaaaaatccaatcattttcatccctcacgaaagaaaaatactaaaaataaaaatctacaccatgaaaactagcaaatataaaaaatggcagctatgacatggaaaatgacaattttagagcaattataaacgaaaggcagagagccattaaagttaaggcaatgttattaaaagatgtgttaattttcagttaaattttctataaaagaccaattagtttaaaaggcttgacagcattaactgtgaaacataagctccggtaattatactttaaaaaaataaaaagaggaggatgcttgggcgggttacacttgcaggcacagcggggcgtgggccaagcgggctagatggcgctgtgggctcaggtttccctgttacagtgccttggtccctcccctggcatttcatggtttcctcagtgtccttttacaggacctgagaatcatcaaactttagaggccaagcgggccacccttgtgttctgagccagctctcagagattagaatcagaacgccgagacacccggagagggaattgtctaaattggttgcattgctagttgatggttctttttataaactcccattttttgagtatgctttgtctatcagaagtttcacaaatcctctcatttaactctaatctataaatttttgttttgttttgttttttcatctctgttatatggatgaggaattcaaggcagagaaaagttaggcaactttttcattgttgtgcctattggatagcaaagcaggtattaaaagccacactaattggatttggaaatctgtactcataaccagggggccacgttgccttaatcagaagaagggcttcgctagtcaggtttgcaaacttgtccttggcagtgggaagagggactcctgtattccttagactatgcgggttccctgatcccaggctctgaacaggaccctaactcagctgtcttatactcaatgcccatgtgacgcaaggatagatattgagaaggtctctgcctgaagcatccctgaagactaaccctgccagagttggaggttctatacaagagcttcccagaagacttctagcacaggtatcatggtaaggcacagaaaagactggcaggacaaaagcttaggaggcaaaggatctcacctacatgatcctgcctttagaatgtttcatttcttcaattttagcatttatgttaacccagaaaaaaatgtgtgccttctgggtcaggtgagttgtagagaggtttcctccgcaggaagcgcctttggtaattggcatttgaagttctagcacctggtttgccccatgatgcagaaacagccatcacctatgcagaaagccttggagtgatgcttaattgcagactgctgaatgctccgtgaagtgccctaccccaaccctcactcccatcacataaggaaatttgcatcctccaatatgactgacctgacacccttttccagaaaaggcattgtctttccaccaaattattcagatcctgaagagataggtgtgcagagcacacccgtcagcaatgctcagagtccttttctgcatccgaatattggggtatcaaaacaggagcaaaagcatctgctggcaaaaatacatcatcattctctgtcatcacagattctgctgccccacagctctgctcctggatgcctgcatggaaaaatcaaggagagccatcatctgggatgcagtgccagctcagagagcagacaattatgctcagagatatgagtggtcccagagttgttcagacacctgtgaaaccctgggactgactatgaaattgtacctgttgatgagcaattctaaaagtcatgcactctttgactttcacacaatttcaggctaaaccaaggcccaacgattagtaggtgctcaataaatgtcagtgactgatcaaaaagatttgggtataactgatttcaacacagaagtgggaacatgttagggtcaaatcccaaagatttgacaaaacaataacctcccagcctgaccttctagatttatcattgcaatggataacctatagtgccctttgtttaaaaaaaattgactgtgtttttattagaacagttattcatacttcttgatgaaaatttggaaagcacagaaacatataaaagaagacatataaagaagaaacatataaaaataaaaagaaaacatataaagaagaaaatataaatggcctatgtttccaacaccaaggataagcatggttaatattttggtgtctttccttctaaatggatggataaatacagaattatctcattttataggttggttattttttcccttttcagttaatattttatccagagtattttattatttccttaggtgtcatgatttgcagagcctccataggactttatgagactccagtctgtggatgttccagaatcgatttatcactaaatttttggctatttagctttaaaaaatttttgttatagcaatgattaatcctgtaataaaaattattgtacataaatctttgaacaagtagcaacttattatattgaggcaaatgtactgggttttttttttttttaacaaatagggacattttaaaatttcttgatacatattgtcatgatatctccaagaaacaattttaccaatccacactctcgtcatactgagccatctcatacattatggcaaatgccgattgtcatttttcctaggaggccctttaattgtgtttatgatagttttgaagcatatcagtttttaatctgtatataatgatgtaaatacatattttatatagtgaattcagtttttatgcataaaaagtgcatgctgaacatgagaactatcaagcatcttgagattaaacagtttgctatatttttgtgaagttgtttgtggctacattttttgcctttaactatttagtaacatttactttcttttttacagaaatttaaaataaatgtattttcacagcagaaaatatataaaataaaattataggaaaaaaaccccaaattctaaaaccaagaattaactactaagtagaaattttgtgtactacttacagttactttcacataaatacgtctatcagttcaggtatgcattatttttccctctggaagtccccaaatcagagcattatgtactttttgtaatactttatggtagaaataaatgagtgaccataataataaacaggatatcattttctgataactttccattaaacattgaagatttatatttaaaaaataattcaaaaagtaataagtgcatgatttgttatattatgaaacagtgtacattataaagtttaataataaaaatgatctctacattttataaacatatgataattgaaaacattaaaaggaatcattagtatgaaaaagccaattaaaagtaatattaaaacttaaaacccagtaccataaagattcaatatttaaaagtgggtactcttaaaattaaattttaaatacagaaaaagttaatttccctagccaatagttttgcaggtatgcatttttaacatgaattgtgattcatggtgttttggggatcctacttttaaaaaacattttagtattatataattattaccatgccattaaatattatctgaaagcacaatattcatgtctgtacaatatgagtcatgtcaaagaaccattgtttaatcattaccatattgttgaaaaatttttatcagagagccagtttcccccaaatcattcattgagtaaaatcccttccctgtggtatgcaatgctttccttgttatactaaggaatggatcagcaaactgtcttgtaaagagccagatggtaaatattttcagcctttgagggccacatagtctctgtcacaactacttaactctgagtttgttagcaccaaagcagccccagacaatacataaacaaatggacatggctgggtcccaacaaaaccttattttaaaaaagtaatggatggcagagcaagatttggcccaagagccagatttgccaacttttgtattaaggtcttataactactaagctatggttctcataaatccattctggttgatcttctaatttttcacattgtctacaatatttggttaggaaacctttaaaatttactatactacatgagaggacaattttgtacaactctttccaggggaaatttagcataattttatcaagttttaaaaagtccaattcaaatctgcaattacacatatgtcaaacaacaattttactggaaaaaatgacattaaatggcctatttacatgttaaggaacatggaattttccttttttcctaatactctcctctgtctcttcatagatgattactactttgctttttgcctaaaaacagtagcgattcttattcacgtccagtgattggtattaaagagagtatctggaataatactgttaattctcctatgtatctgacattttattctccttatttctaattttatttgtgttttttcagttatattgtcataagtttattttttcaaggaattatttcttgaatttaacaattcactaaatatcctcttgctaattcattaactgacacttttcatcctgcttttttttaaaaaaagaattcttttaatacttaattttacttattataattctgttgtatttaataatagcattaaaggctctgaatttgtctctatagcattggcctcaagacatgatatttttatatgtcattctcaaatattctttaattttaaaatatttcatattctaagtttgatttccatcttgacctagtagttataggatacttaacaaaatttttttgatgttctggaatatttacttttgcctctattacattgtatttaatttttaaaatgtaggttatacagcttatactttgttatatgtattgagatttgatggttttggccattgatttttttttttgtaatcgttgttacaaagtttagtaaaaatacactaaatcaacctgattatatcctcaattttcttatcttttgatctatttggcctgtaaaagctaaaaacagtgatagtgggaatatttcacgtattacccttagtccagatttattctagtgtaattctaattagttttgctttctatatttcagttataatatttgtccataaaaaattatagctttattgtgtcaactatgaatataaaattaacttatctaacataatagtttaaaatttttctttgaagctatactttttttcttccctttttctcttttaaagatatcagagtttgattttggcatttgaacaagtctgaaaatctttgccattttataggatcatttagctcatttatgtttagttatataacataagatgctatagtcttgcattatgttttttacatgcttctatcataattatatgttttatgatccatcttttggtatgtggactatattttgtatgcttattttctgtagtgtaaactttccattctatttttaactctagttagttgttaccagccattctatagatgtattttctaagtattattgtctagaaaaatttagtagttcttgattcctccttgtataagatcaggcaattttcatgcctttatttccatcatcatctctatctcatctcatttttctaactttaaaacataattttagcaatactatattaatagctagttttgtcatttttttaataattagttttgacatttgcattccattttgtaataatatatacaataatcttttacaattctgttttaaatatattttaacagtaaaccaaatttgctcatattttagttactaagggtttaaaattatctttaaagaagctaatttttgtttctaagtatttaaaaaaattaaatcaataaatgcttatgtacgcaaagagtcaaaaaatatttcagttgccttcacaaattattggcaatttaactatatgtagaatttttggaacaaatgtgtcctgtcaaaattcctttgacattcctcttacattttctagagaagcttcagcctagccttattttatacttgtatttcttacagcattgttttaggtcatttttattctccatttaatattttgaattcaaatattcaccgagtacaggtctaggagttggccacattaacttgctgaatgcttttgatctgcatcctagattcatttcccagctcaggacaggttatttttatttgtttgtttgcttgttttacacgcttgcattttgtttacaactttgatttgtaaatacttactgtttatcacttgacctttgttgtctttttctcaatatcaaccagcactcttattaaacaaacaaacaaaaatccctatatctttctctatttagcttagaacttcctggttttacttccgtatcactaattgtgtgtgtgtgtgtgtgtgtgtgtgtgtgtgtgtgtaattttcacctctaatactcatggctccttagattaaaaagttggccagtgcaaatttagttgtcttttaactatttattttaaaaaaatgagacacaacatactatacaactcatccatttaaagtgtacgattcagtggttttttttttagcatattcacagacatgtacagccatcactacagtcaattttagaacatgttcatggcatcaaaaagaaactttgtattttagttatcctaccctcccctacaactccacccatcaacccaccaaccctaagccaccactgatctactcattatttctgtagacatgccttttctggatattttatataaatagactcttgttgcaggaagtcagagaccccaaacggagggactggctgaagccttggcagaagaacataaattatgaagatttcatggacatttatcacttccccaatcagtactcttaataatttcctatgtctgtctttaatctcttaatcccatcatctttgtaagctgaggatgtatgtcgcctcaggaccctgtgatgattccgttaactgcacaaattttttctaaagcatgtgtgtttgaacaatatgaaatctgggcaccttaagaacaggataacagcaattttcagggaacaagggagataaccttaaagtctggctgcctgtgggctgggtggaacagagccatgtttctcttattactgaaaacaggtaagagaaatattgctgaattctttccccagtaaggaatattaataattaacaaccctgggaaaagaatgcattcccaggaggagcctctaaaatggctgctctgggggtgtctgccttatggagttgcagataagggatgaaacactccctggcctcctgcagcgcccccaggcttgctaggattaggaaattccagcccggcaaattctagtcagaccggttctctgctcttgaaccctgttaagatgattatcaatgacaacgcctgcacagcaggacatggaagttccttaataattctagttttgccctgaccttgtgatctcgccctgaccttttgccttgtgaccttttgttgcccttgaagcatgtgatctctgtgacccacaccctattcatacactccctcccctttgaaaattgctaataaaaacttgctggttttgcggctcagggggcatcatggaacccgccgacatgtgatgtctcccccagacacccagctttaaaatttctcccttttgtactctttccctttatttctcagactggccgacacttaaggaaatagaaacgaatgtacattgaattatcagaggtggtttgtctgatagactctcagtacaatgtgttcaaggttcatccatgttgtagcatgtatcattgcatcactcttttttacggccaaataatactcattgcacggatataatacattttgtgcatgcattcattagctaatggaaatttgggttattttcaccttttgggtattaccaataatgctgctataaacatctgtgtacacgttttcatatggacatatatttttatttatcttgggtatatactgtaagagtggaatttctgggtcatatagcaacacaatgttcaaacatatgaggaactgcctagctgttttccaaagtgactgtgtagcaggacgagctgcagacaaaactcctcagacaccgagttaaagaaggaagaggtttattcggccagcggcattggcaagactcctgtctcaagagccgagtatcccaagtgagcaattcctgtcccttttaagggctcacaactctaagggggtgcgtgtgagagggttgtgatcgattgagcaagcagggggtacgtgactaggggcggcatgcaccggtaattagattggaacaaaaaaggatagggattttcacagtgcttttctatacaatgtctgtaatctatagataacataaccgattaagtgcgggtcagtctttaactaccaggcccagggtgtggcaccgggctatctgcttgtgggtttcatttctgccttttaatgtttactttttctttctttggaggcagaaattgggcataacacaatgtgaggggtggtctcctcccttaactgcaccactttacattcccaccagcagtgtgtgagagttccagtttctccttattcttaccaattcttgttattatcatcagtcttttttattacagctattctagtaggtgtaaaatatctcattgtggttttgatttgcatttctctgatgactagagctgttgagcctctttgcataagtttattaaccacttttatatctttttggagaaatgtttaagtcttctgcccgtttaaaaaattgggttgtcttttttggttgagttataaaaggctttttaatactgaatattagacccttatcagacatatgatttgcaaacatgctctctcattttgtaggttgtttttttcactttttggatagtgtccttcaaagaacaaatattttttaaatttttatgaagtccaatttaatctgttcttcttgtagtttatgctttttgtgtcatgtccaagaaactattgccaaatcaaaggtcataaagacttactcctatattttcttctaagcattttgcagttttagcttttacatttagatctttgaccccttttgtgttaatttttgcatatagtgtgaggtataggtcccactttattcttctgcctgtggatacccagttgttgctatgccatttgtttaaaagactatattaacttctccattgaatggtcttggcacactcactgaaaattaatagatcataactgaatgagtttatttctggattttcaattattttccattggtctataggtctatcctatgccattactatcttgattactatagtcttgtagtatgttttgaaactgggaagtatgaaacttccaacttcgtctttcttttataaggctataagattgctttggctattttgggtctgttgcagttttagagtcaatttttccatttttacaaaaaaatggactttgtgattttgataggtattacataaaatctggaaattaaggtagtattccatcttaataaatcaagtcttctaatccaggaacatgggatgtctgtccatttatttaggtcttctttaatttctttcagtaatattttgtagtttgcagtataccagtcttgttcctccttcaatatatttatttctaagtattttattcattatttttctgagacagaatctcactctgtcacccaggctggggtgcagtggcatgatctcagattactgcaacatctgccgcccgggttcaagtaattctctggcctcagcctcccgaggatctgggattacaggtgcccgccaccatgcctagctaatttttttatttttagtagagactaggattcaccacgttggccagcctggtcccaactcctgacctcactcctgacctcaaatgatcctcccaccttggcctaccaaagttctgggattacaggtgtgcaccatgcttggctgacctcccattttctaccacatcgagtttaaaatcccttgcttggtttttaaagccctgagttccccacgcctccaagaaaacaaagaagattaaaaattcaaaggaaagttgagaatggagctgactgttcctctacttggcaaaggcctcatgtctctgatatgaggccaaaatgtttatcagtgcttcctgtgcaccaagcatgtttctaagtgcttcatgggtaggtcatagagccccacagccttctattattacattttacagatcatgaaacggaggcacaaaaatgttaaataactttccaaggtcacacagcttctgagaggtgaagtcagcattaaacccctcagcccagctctggatccctggatcccataacctctccagaaacatatcctactttaagtatcctttttctgcttctgtgcctaagggcatatcttaactctgagcataaatttcctttagggtctggcaggctatggataacattcctaaattcttttgcagttggaattttgtatcacaatgggtgtttttgtaagtatttcaatgaggattgtgaatccagccccgctagtaactatcatcttaattcagaagtcctcatggaattatgtgaatataaatttggttttaatgaccactgttattttacagacgagaaaaatcaaagtccagaatgactaggcaacctccaagacatagaactagttagcaaacctgggatgggaacttgagctcacccttacttggtttgttccctactatgccttgccagctaaactctctaagaagctgctgaggtgcaattgcatctttccttacctctttccaaagtgcatcctcaaaagccacaggcaaactttgatttgagttttttagcctgcttgatttctacttacataggaaaatggaatgcacacccttacctgagaatttctcaaattaggctggtgacaaataccttttaaagctcctttatttgacatcctattaattttttttaaactcccattcttttgttcctgacagatctgttatgtttcagatgtgacacaaatgtacacttagagggaaacttctttaataagtgatatttgcctcagactactgaggttattttagaaaacaaaagccaaagtacacttaccaggacattcaccttttcataaatttatccggcatatttaattgatcgagatttctgagttagacagttatcaacgcatgtggtaaatcgttaagcgtgtggcattaatgaaaggttttgccgttgtcgtggggaggaagcttcctggcacatggatgacagggcctcagagacaatgctgcttgggttagtagctggggcaggctgcattttattacacgtgtccagaatctcatagtagtcacgtagactttaggagggggaggcaatatttgtatccctactaaaaccaattatggcaaacactaattattcagatttgagccctttactaaaaaatcccctgaactgggttttttaagtcaggctgtcgtagcagagccaagcaagagagaaaataacggaataattggaggctgctgtcttttcactccccacatgaaattatttgaagagacaggccagaactttaaacaggagataccaagaaaagttgtaatttggatgtcggctgtcatgactttagggtgtttgcttaaaggacttttccctcactttctctccttccccagacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggtgagtccacagcaccgaggtcacctgagcttgctgtttgggaaaagcttgatcctgaagaacgtggtatcagatgtgacaagctaggcatctggcttttctccttcctattgtagataactgtaagaggtgatatttatttatagtttactctggatcagacactttgctctatgcatagtcattcattttaatcttcatagcaaccctttgatataagttctagtatcacaccttctaagtcaactgaggcccagagagaatgagcactagacctattgggaatttgcaccaaggcatcctggcttcagagccagtgggctttctccctccttggtgttctcttcacgtatcctctgcacaaggtgagaagcagcaggtgatgccagcatgcagccaaggttgggaaatatttccacaggctcttagcgtagcttagggatactcaacccaactatacattaatagcacatggaggtggccagcctcagcctgcaggtttcttagtttttatatgtgaataggacccaggcactggtggttttcaaagcaccagggtagtcagtagtcagatgtatccagaaccaccggccaaacaaaccgaatcttatgtggatcctttaatgcctgtaaatcaaaacctagaccttgtaatttctgagagtggacccagtcacgttccctcatgtcctccctgtgacggaagtggccagcgtctcccttctgattccatgtatctgcctagtgtaggcactgtgacagaagtgtgctgtctttgcccttattcccagcccaaccccacagatgcatttaagagatgcagccataagtcacagaaactgataaacctgttacacaaacaatggtgtcgcccagaaagactaaatagtggaaaaggagccaaggaaagggtctgtctctgttttttctgaaacagtgctgcatactttccccatattttagtttgatcatggactgggacctatgttagactaggctttttttgaaagggaattttcatagctagtggctctttatacctatcatttacttattgatgcacttgattaggataaagactttagataatggtaagatttggtcccatcagtgttctttggtatgagaccaatatgagaattccaatgattggaaggacaaagacagtcattttatacccagtgaagccatcccgcagtgcccagtgcccttcatataatacaggtaacatctacctgaagccacctggccgctgaagccagcatttccaagtggatgcatttgctttcactttctgcatcaggccccagaccccgggaaggtggctgtgaactgatcagaactgcgaatcctagttattcagcctgcagacccctggctcctagggaaacacattctcttgcacccttgccatctctgaggtctgtaaattgtgcttttcacagggtccttacctcctgaaagagtctgtcaccataggacctggtggggtcctcctccttgcggtggttttcattatcactcagacagttttgacaacacgagcctatcacagcggttacagctgagctgggactgaacataatcaccattttgcagagaagggttcatctcctcagctgagcatacatctgagaccatcaagctttacactttgacttaaagtgagggagaagcataatctccttagagctttcaaaccccactgcgacaggtggaaaactggagagacaccagaggaaaaccccattgttacctgatccctaaaaatcacacatattgggtgtagtctgttaaacatgttgacttcttccactgccgtcccttggcacatggaccctccaacttgggagacaccaaaacaagctttgatgaaaagacccgtttccctgctgtcccttgattttcaggcaaataaaaaggatgtttctctctgttcttttgctgtctcccaggatggtggttgttatggtgatctgttctgcaaagctctgaaaacatataatatgctttgttttggaatttaccggctgagagatgctcacctcagcacccccagtcagtgcacaaagaggtgagtattggtttcaactctgccctcccacctaatcacagaaatattaatatcctttcctgtcccctactgtaaaggcaaaggtctgtatacatctcctcaacatgcaaattactctgcccatattaaatccaacactgagtttggaggtgatgggaagcatttttctataattactaatagtagatgtaaagacattttggtaagaattcaagttttgtattaatagaataattccatcacctaattacaaaagtctgaatacacaaacatctctcccaaactctagctactaggataacatctgttggtacctaatatagagatattttacattgctagtgtttaagataagtttttttgtttttttgttttttgtttgtttgttttttgagatggagtgttgctctgttgcccaggctggagtgcagtggcacaatcttggctcactgcaacctctgcctcctgggttccagtgattctcttgccttagcctcctgagtagctgggattataggcacacaccaccacacccagccaatttttgtgtttttagtagagagaaggcttgttggccaggctggtctcgaactcctgacctcaagtgatccacccacctcggcctcccaaagtgctgggcttacaggtgtgagccaccacaccccgccctaagataagtggttcttctgccatatctcagaatcccatatttttacttcacatattttaaattgactcgctttttaacttttatatatttatttttgagacaattatatattatcaccttaagcagagaaataacagtttagatgtgccaattatatttttctcatatgcattaaaataaattcatagcaggcaaaaattaaaagtacatcctagaattaccaagatcagtgagtttgcataatataccctaggcaacagtgctgcagagacaagcgtttctcatccctgcttgcatagtagaatcacctggggagcttttaaaaaatattctgattactctaacttaactggtctggaaggaagaaaacatcatatatatattttaaattatgtaaacattttatatataataaccagggattatagtgtatagccagaattgagaacaattgctatagaccagtgggttctcaaaatttagccatcatgagactcacctgcagagcttgttcaaccacagattgctggaccccatcctcagcacttccaattcagtaggtctgggtgggattgcttaagaacttgcatttcctagttcctaggtgatgctgacctgtgtggcctaaggaccacacttggtgaccactgctctaagtgaaacagcgtgattttcttagtcacatctgctgttgaccaaagaaagctccaactaattgtgaagaacaacaaagtagtgctgataagtaggcaggtttcttagattcttccatgtggtgaattccaaattccaaattctctcaccaaagtagattttaaaaggtaaagagcgagaatagtctaaggagacactctgtcatggtaaacaaagatcttgtgatgtatatctgggattgtccgaaaattatgaaatgaaagttgcatcacacttcatgaaacctcttgcggttgggctacttgaaagtgactttgaccttgtatagaaaggtacatgtagaccacgagaagcgaagtttggttcttccattactggctctaattccacatctctgcctgggctcctggctggcctcctttattgagttaaacagaggaagtttccatttaacaagaaaaagaatgtttaaggcctcagaccagctaggagtgcatcttccagatcctctgaaagtcctgagtaaccaggccattgcttttggttcagagagagttgaattctttactcagttactctcaggaggtgacatctctgctttccctgtccaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaatttta

SEQ ID NO: 38682 - DNA, 37129 bp, Homo sapiens
cgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgccgggggcggcagcagcaggcacgagaagagcctggggctgctcactaccaagttcgtgtcgctgctgcaggaggccaaggacggcgttctggatctcaaagcggtgagctccggaggcggggacgggggcggacttcggaacccgtggcccccggggaagcccagcccctcgccgcgtgggtctagcggcgtggtgtagacgcgccttgcggggacccgggaccgggcaatccgaggaccatgtggcctgcgcccgggtcgtggacgccgggatgggggagggacgagggaccaggatggcaccgagcggacgcgtaaccaatggggcccggcgccacgctgggctctcgacaaagagcccaggacctcgagcgcgcccgcgtggcttctgtctccgggcgcagggacctgagggtaaccgagtgtctgttgctctgcgtccacctgtggcagaggctcacggggtaacgggcgctttgcccggagacaccgtggatatcgattttgctgttaagaatggatggttttaataggcgattccagttggaaccatgttcctgtagtttaaataaaaaggaggaaaaacaaaacccagtctgccatctctaccagatgaaagaaaaaaaaaaaagagtacttctttccacgcccctccccgataaaatagtattaaatcttccttgtgcacttctttcatcaccctgatagttaggaggggtatttgatttgtgacttcatttggcatgtgtcatgggtttccaaaagtgagatctgctgtcacacgaaaaggggatattttacaactttcacccaaagaggtggaagtgctcagtaaactctctccctgcgtcgtcctttacagcgttcagatttttcaaacaggagcaggcatcaaaagctgttctgtcatacagaatgacttaaccgatctaggaaggatttggaagaattcaacagcgctcaggataatgagaatgtggtcactccgcgcgaagtttaagaactaaagttttagaaacaaacaaacaaaaaacactaactgcccaataatcactgcaaatcccctttgactccctaaatgtggccttacttggaggattggccccagctcccaggggagtgcctggaccaccttacctggcttgagagtgtcactgcatcctcaaggctctgcataaagcagtggcagctccctgaatgtaaggaccaagacttgcaggggccaactcttctgctagaggccctcctccagtgtagcccaaggggaagtagatcttttcagtgccctctcctttccctggatgtagttggtgttcaatcagtgattgttgaactgaattacctaaattgttcaacttcatacaactgaggcatgctgcacatattttgcattttggtaagtaatttctactattttctttttgatatgttattcctggaatttttttcccacctctggaaattccttgttctcttttttccaccacagccccttcttcctttctctccctgaaagtgatttatggcatgtgtagtatttaaattgtagtgaattaaaatggattctgtttaaagaatttcacaggaagtcatgaagttatcagagaaagccaggaatgttacaaagcacaggtggcaaactgctgttcaaaatctagaaattcagctgtagcctgtgactttggtgtaagaaaatcagggaagtttggggttttccaggtaaaactgaactctgacggctggactttgagggcttctccctcagcttgcctcaggatatggtggaactttgccctttcttgacttgaaattctttagcttcctcctgtttcatctgtggctatataattgccctacagaagtcacagaggcagtgagtaggatgtaaagtttggtatttcatgacaataattgctttattcattctggaactctcctaaaaattcaaaggtttctacaataacactgtctcattatattaatgacttcatactcctagaaaagagtttgaatgtctttagttttcatatatatgtatgaaaaacatatgttttatgtattttacgtatatttttcatttatttatatatacttatatatgtaaaaatcttttttttttcttttttgagacggagtcttgctctgtcgcccaggctggagtgcagtggcgcgatctgggctcactgcaagctccgcctcccgggttcacgccattctcctgtgtcagcctcccgagtagctcggactacaggcgcccgccagcgcacccagctaatttttttgtaattttagtagagacagggtttcactgtgttagctaggatggtctcgatctcctgaccttgtgatccacgcgcctcggcctcccaaagtgctgggattacaggcgtgagccaccgcgcccggccaaaaatcttacattgaaatctttccaatgatatttcttattatacaccatagtaaaagatcgttaaagccttttttttttgagactgagtcttgctctgtcacccaggctggagtgcagtggcagatctctgctcactgcaacctccacctcccgggttcaagcgattctcctgcctcagcctcccaagtagctgggattacaggtgcccgccaccatgcccgactcatttttgtatgtttagtagagaaggggtttcaccatgttggccaggctggtctcgaactcccaacctcaaatgatctgcttgcctcagcctcccagagtgctgggattacaggcgtgagccaccatacccagcccattaagacatgtttgataatacatattaaagatggactcacactgacaattataaatttcctctaatttgaaattataaagacacattttctcttgtattcttactttggtgggggcatatttcagcataatttttttgaaacttttaagttatacacttgacttttaaacgcagttaaagaaactatacatatatatatatatatatatatatatatatatatatatatatatggttttttggttggtcttgtttttttttttttttttttttgagacagagtctcgctctgtggcccaggcgggagtgcagtggcgcaatctcggctcactgcaagctccgcctcccgggttcatgccattctcctgcctcagcctcccgagtagctgggactacaggcacccgccatcacgcccggctaattttttttgtatttttagtagagacggggtttcaccatgttagccaggatggtctcgatcttctgacctcgtgatccgcccgcctcggcctcccaaagtgctgggattacaagcgtgagccaccgcgcccggccggtcttgtttgttttttgagacagggtcttattctgtcgcccaggctggagtgcagtggtacaatctcagctcattgtaacctccacttcccgggctcaagtgattctcctgcctcagcctaccaagtagctggcactacaggcgtacaccattatgcctggcttatttttatatttttagtagagacagggttttgccatattgcccaggctggtctcgaactcctgagctcaaagctatctgcctaccttggtctcccctgtgagccaccgcttccggccttgaagaaacagtttttgaatatcccaaagaataaaaaagtatatcaaacttcaagtaaaatatccaaatattttggatatcataaagtatcctagaccacatagatgctatttcttttctatcttatgctgctggagaataagaacgtaaggttgtatcttagtgacacatttcttctttttttttgagacgggagtctcactctgtcacccaagctggagtgcagtgtcgcgatctccactcgctgcaagctccgcctcctgggttcacgccattctcctgcctcaggctcctgagtagctgggactacaggcgcccgccaccacgcccggctagttttgttttttttttttttgtatttttagtagaggtggggtttcaccgtgttagaatggtctcgatcttctgacctcgtgatcctcccacctcggcctcccaaagtgctgggattacaggcgtgagccaccgcgcctggccatttcttcttaataatataactaattgaaaacatggctcggtcaggcgtggtggctcacgcctgtaatcccagcactttgagaggccgaggcgggcagatcacctgaggtcaggagttcgagaccagcctgcccaacatggcgaaaccccgtctctactaaaaatacaaaaaaattagccaggcgtcgtggaggcgcctgtaatcccagctacttggcaggctgaagcaggagaatcgcttgaactcaagaggcggaggttgcagtgagccgagatcgcaccactgcactccatcctgggcgacaagagcgaaactgtgtctcaaaaaaaaaaaacatggctcaacatagaaaatcaattttaataaagctgttgtagtataacttaacaattaggaagcaatagaaagacattgaaagtgatgtgaggaaagtttattcattatctctgcagcttcacctacaccatatagtctcatttacaatagtggaggtgggatagttattatttctttattccagtgagataagaaattatatcatggttatttcaagctacgtggtttgccagtttatgctgttaatagctaatatacatcaagagcttaccatatgcaaaacattttacatgtttttagctaatgttatcctcttaacaacagtgaacatttcggcagaacagccccatttcacagcgtaagaaactgctagttaagtaggccaagataggttagataacttgcctggtgttgtacagtagaaagtgagagctaagatttgaaattagaccatttattgttattctctatgttataccatctttcagtagtcttcaaaaataaatgtatgtaggtaggtttccatttgcataagggcatggaaaaatgcatgattattcttactcctctgcccaaggtggaaaagaaggaggtactgtgctcctgaaaatgaagctattggtgacatattctgtattattgcataaattaaactaggatttcacttgttcacagttaagaatttgaacaactgttaagatagtcatgactatgtatctgtatgttgttttgaaaattcctattaaatgtaagttataactaaagttctacattttatttgccattttggtgtcagtatgagcttttttaagcatgatgaagattgcttatctcttttattataattctttaacttaataaattacctgaattatacctgaattaatgtgataaagtatggtgcgtcttatctgacaggtccctgatgcatacccgtttatgagcctgatttagatacatcctgggataaataaataattgaagacactagtttggccgggcccggtggttcacgcctgtaatcccagcactttgggaggccgaggcgggcagatcacgaggtcgggagattgagaccatcctggctaacacggtgaaaccccgtttctactaaaaatacaaaaaaattagccgggtgtgatgactggtgcctgtagtcctagctactcaggaggctgaggcaggagaatggtgtgaacccgggaggcggagcttgcagtgagccacgatcacgccactgcactccagcctgggtgacagagcaagactccgtctcgaaaaacagcaacaacgacaacaaaagaccctagtttgtaataccaggcaaacattttaaggtagaattagcctaaggagagatatgtgggtaggacagcgagaactttagtgcatgcttacaaattctcaggacccttccactcctgggtgtatacccaaagaattgaaagcagggcctcaagaaggtatgtatacccctgtgttcataacagtggcattcataatagccaaaatgtggatgcaatcctaatgtccgtcaatagatgagtagcttaacaaaatgtggtatatatacaatggaatattcttcaggcttagaaagaagaaaatgctgacatatgctgcaacatgataaactttgaggacataatgctaggtgaaataagccagtcacaaaaagataaatactgtatgattccacttacgtgaggtacctggagtagtcaaattcacaggggcagaaagtagaagggtggttaccaggggttgagggaaaacagaatggaatttgttgcttaatggatgttataggctgaaatgtgtcccccaaaattcatatgttgaaggccttacctccatacatcagaatgtgattgtatttggggatagggcctttgaaagataattaagctaaaattaagctgtgacctgatctaatctgactggggtccttatgagaaaggggaaatttggatatacaaagagatgcctcagatgctgccacccagaggaaagaccatgtgaggacacagcaggaaggtgatcatctgtaagccaaggagcgaggcctctgaagaaaccaaatgggccaatgaaaaaaaagaaaatgtcaggcccatataactgatgaacgtcgatgcaaaaatcctcaataaaatactgcagaccaaatccagcagcacatcaaaaagcttatccaccatgatcaagttggcttcatgcctgggatgcaaggctggttcaacatacgcaaatcaataaatccatcacataaacagaatcaatgacaaaaacccatgattatctcaatagatgcaaaaaggccttcaacaaaattcaacagcccttcgtgctaaaaactctcaataaactaggtatcagtggaacatatctcaaaataataaggctatttatgacaaatccacagccagtatcatactgaatggacaaaaactggaagcattcccttcgaaaaccagtataagacaagaatgccctctctcaccactcctattcagcacagagttggaagttctggccagggcagtcaggcaagagaaataaataaagggcattcaaacaggaaaagaggaagtcaaatggcctctgtttgcagatgacatgattgtatatttagaaaaccccatcgtcttagccccaaatctccttaagctgataagcaacttcagcaaagtctcaagatacaaaatcaatgtgcaaaaatcacaagcattcctatacaccagtaacagacaaagagccaaatcatgagtggactcccattcacaattgctactaagagaataaaatacctaggaatccaacttacaagggatgtgaaggacctcttcaaggagaactataaaccactgctcaaggaaataagagaggacacaaacaaatggaaaaacattctatgctcatggataggaagaatcaatatcatgaacatggccatactgcccaaagtaatttatagattcaatgctatccctatcaagctaccaatgactttcttcacagaattggaaaaaactacttcaaacttcatagggaaccaaaaaagagcctgcatagccaagacaatcttaagcaaaaataacaaagctggaggcatcatgctacctgacttcaaactaaactacaaggctacagtaaccaaaacagcatggtattggtaccaaaacagatatatagaccaatggaacagaacagaggcctcggaaataaacaccacacatctacaaccatctgatctttgacaaacctgacaccaagaagaaatggggaaaagattctctatttaataaatgatgttggaaaactggctagccatatgcagaaaactgaaactggagcccttccttacaccttatacaaaaatcaactcaagatggatgaaagacttaaacgtaagacctgaaaccataaaaatcctagaaaagaacctgggcaataccattcaggacaaaagcatgggcaaagacttcttgtctaaaacacgaaaagcaatggcaacaaaagtcaaaattgaccaatagaatctaattaaactaaagagcttctgcacagcaaaagaaactatcatcagaatgaacagccagcctatagaatgggagaagatctttgcaatctacccatctgacaaagagttcatatccaggatctgcaaagaacttagacgaatttacaataaaaaacaaccccatcaaaaagtgggcaaaggatatgaacagacacttctcaaaagaagacttttatgcagccaacaaacatatgaaaaaatgctcatcgtcactggtcattggaaaaatgcgaatcaaaaccacaatgagataccatctcacaccagttacaatggcgatcattaaaaagtcaggaaacaacagatgttggagaggatgtggagaattaggaatgcttttatactgttggtgggagtttaaattagttcaaccattgtggaagacagtgtggtgattcctcaaggatctagaactagaaataccatctgacccagcaatcctattactggctatacacccaaaggagtataaatcattctatgataaagacacatgcacacgtatgtttattgtggcactattcacaatagcaaagacttggaaccaacccaaatatccatcaatggtagactggataaagaaaatctggcacatatacaccatggaatactatgcagccgtaagaaaggatgagttcatgtcctttgcagggacatggatgaagctggaaaccatcattctcagcaaactatcacaataacagaaaaccaaacaccacatgttctcactcgtaagtgggagttgaacaagaacacatggacacagggaggggaacatcacacagtggggcctgttcagggttggggggctaggggagggatagcattaacagaaatacctaatgtgggtgacgagttgatggttgcagcaaaccaccatggcacatgtatacctatgtaacaaaactgcacgttctgcacatgtaccccagaacttaaggtgtgtgtatgtgtgtgtgtatatatatgtacggtatatatatatatggtatatacataaggtatatatatggtgtgtgtgtatatatatgatatatataaagtatatatggtatatataaggtatatatatggtatatatgtaaggtatatatggtgtatatatggtatatatgtaaggtatatatggtatatatatggtatatatggtatatataaggtgtatatatgatatatataaggtatatatatggtatatataaggtgtatatatacggtatatataaggtgtatatatatgatatgtatatataaggtgtatatatatggtatatatatgtaaggtgtatatatatggtgtgtatatataaggtgtatatatatggtatatatatatgtaaggtatatatatggtgtgtatatatataaattcctccttagttttctctaacaatccaagcataaaaaaaaatccctgttagaactgcttttgctgtattccatagattttgttatattgtttccattttcatttgttaagatatttttcagtttccctttgtattttttcattgactcattagatgtttaagagcatgttttttgtttttaaatttccatgtatttgtgaatattctgtagtttctcttgttaatgattttgtcagaaaagatacttgtaattatctcagtcttctagaatttgttatgatttgttttttggcctcatatataatctaacctggagaatgttctgtgtgcagttgagaagcgtgtgtattcttctactgttggatggatgttaggttcatttgatctagagtatagtttaaatttgatattttcttatttactgtctctacgttctgtccattactgaaagtgggctgttgaaatcccctactattgttgtattactgtttatctctcccttcagatttattaatgttttctttatatatttaggtgctgctatattgggttcacacatatttacaactgttatatctcatgttgctgaattgacccttttattattatatagtgacctttgtatctttttatagtttttgacttaaaatctatttaatctgatatatgtatagccacttctgctttcttttggtttctatttgcatggagtatcattttctgttctttcattttcagtctacgtccttacaggtgaagcaagcctcttataggcagcataagttgagtgtttttaaaaatccatttaactactttgcctttttattggagaacttaatccacttacgttcagggttatcattcataggtaagtagttaatactgtcattttgttgttttctagttgttttgtagatattttcttcctttctttctatcttcttttgtggctaaattatgttgttgtctagtggtatgttttgattccttgcctttttatgtatctgctataggtttttgctttgttgttaccatgaggcttacaaaaaaatatcttacaatgcggtattttaagctgataacaagtttgatcgcaaaaacaaacaaacaaaaagaaacctaacaagcctctatgcttttattccagtcccctcctcacattttgaatatttgatgtcacaagttttatctttttatatcgtctattgcttaaaaattattgcagctactatgatttttaatagttttgtcttttaacttttacacaaaatccagaatactttaattctgtgatgatgctgcataaattgcttatatctttagtcagtgtacttacttttaagtgagttttagactttcagattgttttgtgttactccttagcatcctttttttttttttttttttggagattgaagacttccctttaccattttttgtaaaacacttctggtagtcatgaactcccttatcttctgtttttctggaacaggctttatctcttcttcatttctgaaggacagctttgtggggtttggtattcttggctggcagggtttctttcagcactttgagcactgaggcaggccagaagcttttggcagatgtggccagcacaggagtggtgcaatctgaagccaaagttcactgagatatccctggtattgtgagctgtccagagccctggactgctgacatcagcctggcattggtgcagcccagagattgagtttgccttgaaagcctgaagcctcgggttatgtgatcctgcttggcaccaggctggatctagagcttcagtctatgcgcactagcctggaacatggggttgtggtggtctcaccagtgttaggttttactttggcaatcctagcattggagctaaaggtatggtgtctctctccttgctgtgcttcctagggttgagggaaggatgacggggtaatataaaactgcccttcttaccctcttcaatgtgacttttcttattattgtgctgcaaccagatagtgtaatctcttatatggcttatttagctcttgtgaaggtatgttatagtatggatgcttgttcaaattggtgtttctgctggggaaaattgctgaagcgtcctactctgccatcttgctccatcccttcctaaataaatcattgttttaatttcaccagtaaagactgactgtcctcaattatgagtaagtttcctcttacatcttaatatttttgtgaaagtgaggatatactttctgatgttccttttccaacctaaaatacaattactgaagtatcagtagaaagcttgggaaaaggttaatatactctagagtaaaacttgcccagtatgcaaccactcacagagaaccactgtcaacaatttttagtatttcccatttcttgcaactttttatagctgagatcaaatgtttattgttcctacttattaatattattattattatttttgaggcagagtctctgtgacccaggctggaatgcagtggtgagatcttggcttactgcaacctctaccacccaggctcaagcgagtctcctgcctcagccacccaagtagctggaattataggtgtgaaccaccatgcctgggtaatttttgtgtattggtaaagatggggtttcatcatgttggctaggctggttttaaagtcatggccccaagtgatccacccgcctcagtctctgaaagtgctgtgattgtaggcatgagccactgcacccaacctctttttccaaattgtaaacatgatttataatgtcttcataattttgatctgtcacattacccagaattaaccattcttattagtaggtatataagtttttatgtttttttcctatttcatacaatgaatatgtattcacaaatgtgtgccccgttgttctttattttagtagcttccagattataattatcagaaaaagtcagagaaatgggcagttccacgcttttcacactgtgaggggtgtttggaagcacctacctgagccttacgcttcagggagtagctgggagctgacctaggaactccgggactcaaaagccagatgtcatcaatatatatacaatttaagaatttaaggttatattatacctctacttagaacaacgttcagacacctacaagatcctgcctagtctggccctccttcctctgccacctcgtctatgcactccctcttagatgactccagtctcactgactgtctttcagcactctcacatgccctctcctcctgcctcagggctgctgcacaggtgtttcctgctgcctgaaatggacttctgcacgtgtgtgaaaacacacacacacacaccccaccaccaccactgcaccacacatacacaaacacacaactggccacttctccaaaccgtctggtcttagtttttttttttccttcttttagatgtttttgtaggcagaacagtggtccctcaaagatggtcatgtcctaattcccaggacctgtgaatatgttcagttacataggaaaggggaactaaggtcaaagttgctaatcagctgattttaagatggggagatttttccttttttttttttttttttttttttgagatggagtctcgctctgtcacccaggttgaagtgcagtggtgtgatctcggctcactgcaacctccgtctcccgggttcaagcaattctcctgtttcagcctccctagtagctgggactaaagatgcccaccaccatgcccaggtaatttttgtatttttagtagagatggagtttcaccgtattggtcaggctggtctcgaactcctgacctcaagtgatctgcccgcctcagcctcctaaaatgctgggattacaggcatgagccaccgtgcccagccaagatgtggagatttttcctggaatatctggctgtgcctgttgtaatcaaaaagttcttcaaagtggaagaaggaagaagagagtgagaaccaaagaggtggaagcttgaaaatgacctttctgctgttggaagaaggggtcatgagccaagaagtgtgatagcctctagaagctggaaaggcaaagaaatcgattcttccttagagcatctagaaggagcacagccttatcaatattttgattttagctcagtgagatccattttggacttctgatctatagaactataagataataaatttgtgctactattcaaccattaaaaaaaaaggaaatcctgtcagtttttgacgccatagaagaacttggaggatattttgctaagcaaataagccaggcacagaaagacacatgatctcatatatagaatctaaaatagtcaaattcatagaatctaagaataggatggtggttaccaggagcttggggagatgttggtcaaaagatacaaaatttcagttagacaagaataaatttgagagatctaatgcacatcgtggtgactatagttaataacaatgtattgccttcttgaaaattgctaagaaaatagaatttgagtgttcttaccacacacaaaaaaaatgatcagtatgtgagataaagcatgttaactggcttgatttagccattccacaatgtatacatatatcaaaacaacattttgtaaacaatatatatgatttttaattaccaattttatttaaaaattttgttttgtcttaaacaactacatttctggtcatttgtgacagttagcaatggaaactaagggaatacagtgtatacagatgcttgtcctgactctccttaatctgaagtgactgaagtaggttcctgcttattctcagcagcctgggtttttgccttactatcctttatcacaatatggaattatttattcctttgtttgcccatgtttcgctgtaggccagggactgtcttctgtgttaccaatgctgacccagccagtccattataagctttcaacaaatagctattagttttgagttaagtgagaggacattcctagtcagcaagacagtgtatgtcagagccaagaggtagagaaacatgtgggtacatttgagaggctataaatcagatgactgttgtgtgaagagaatattggattgcaagcagatttacaggcttaaactaggttagaggcagggacaataagaaatggagagattctggtgacttcacattgtggaagtgacagaacctggtgctgagtctatgggaataggaaagtggaagtgacagaacctggtgcggagtctatgggaataggaaaaattatcaatgactgccatattgctggcttggtaaatggagtagatagtggtgattttcacttagaagttatcaaaagggagaaagaattgagaggaatggtaaattcagttctggacatgaataagatgcctgtgggacatcctagggtaggtctctggcagcctatcggaattataggtttggaacccaagataaagttgagggcttcctgtttgacttggatatggttgatttatgaagtttatgtaaggaaaatggtttttagcaaaaagaggaacaagaatggaactctgaaacactagtagttcagtagcagagggcagaagaaagggaaaataagacaagagaaaagtctgagggtatggtaacaccaagactagagaacgatgagggagtagccaaccagtgtcgagtgctacagaggatgcaacaggacttaatagtgtccactggttttagtaacagaggtaattaatgttccagaaaacattttgggcttttagacagtttatactaaagaattactggagcagagcataataatagtttttaagtcctttacttaatgttgtcaaattgcaaaaagatgaaattagttttcagtccagtagcagcatatgattgtgaccaaccatctcacagcatcagaagtagcatggtatctctgagtttatgtcctgactttacaatatttagtgcccttgggcaagttactcagccttggtttcctcttttccaaaaatgggacaataatattacctaccacaggtggttatgattaaagaagttatcaaaatgagtttttatttttaaagcacttaaacagtatctggcacatagtaaatgctacattgaagtgtttgttgggtaactgacagatacatagagagatggatacatacatgtatacatacatacataaaataaatgttgggtattctaattttttttatattttacaaatttgaaaagtaatgaatagtattttttttcagtcaactttatatatatactttacatatattaaaatgttcctggccaggtgcagtggctcatgcctgtactcccagcactttgggaggccaagcgggcagatcacttgaggtcaggagttcgagaccagcctggccaacatggtgaaaccccatctctactaaaaataaaaaaattagctgggcctggtggtgggtgcctgtaatccagctacttgggaggcttaggcaggagaattgcttggacccaggaggtgaaggttgcagtgagtggagatcatgccactgcactccagcctgggtgacagagaatccatctcaatcaatcgatcaatcaatcaataaaatgctcctattttaagcgaacagttaaattagttttgataaatacttgtacctgaatgaccatcacctcaaccagatgtggaacattctcatcaccccaaacagttcccttttgcctcctcccagtcagccctcaacttcatcctcaatcccaagcaatcattgctctgctttttttcctgtgaattagaatacccttttctagagtttcacgtcagtgaagtcgtaccgtaggtactctgtgcttagcttctttcacttggcatgtttttgagatgcattcatattattgcatgtaccaatggttcattccttccactccccgagtggtgttttgttttatggatgtaccacactttgcttatgaatacatttactctactaaatgtatagttttggttgttatgaataccgctatgaattcatgtataagccttcatatagacacatttttattgttttggtgtgtattcctttgattattattcctttattaactcattaaaagtttgaaaactttttcaagaatggtaactttttttgtttttgtgagttctatcttttgtccgtgttttattttgtggttttatgttttctatgttttaattattgagatagtctaatctttttatttcttctatatatgtaacatttataagttcccatgaaggaaatttttgacattttgctgtatatgcatgtatgtttgtgtatgtgtgtgcccagtaattttgggagttttaatcagttttgagaatgggctattcggcagttaatgaagacagctaacatgaaagttagggtaaactcaaatcatagttcatattcactataatttcttcagaattttttagattattttaaaatccatgtacattctagtagattctgtctagtacatttttcttgaatatgacaagtctaggttcctgacaccattcgttatcctttaagcaatgaaattttgtgtataacttagttttctgattaacttaggtttatctctttgttgtttttttgtttgtttctctttttttttttttttttttgagacagagtctcactctgtcacccaggctggagtgcagtggtgcgatctcagctcactgctacctctgccacccaggtttaagtgattctcctgcctcagcctcccaagtagctgggattacaagcgcctgccaccgcgcatggctaatttttgtagttttagtagagacagggtttcaccatcttggccaggctggtcttcaactcctgacctcatgatccaccctcctcggcctcccaaagtgctgggattacaggcatgagccaccatgcctggccctgttatttattattattattattattttaatttttaaaatttttgtagaatttaataccacacccggctatgccagacactcttctatttcaaatattatattcatttaatcctcacagcaacaatatcttcatagttatcttacagatgaggaatttgaggctaagtagcttgcccagggccacacagctaataagtggggtctacctcagagcccatgttcctaagctttatgctgtgttgctgacagggtgaggttaaaatatggaggccgggcacagtggcttacgtctgtaatcccagcaatttgggaggccgaggtgggtggatcatgaggtcaggagttcgagaccagcttgcccaacatagtgaaaccccctctctactaaaaatacaaaaattagccagatgtggtggcatgcacctgtagtcccagctactcaggaggctgaggcaggagaattgtttgcacccaggaggcggaggttgcagtgagccaagactgtgctactgcactccagcttgaacagcagagcaagactctgtctcaaaaaaaagaaaaagtaggtgcaaatctcagtaatagaatagcagattcacacttaatctttctcctgttttaggaagttaatacttaaaagaattattatttattttttctttttttcctttttgagacagggtctcactctgtcacccaggctagagtgcagtggtgcagtcatggcccactgcaacctcaacctcctgggttctagtgattcttcgactttagcctcccaaatagctgggactgcaggcacgtaccaacttgtctggctaatttttttaatttttttttgtagagatggggagctttctctgttacccagactggtctcaaactactgggctcaagcaatcctcatacctcagcctctcaaagtgctaggattacaggcatgagccactgcatcggccaagagaattttcaaagtatgcaattgaaaatgtaggcaagcagtctctagatcttaataatttataggtttctgaggttcagcattattgtcctagttaaataggcactttatcaaatatctttttttcatttgagtcatctttgatgatttctgttggtaagacaatagaaatgaatttccttttttaaaagtttatacaaagtttattaaaaatttttttttaaaaatttaaagcttatgcatttcaaaaatatcaaatacagtagcagttagtttggagtgacaagacgacccctgaagattttttaaggagagatttccttgtggtagagtagtgactgggaattgaaacatgcggctcctggagggagcgctttgcgtctttaaagtaagttatttattcttttatatttaatttccttattgatttggtagcccttacagacccattgaaaacacatagtggccacctccaggaactatttcctgtttgctcccaccttaagtaatctctcatttttctatctcttataacattttgtctactttaggtactatttcattttttaaacctcattctataaagtgttggtcacaatcccagagctttagacatgtatgcaattttttgttactgtttattatttttcaataataagtggaaattaagatctttctgttttttcaggccattttatacacttgatatgaaacttcctgtagaccattgttatttgaattgcttcttcaatgcagttatataacttggaaacttttggctgtgtaccaaatttatttaaagtcatttgaaatcatataagtccatttaaaaatgttttaccacaaatgtatttatgaatatgcagttaatgctaaattccaccttgatcattcattagctttgtggatctgtttccagtataacagggagaacactaaagctgccatgagcattaaattagataatgtctctgtaagattctattacacaattatcctgttactggcttataaaaggttcctcttaattgtggattgaaataaaacattctgcattaacatctaaagatataaattatctttaacagtgtttaaaattaagtaataattagtccaaacctcatcatgaaatagatcaacataaagtaccatgtggctcagttgaaagcaagttctttcagtttttattttaattctcattaaaatataggcaattttggagcatcagttgggggccttcccatcttcttttcaagtggaactgattggttttatatagtacttctgttgcacattttttattttgggattctggcctgcttcatcatagtgttcgtttctgaatcacagtagctaaactattgagtgcatatgtattgacttttgtgattttggaagacagcaaataaagtacctgctttgcaggtgaagaacctgaaagacaggatgtttcctattattgttttgatattagcctttttaatacaacatcatggtccatcagaagaacaagcctgagccaatgagccttagctaatcctaactcaaataaagctaccacataatgtttctccctatccagagttaacactgggtcttagtggactcatttgttcaaatgaagggacgtggcctcatgattattaaagccgtttttagcacttatggactacctatctcagctttcctggttcatttgtcttgagcacctcttagaagcattgcagactttaattttgttccacctatagacattgctttgttcacctttgtttatcatatttttagaacaggatttaatatttggaagggagatctaattctttcagaggaatatttttgtttgtttttttctgtaaactgagttaatgtgatacaattagatgcttcctttatggctgtataggtaaaatcctatgagagtaaatgtagccttttaaagtaaatgtgattaagaaatatatatacttattcaacagttacagtggcaagcatgggttgggaatggtgacttgctttgctctccacctaccccttgtctgtacccaggcaactgtccagggctggaggaaaatgcaaaataatgctgataggtctcactttaaattcatgatcaccaactacaaaggggccagtagtgctgtccagcgttccttccatgctacctattgtcttgcttttttatatgaatattttgtactttcttctctcctctcaaccattaatagctcctttcctttctccccgatcccagtgctgatgagagaataaaaatcaaccagaaggaaatgtctaacctttctccctacctggtctactaatgtacctatatctgtacccaggtactctgctggacttcagttattaatatgccctgttattatctaaggacagtcctcacttattgaattcacatcctgccttccctacttattgccacctctagcagtcatcccttctctcttctgcattgttaatgattcctctttctttaccagatcattcctatcagcatactcacatgttgaaatagctcccatctttaaaaggaaaaaaaaaaacttcctggagaccccacagttccctaaaaatattgccccatttcttcttacctctttgcagcagaactcttcaagagttgtctattctagctttctttccattctttcttgaaatttctccattaagactttcagccccacctctctgccaaaacagctctgatcaaagtcacccatgatctttccaaaggcaaatcactgatcagttctcactaacttgctctgacagcaatacttgatatggtcacactttcttacactctcttcccttggattccaagaccccacactttctgattttcttctgacttcagtggcaggttgctccctcatttcctggaccttaaacttccccagagttggttcttaaccttcccttatatgctcacctcctatgtcaaactagtggattccatcttgtggtataaactgtctattcgctgaagactactgaatttatatctctagcttggatctctcccctaagcacacactctcgtgtccagtggtcttgctttctccctgtggatgtcagaaggttcaaggccagtttctttatttccagtgctccaaactggttccttctgtagtataccttatttgtaattgctcttatcaaaaactgaagtcatttctgattcctctctagggacctgctgcttgccataccttcaaaatatatccagaatgttaacatttttcaccatcttcatagctacccctccatccaagccactaccatctcctgcatggattattgccatcgccatcttgttggtctcctttcctgtctttatctcctttttccattttccctctcattattctgccacactggcctgcctgcctctccttgaagaagctaagcacccctcacacttcagaaccttcgtgcttgctgcttcctctgcccagaatgctctaccaccaaacattcacaggggtctcctactccattcaaatgttcagatgtcaccttgtcagagagctctttccctgaaaatcctatttgatatagcaccttcctcttgcctgcattctctccaaacataattatttgtatattattaacttccctctcttctttgagggcagggactttgttctgtcacatctatatctttaagacccagaaccaagcctggaacattttggtgttaaatgaatggaggaaggtagtggtgatagtggtggtggtggtggtggtggagattcatggtattattctgttagatattaaagccccaaattagtttttaaagaattcacacacaactttttcaaacactatataaaacaaggtaaatctgtatacacacaaactttaaccaatcttaaacacagtcttacccacgatccgtttcaacctgtatttgatgatgaggctgactagccaacatttaagtaatcactatacagtagacattgcggtaagattatccagtttaattcccacaatactcctttcagtatatgttataccattttatgaaaaaggaaatgaggcttagtgagcttacgatgaggccagctgaagataggaagtggcagccctgggactggatctcagtgtgtttagcttcagaacttcttaagaatgatgggactggctgggtgccatggctcacacttgtaatctcagcactttgggaggtcgaggtgggtggatcatctggggtcaggagctcaagaccagcctggccaacatggtgaaacctcgtctctactaaaaatacaaaaattagccagtcgtggtggtacacacctgtagtcccagctacttgggaggctgaggcaggagaatcagttgaacccaggtggtggaggttgcagtgagccaagatcacaccactgcactccagcttcggcaagagagggagactctgtctcaaaaaaaaaaaagaatgatgggactttctaaaataaaaccctcctggagattcttttacatatgatctgtacatgttagtcatttatatgtttacatacttaaatagtaaagtatttgagaaataatgtttagttttagaaactaggggttaaatgttgtgattgttaagcagtaataaatataaatgataaacaagacacctttttaaaactttgagctaaaaattaaatctcatggcactttgcctaatgacctaagctagatcttgtggtctggttcatacaaacatgttctgataccaaaaccagagtgctgttgctatggctgtgaatgcttttctgtgtgagtacatagataccagtaacacagagccatggcttggagttctctgagttacttctctagagagaggaaagtgagaaatgaaacctcagcttcagatttgtaccgttaactttgcagtcgtgtattgctcttcataaaaacagcctcgaagtcaagagtaaaaattctgtgaaggtcgataaaacaagaagggaattgctaagtacaagggaagaaggtatcaatgaaacaaaccatggctagtcctgctgttaattttctggttctctagaagggacagtgccaagttagagttggggaacaaagagccccactctcctgcttttccttcttctgccacatcctgcttattctcctggtccactgaggcatgaatccccttcttgaggaagacctgaatgatgggacagcagtaacctgggggttttggtggcacatacaaaaaaatgtgtctgagagaactgacatttctcttaagatcccaaatgcctgtacagtgaatatagctgtcagtggcaccttctctggggggaaggcaggtccagattgcaaacactgtgctgagctaggttttcacagaatcaagaaagtagtgatgctctctgggagagctgttagcaattatgcgaagctgggagagctgttagcaattatgtgaagctaaatcctgttcatttagatattttagataatgtgctgaaaattgtcagtagagacacaaatatttgtaactaccatggatcttaaaatgtggctccacattcaaaataggctattgtctaatccactctgaaaacttctttgaggttctctttgttcttttgggaacacacatcaaaaatgtgaattggaactaatcagaggaattgtttgttgaattcataacatgatagcatatattgttttgttgatcttatctaatgtgaatgcagctaccaagtttttgtataatagttgctagtgcaatcttgagctattgattctgatttcttgctgattttatgctttgtgttaggatggcatgattcattcctctgttttcgttattaatttaaaaatgtagatatttatttcaaggtattataagtgtgcatatagttcagaatttccaagtgtcttaattaccaaaataaattgctgagatgtaattctttaaaattttaaaaaataagtaatgcatctttagatgagactgtttatgaacagagaaataagataggaggtgacatggataggcaattagtagctcctcctcaggattagtccataaggtgacacaaagtattcttattgtgttcttttatttttgcaggctttgtgtcatgaccttaatttctttttctgttccaacatctgctagcttttaaatggaataatttctttggtatttgcagtgtttgggagatgctttgaacatgctcagctattgtccccaagcaactgagtgggtcaaatttgagattggacttgttgtggatttaataatcaaccctttttggctttaaaatatgacttgccctttatttcactgttctcgttgtctttcctgaacaggctgctgatactttggctgtgaggcaaaaaaggagaatttatgatatcaccaatgtcttagagggaattgacttgattgaaaaaaagtcaaaaaacagtatccagtggaagtaagttacaaaccagcaccctcttctgaaaccttttttcttctcagtgctctgtaaaatttgaccttcccaatgtttctatctcccaaatcctctatttcagtcaggcccctcagctttccctgaacacacctttctgggcctctgtgtcactcctgtgttgggtgttcccttgctctcttggatattgggttttcgctcttaaaattcaaatcttactttctccctcaagctattactcatttggcacacattgcatactgtcttgtattaatctcttcctaactctttacctgtccttgagagcaagaactactttcataggaatttgtactttgtaaatagtaattaattgaaacgcatgttgtcattaattgtggcctggttatacgtttgaatgtaacaatttctgttcttctaatgtgtcccctttgaccatagtttttgtcttgttttgttttcgccaaaattccaccaaaacattaaaatgttgtaatttattttaccagcacctcagtcacatcctgagactgctaggtgtgactgctgagcacactcttttggtacccagtcaccaaccagtctggccttccagatgacaaaaaaacactgtagggaagattgagaatttttgtaatttggttgttcttgtcaataaattttctaagcaagaagtatggtgtttaaaatttttaaggattttagtgcttgattttaagagtgtaaagacttctgtcttgaatatattactaaataagtcagttttattacagtaaaaattaagtgatattaacctagatctgatactgaggatattaattctcatatgtttttaagaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagatatccttttaaataagttatgcatatacatatagctttggaatatgtatgtataaatcatttcagtctaaagatcattcactttgtttttagacagttaagttttataagtaaatatgacattttaattttattatattcttatatactaatattttctaaatgttacctttttaagttatatagtacagatccgttagcgttattcctgtgttgcactgagggggaaaaagagattagccaacttttggtctaccaattgatagaatgcagtatgctagccagtgtgcttaggaaatctgtgaatattagaagccattgttaagtacatttgtatttttaaataattatgttcagtgttctgaagtataaaattcagcagctctcaaagttttgaaaatttttcgtttaaagatgagatatgatgtgtccacaatcaatccttgatactttctgcctaacatgaaccccaaaatagttcctactggagaacaggggtctaagtcgtgtgtgcctatcaacaatatatattgggggaaaaacattattatatataatacatataatatcatatataatatataaaatatatttatatataatatataaaaacattattatatatataaaaacacatatccatgtgtttcttacaaaccaccgtcttctctcaggtatctgtgattctcttagtttatgaacttacctgtactcttaaagaaactaaccacattttaccttgtagcacctcatgaaattttgactaatgtatacaatataatttacttttcacattttcatgtatttggtgaacaagtccatgatctcatttgttatttcctttgtatggatcagagccccttaacagtttgagaacaatgggagttttcaagctgtgttctgtggagctctgaaattcaaaagccattaatctattttatcttggacttcgctgccctgctttacgagatgctggccattcccattgccccaaccatggttatgtgtgatatatataaagttttctgtatattatggtattttgacatctccataaacctttctggctgaggagagactgcccatcctgggactagccacttcttagaaacagcatgggctcatgtcctttttagggtcatggatgacgctggaaaccatcattctcagcaaactatcgcaaggacaaaaaaaccaaacacctcatgttctcactcataggtgggaattgaacaatgagaacacatggacacaggaaggggaacatcacacaccagggactgttgtggggtggggggaggggggagggagagcattatgagatatacctaatgctaaatgacgagttattgggtgcagcacgccaacatggcacatgtatacatatgtaacaaacctgcacgttgtgcacatgtaccctaaaacttaaagtataataataataaaattaaaaaaaaagaaacagcatgggctcagccaggagcatccctttgatatataaactaaccagtcaaggtccagacctcctctctccagtccatacaccccaggtggcaatattcctctgccttaatcatcccagggtcaggtaccagacaactgggggactacctgcatagcttagagcccaccaaaattatccaaactaggccaaatgcagtggctcacgcctgtaatcccagcactttgggaagccaaggttggcggatcacctgaggtcaggagtttgagaccagcctggccaacagggtgaaaccctgtccgtactaaaagtacaaaaactagctgggcatggcaatgtgcatctgtaatcccagctaccagggaggccataggagaattgcttgaacccaggaggcagaagctgcagtgagccaagatcacactactgcacttcagcttgggcgatagagcaaactccgtctcaaaataaaacaaaacaaaattatccagactagctaatcgtagtgttctccccaccctgcttttttttttttcctgagatggagtcgctctgttgcccaggctggagtgcagtgatgcgatcttggctcactgcaacctccaccccccgggtttaagcaattcttctgcctcagcctccagagtagctgtgattacaggtgctcaccaccatgccctgctaagttttgtattttagtagagatgggtttcaccatctctagactagacttctttttttatctgtccatgtgtggcagcccctctgtgcatatggtcaggctggtcttgaactcctgacctcaagtgatccacctgcctcggcctcccaaagtgctgggtggcgtgagccaccatgcccagccaccctgcatttcttttcccaaggaaaccccaataaaagctctgggctaatgctttccccttgctcctgtcttctgcctcctgaccaccttgttgtcttaaccatgtggccctgagtagcctgccttgcctcccgtcactaggacctatgagtataatactttgtttttctgagcctttctttaatcctctgtgtcctcttgtggccatacctgaccatttaatacaagaacaaaaaacaacgatcacagaaaattcctgatgtggaagctgatatggttgctgatggcctccttttccccatccattcccttcccccagaaacctttgcctccatgaagaatgtgcactgctttccatctctctcctaagggtcctcaaatgtcacaaaaatcagaatggcttcttctaagagcaaaggatgggaactcctttgtctttacctttctagactagacttctttttttgtctgtccatgtgtggcagtccctctgtgcatatggtcatttagttattttgaccttcagatgtattaccttaatttaaatgcctacggcttgatataaatgtcgttccttaactcctatgacagtacattttcctatgtaactcatgaagacatctgtaattgctttaatggtaagtaccattagacttttccttgcattcttcctctcaacctatttagtggagggtgattcagaattccctgtgtcctcatcctgtcattattttcagaagttgtgggcattgtgtctcactccaccatgccgtgtattgatagactgcttttgtttctgttttcatgagaatagctgcttttcacagcattcagttcattagctccactggtagggatcaactgtgtgtggaaggggaaggggacagggacagagggcaagctaaatcagagcgggattaagcaactttcattgtcacacagtcacagagttagtgaccaaacttgaactagaacatggttctcatcagcattgtttatcaaactatatgcaagtatgctggtctcaaatgaaactcaaagaaaccataaggaaagaattaggtgaatccatcttataaccaggaaacctattcctatgcaatttgctgcccctgtgttttctccttaaaataacaatatcatgttaataattataattattaatataactaaaatggggggacgtgtgttcccaaaattatagcacaagtaaaatgaaattgtgcatatttaaatttatgtgtattatccacctatttaaaaagattctgccaagtacctcatcaagtggaatctgactttctatgtaagactatgttggaaataagtataggactattgttctattttaccactgtatttcctgagttttttaaggaagtttgctgagacttctgttaatctgcaactcaacagagatttgttgtagaatttggcttcaaaaataataaaatcatttaagctcaacatttcagtgtctcatacctaatctccactatcctcagtccaatgaacagtgttatttgaggctaaatggtcttaagaatctcagactttacaggagtcttagtcaaagcaaaatcaacttgagctgaatttgttaatgagaatcatacagctaacccatgtataatactaatacatgtattatcttatttaatcctcaaaataaatctatgcagtaggttgtgtatcccccattttatagaattgaaaatcaaagctcaaggtcacctagtttgggattgaaccaaacactctgattccagagcccacattcttgccactgtattccatgatcaacagtattttatgtaactttttatatttatttttgaccaggtgatacacttttggccattcaggcaccttctggtacacaactggaggtacccattccagaaatggtatgtaggataacttatgtttatataagtgggaaaaatgaatctactgtctcaagaaggatattttctttagctgaatgtgagctaattgtgtaaacactgtgagttagtcaagtttttatctaaaagtattgatagctgaatttgtatgtctttaattccttggtaaaattatagaactaaatgaatcataaatgattttaaagattattggctatatccttagtcatttattgatatcatttagctcaaagtcaatttttaaaaagtaatcagaatgctttatcaagtgatttttgtttcatacaaaaattaaaactattgtataaaattatcttcaggctatgtgaataaggtgtgtatgaaacaaatgaatattgtgtttagacttgggtcctatccctaagatatctatccccaagtaaccaaatgatttaaaatgatttaacattttgattaaattattttaaatttgaattttttaagttagaggatgtcaagaaatgactaatcatatggccaataatctataaaaataagttaaaatgaccacattgggctgggtgcagtggctcatgcctgtaatctcagcactttgggaggccaaggcaggtggatcacttgaggtcaggagtttaagaccagcctgaccaacatggtgaaaccccatctctactaaaaatacaaaattagccgggcatggtggtgcatgcctgtaatcccagctacttgggaggctgaggcagcagaattgcttcaacctaggaggcagtggttgcagtgagccgaaatcgcgccattgcactccagcctgggcaacaagagtgaaactctgtatcaaaacaacaacaacaacaacacatctacaattgatataaaaattgccactgaggaaaaagttcaatgtacatatcaacaatcaattcctttaaattaggtcttttataaaacattgtctggcttattaagtcaaagacatttattgactctatgagtttcatgattttcgttttcagattcagatttttaaaaacaaactaatttgaaagcaataaccaaaaaagggagtagaaaaagattactatattatctacctccttcccccacccgcttattaaaaaagtttacatttaggcatttgtattactggagtctgaagcctcaggatacagattactttttcagctggaagaatgttatatttatttctcagtaggagaaattagttgtctttgtgcttgcagatgggaaaaaaaagagtttgatttgtgaagcatgttgaactgaccagatctgtggtggccaactccaggggataaatttcctgtatatggagaatacctggagcattgctgggccctgacctattatatagtcacacacggtaacaacagatggttgccagaattctacaacagagagtttctaatgatcagtatttgtgaaaagcttactttttagaaactagtggtttagagccctcaaaattacattctactctatgtctctacttttgtgttttgacttaatgactttattgtgttatgtgaatttagtaagtccctaatagctttgcctgtcttattgtactgtcttaagttagctagaaatgttaataattatacatttgtttatacccaataacttcaaagggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcaggtgggttcagagcctttcttttgtaaattagagagggagaaatataaaaacaggttggctctcttatccaaagtgcttgtgaccagaaatgtcccaagcacttttgacattttggaatatttgcatatacataataacatatcttggggataggacccaagtctaaacacagtattcatttgtttcatacacaccttattcacatagcctgaatataattttatacaatagttttaatttttgcatgaaacaaaatattgactgtggcttgactgcagcctatcacaaggtcaggtgtggaattttccatttgtggcatatgtagatttcagcttttacctgaagtttacttggtaaggttcttttatctctcttagtaagtctaggataaattagtgaaatatgttccaactacctttaagaaaatatgttccaactatctttaagtatggaccatagtgacttatgcctcttgtttctccatattctttgttatactttttatttgggaagcttagttttatagaagtgataaatggtctcaactccaattatgtaggaaatcttactttcctcatttgtttcatttatgaaattttaaaaagctaaaacatttcacactgggtatcaggagtagagagcacaactcttaatttggcagtaccttactgattccaaataaagggagcatggtaggcaatctctcagtgactactgaatgaatgaatgaatgaatggtgccaatatagacatcatattgcagataatttaaaactatattgtatataatccaaattgtttattttacctctaggatgtgtctcattgctaaaatgggatttcacaggttaaaagtgacgctaacaagatataactggacatggaatgttttttagcttctttttgcccacatctattcctttctttcccctataaatatgtctatactacagaccattaggatgcacaatagaaaaggtagtgctggctgggcgtggtggctcacaactgtaatcccagcacttagggaagccaaggcaggcagattacctgaggtcaggggttcgagaccagtcttgccaacatatagtgaagccctgtctctactaaaaaatacaaaaattagctgggtgtggcggcgcacacctgtagtcccagctacttggaaagctgaggcaggagaattgcttgaacccaggagttggaggttgcagtgagccgagatcgcaccactccagtctgggcgacagagtaagactccatcttaaaaaaaaaaaaaaagaaaatgtagtccttaaaaagcttacaatctaattaggatataaagcaggcaagctttacatgggttttacctgggttagcttagacataattaacacactggcttcaacaaagtgtttttaaaaagtgagtattctgtttttatggtttcatgtttggaaatcctaactaaggaaagtaattttgggctacattagagcaggccttgaatttcagagtagttaggacatttatccaataaaccagtgaagatctgtgaccaaggaaatagcataattagctataatggtgcacacaggagtaatatgattaggaaagatgcttttggccctgggaagcagaattcagaagcgatggaaactgtagatgtttgcagttatgcaactgagagaacattagggctaaaacaagggccaagtgtggtggggctcatgcctgtaatcccaacactttgggaggccgaggcaggtacactgcttgagcccaggaatttgagaccaacctgggcaatacagtgagaccctatctctaaaaaaaaaaaaaaaaaaaaaaattaaaaattagctaggcattgtgacgtgtgcctgtggtcccagctactggggagggaggccaaagtgggaggattgcaagcctgggaggtcaaggctgcagtgagccctgacagcacttaatgtactccagcctgagtgacagagcgagatcctgtctcaaaataaataaataaataaaaaggctaaaacagtgattacagtgagatcaggaagagaaataacgaacagatttgagaaacactgtaggcaaaataacatttgatgtgtgagatctggagataaagttaacaggaatggaaagtgatgttgaagttttaaggttgaataactgggagaattatgaaactactgactaaaactgagtcagttttggtagaatgatgatgaggtttgttgttgttttttttttttttttttttttttttttggcagggtctcactttgtcagccaggctggaatgcagtggcgcgatctcagctcactgcagcctcaagtgatcctcccacctcagtctcccaagtagttgggactataggcacgtgccatgaatgtctggctaatttttttgtattttttgtaaagacggatttcactatgttgcccaggctggtctgaactcctgagctcaagcaatccgtccacctcactcagcctcccaaagtgctagaattataagcatgagccaccatgcctggcagataatgagtcttttggtcttcgtctggagtttggaagtttaaaagtaatgccaggcacagagtaagcgctcatgaaaacaacctgtccacaaagtactagtactttaaataaatgtgcatgtcagtcaagctgctgctgtgactacttgtgtttaaatatgagtatcttttactgttaacagaaatataacaaaactttattactgtttccagcaggatctattagtggagatatcattgatgagttaatgtcttctgacggtaagtaggttaaaattttactaactcacttatcagtaatgcttctgtggaatttataagtgaaacatgatttaaaagaaatgaacatatatttgctacctgctttactatgaagattcatgaaaattctcccttaacacttacagtaagtaataggcaaccttcagaatttatttttctttgcttgcattttgagggaaaggaatccatatggggatacttctcaccttcattgaaaataaactgttagccctttccactcctgaaggatctggtccaagaagagtaaaataacttgtctaaatcaagcaactgatctgaacacctgcctttgtaaatacccctacccaggccaatttcaagctgccaatgggaagtcactgaattagtattaatattaaccatgttgtcatctaacctgaaaaattattaaatatcagttagctacaatatgctaattactttaataatttctctccttctgtaagttcttggatcagagtcctactacctaacaaataaagtagaaacctacgaagtggtagcagttaagttagcaaatgttatagtaactagagatgtactaaacatgtatgtagaagcagagaacatcagcaaactttgtaagtccagttcattcttctgtttgcaaagtggaaaacaaaacactttcattagtgttctgttttttttttttaaggcagagtctccctctgtcatccaggctggagtgtcatccaggctggagtgcagtggcatgatagctcactgcaacctccacctcctaggttcaaatgattctcctggctcagcctcccgagtagctgggatgacaggcacctgccaccacacctggctactttttgtatttttagtagagacggggtttcaccatgttggccaggctggtctcaaactcctggcctcaggtgatccacctgcctcagcctcccaaagtgttgggattacaggcatgagccactgcacctggcctcgttagtgccttttagttatattaccttagtgataagttcaaccaataaaaaatttaatttctaggccgggcacaatggctcatgcctgtaatcccagcactttgggaggccaaggcgggcgaatcacgtcaggagatcgagaccatcctggctaacatggtgaaaccccatctctataaaaaaataaaaaaaatgagccggtcgtggtggcaggcacctgtagtcccagctactcgggaggctgaggcaggagaatggcgtgaacccgggagtcgggagcttgcagtgggccgagatcgagctactgcactccagcctggacgaaacagggagactccatcttaaaaaaaaaaaaaaaaaaagaaaaaattaacttctgtttctcaatctaatatcaatattcaatgtacaaattgttactaaatgagaatatttcaaaatacacattacacaagactttaatttggaatgatgtatttgagagtattttgttaaagatcattaaccgtatgtagaaaccatctttaacactaaatttgttttttgttcgcagtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacatt

SEQ ID NO: 38683 - DNA, 3676 bp, Homo sapiens
ggggccgcgcgtgctgcagccgccgctgctgctgctcctgctggcgctgctgctggcggcgctgccgtgcggtgccgaagaggcctcgccgctgcgccccgcgcaggtcacgttgtcgccgccgccggccgtgacgaacgggagccagccgggcgcgccacacaacagcacgcacacgcgtccgccgggggcgtcgggctcggcgctgacgcgctccttctacgtgatcctgggcttctgcggcctgaccgcgctctacttcctgatccgggcgtttaggtgcgtcaggcgcacgtgggcgccgtctctcagccttggccaattagcgcgcgcctagtgcgtcacgtgccgggccgcggggtcctcccctccctccctccctccctccctctctccctgttggagtgggcgtgggcggtgctgtgcggggtcgtcacgtggtgtgggcggtgcaggggccacgggactcacccgctctccagcctgcgcctggggttggaggtgcccagcgcgccgcctcttaactcgggggtgacgctgcccgtttcccaggtggggccactgaagccggagcatgccgggcaggggtcaggccctggcggggcgagggggcctccttggctccttgtcgccggatgcccgtcctcgttctcatcttcccgcctgccgccaggcctttccgtggggtcccgatattttcctttctgcttctacccactgaagctggttcgtcgccagggtcggccacgtgcccgccttgggtgctcccacagcccgggaggtgcagctgcgtccccagaccctcgcgggggtctccagctgtaggcagcccctgggcaggaggggcttctgcgtgttcaggccaccccggcttccctggcctgtggctccagtctcctctgggctcctgactacccagtgtggctgcttctcccgggtgggagagacacagcgaggaccttatccctccccatcaccaccctggcaaagtcaagccgctttttattttttataagtttttattgtagcgatggggtctcgccatgttacccgcgctggtctgaactcctgggctcaagtgatcctttttcgttggcctcccaaagtgctggcattatagatgtgagcacctgcactccgccatgctgctttttatgggccctgtgcagagcctcccctgtgctccacacctcttcctgtggaagcacctgctgcgcgctctcccctgcctgtatgccgcgccctccctgcctcccgggctgctggggccaccaggggcttggccctgagacaggcttccattctgttgtctttggcaaagtctcacccctgtgtgagcctcagtcttttcatcagtgcaatgggagtgacatcagcgtgcctctcctggggtcctggcgcaggggagatgggagggcctggtagggcacatgtcttcttactgtcatcgccatgggagtgaatggtaatcacttggcgattaggacatgaaagaagcaggcacagcaaaaccagggaggtctgcagcagggctcggggctccagtagaggacggcaatgagagtcctgagggaaggaggaggcagggttggcggggaggggccactgactatgcctggacctacttccaggttgaagaagcctcagcggaggcgatacggcctcctcgccaacactgaggaccccacggagatggcctcgctggacagcgacgaggagacggtgtttgagtcccggaatctgagatggtgtgcacccttccccagctctggggcctcggtgggcaggctgggctggagactcagcaggaccctggggacttggccaagccatggagtggtccctgcaatcacagctgacagcggtagtcaggccatggccccactgggcagggctcatcccttctcccagcctccatttacaactttttttttttaaacttaaatgtttgtcatttatttatttttgaggtggagtggcgcgatcccaactcactgcaacctccgcctccgggattgaggcgattttcctgccacagcctcccgagtagctgggattacaggcacccgccaccacgcctcgctaattttttgtatttagtagatagagatggggtttcaccatgttggccaggctgggttccagctccttacctcaggtgatccatctgcctgggcttcccaaagagctgggattacaggtgtgagccaccgcacctgacctaagttttgttttgttttgagatggagtttcgctcttgttgcccaggctggagtgcaatggcacgatctctgctcactgcaacctccacctcccaggttcaagcatttctcccatcgcagcctcctgagtagctgggattaaaggtgctcaccactacacccggctaatttttgtagttttagtagagacagggtttcaccatgttggccaggctggcctcgaactcctgacctcaggtgatctgcccgcttcggcctcccaaagtgctgggattacaggtgtgagccaccgtggtcagccttcttgcttttttaaggcaggaaagcggctgcagggcttagggtagtggttgctccatctgggcccctccctgagggatgaggtctaagtcaggtggagaactgactgcaggatgcttctgagcgggcggggtcagggagggcctctccctggtgtaatggggctggcttctggaagagtgtctcaggccgagggaacagcagggagcggccgggctgcgcagatgccgggcgggactggggtaggcctgggcatcgaggcagctgtcaggggttagcagggttctgggcagggaatgatgggtatgttgcgctgcagtgtggctgctggggggaccttggcctgttggggggtggcaggcatggaggctgggagaccaggagactgggcggcctctggggacagctctgactttttgagcccccagggagggaggcactgggatccctccgcatgctctgactccattctgggaacccctcccaggtttcttctacctcctggctgggggccccttcccccggagtgggcagttgcacagggcccaggaggccggggagggaggccagtggggggaggctgggccctggtagaccgaggggcctggacaggctgcctgcccctgcctgacctgggtgagcctctgcccggcagggcgggcccttcactccttccctctcacccttgaccccctgctttcagatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgc

SEQ ID NO: 38684 - DNA, 18743 bp, Homo sapiens
agccgagtccggccctccatacccttgggcggagcaggaggcagggccgggctcgttgcgcgcctgatcagtgcagccccggcctttgtcccctaccctgtttctgcaactacatccccgaccctgtcctgggaccttcgtcccggagcccaggctctgggatttccctcagtccctggcagggttgaaagtccgggatggggacttcctaaagctccgggacgccgtgggatgggctcaagtgcgggtggctttgcccagaccgcagtcgggaagtgggaactggacagtaggggtgcgggggaggctctccagggtgctcgggaatgttctcaggaagaagacttgacatagagcaagagctgggtacatgtgaactattgttgtccagcccaggcaccctttaggggccccaccctgactgtccagccaacaacgggcatccccaaggcctgcagactcagcatagcccaaaccggcctcagtttatttccccaactccttacgcactttctctttggctttttttccgtcccctgccttccaaaaccctgagccacacctccagcctcttgcacccaaatcctggccatcgcagtgagtctcaggcctccaaactcatgccccaccctgtcggtcttccaccattgccccagagggctctttctaaaatgcacctattaccacctccctcccatattattattttgttttcttttcttttcttttttctttttttttttttttttttttttttttttttgagacggagtctcgctctgtcacccaggccggagtgtagtggcaagatcttggctcgctacaacctctgcctaccaggttcaagcgattctcctgcctcagcctcccaattagctgggactgcagatgcacatcaccacacccagctaatttttgtatttttagtagagaaggggtttcaccatgtttgccaggctggtctcgaactcccaacctcaggtgatccacctgcctcagcctcccaaagtgctgggattacaggtgtgagccactgcgcccagcctattttcttttcttttcgagacagggccttgctctatctcccaggctggagtgcattggtgtaatcatggctcactgcagccttggcctcctggactcaaatgatcctcttgcctcagcctccagagtagctgagacaacaggcgtgaccagcatgcctggctaatttttaattttcttgtaaaagaaggggatctcactatgttgcccatgctggtctccaagtcctggccttaagcaatcttcccacttgggctcccaaagtgtttggattacaggcgtgagccaccgcaccctgccctcctctcatgctgtaaatccttctgtcgctccacattgccttagacaaatacaataaaaactaaccaccctggctgggcacagtggctcacgcctgtaatcccagcactttgggatcacttgaggtcagaagctgaagaccagcctgaccaacatggtgaaaccccatctctaataaaaacaaaaaaattagccgggggtggtggcaggcacctgtaatcccagctactccagaggctgaggcaggaaaatcgcttgaacccgggaggcggaggttgcagtgagccgaaatcatgccactgcactccagcctgggcaaaaggagcaaaaccctgtctgaaaaaacaaacaaacaaaaaaacgaaacaaaaatcaactctctgaccttacttagtatagctgatactatcaactttatcagacagttcagtggatgaacacattgccacagtcccacggcctttctgtgatttctagaacacctgttctgctatgtatacaaagtctagccctggtaactactaaggaaattgaatttgtaatttaaaaactcccaaaaaagcaatctccagacccagatggtttcactaaggaattctgccaaaggttcaaagaagaattaacaccaatttcacatcatctcttccagaaaattgaaggggacacttccctgttcattttatggaactatgaccctgataccaaaaccagataaagacggtacaaagaaagcaagctacaccccatatccctcatgaagacgtgcaaaaatccttaacaaaatattacaaagtagaatttaacaatatataaagtgaattatacaccatgacaagtggggtttactccagggacccaagactgattcagtattcaaaattaatcaattgtccaccatattaaacaggctgtggtaggcagaataatggtctcttaaagatatccacgccctaattcccagaatctgtgaatacgttaggatacgtggcaaagggatttgaagattaaagatagacgccaggcacagtggcacacacctgtaaccccagcactttgggaggcctagactggaggatcacttgcacccaggagttcaagactagcctgagggccgggcacggtggcttatgcctgtaatcccagcactttgggaggtcgaggcaggtggatcacaaggtcaggagattaagaccatcctggctaacacagtgaaactccatctctactaaaataaaaatacaaacaaattagctgggcatggtggcacgtgcctataatcccagctactcgggaggctgaggcaggagaattgcttgaacctgggaggcagaggttgcagtaagccgagatcgctccactgcactccagcctgggtgacagagtaagactctgtctcaaaaaaaaaaaaaaaaaaagaccagcctgggcaacatagcaagaacctgtctctagtaagtgtaaaaattagctgggcgtggtggcaggcacctgtaatcccagctacttgggaggctgagccaggcgaatggcatgaacctgggaggcggagcttgcagtgagccgagatcacgccactgcactccagcctgggctacagagcgagagtctgtctcaaaaaaaagaaaaaaaaaaattagccaggtgtggtggcatgcaactgtagtaccacctactctggaggctgaggctggaggatcacttgagcctgtaaggtcgaggctacagtgagtcatgatcgccccactgtactccagcctaggcaacatagtgagaactcatccttaaaaaaggaaaataaattagctgggtgtggtggtgcccacctatagtcccagctcttcgggtggctgaggcaggaggaccgcttgagattgggaggtcagggctgcagtgaactatgatcgtgccactgcactccagcatcgacaacagaatgagacaccgtctaaaaaagaaaaattgcagatgaaattaaagttgctagtcagctgactttaaaatagggagagtagcgtggattatccaggtgggcccaatgtaatcattagggtccatcaaagtaagagaaagggccaggtgtggtggctcatgcctgtaatctcagcactttgggaggctgaggcgggcagaaaacttggggtcaggagttcgagaccagcctgggccaacatggggaaacctcgtctctactacaaatacaaaaattagccaggcgtggtggcggtcacctgcaatccacgctagtcaggagactgagcttggactcagtctctgaacccgggaggcagcgcagtctcttgaacccgggaggcagaggtcgcagtgagccaagatcataccactttactccagcctgggcaacagagtgaaactctgtctcaaaataggaaaaatagataaataaataaataaagagacagaccatgtctctgtctttgcagatatagcgaagattattctcccattcaagtagacttatacattctctctgttctcagttccacaccggagaggcggggatttccctaggatcactggacctgctgggatcagcctctgcccagccctggcaggggagggagttgacgggctgacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggtaaggtggggaggcgggggctggccctgctgggccaccgtggggagctgcggcacctctctgagtccctgtctccccactcgccaagggggggcggggtgggtgctggatggggcaggacacgtgctgggggactggggtgggttctggccatctgcctctctgtgcgtctatctctgtctccgtgtgtctttgaatttggtttctttttctctttctctctccctggccccgtctgtctctcccgatgtctgtctcagtctccctctctctttgtctcaatctttgcttttgtctctcgttcactctcttgaatacaaacaagatcagggacttcctccaggaaatggggagtcctctgactcccgagcttcctcccgctcccagcccaggaaaaactccgtgaacctcagctgctggggcgaaggccaggacaggtgacatgtgaggacagtaagagctagcgggggccacattccacaggacagatagttgccatggacagtgcgtgcatgtgtgtgtgtgtgtgtgcttatgtctccctcagaataaagtcccagcccctccgttccccgtgaggccctatctctccttcccaatgccgcatattcattttctttctttctttttgttagagacagagttgctctgtcacccaggctagagtgcaggggcacgatcatggctcactgtagcctcaaactcctgggctcaagtgaacctcccgccccagcctcctgagtagctgggaccacaggcatgcactgcctcttctggcttttattttatttatttatttttgagactgagtctcactctgtcacccaggctgcagtgcagtggcaccatctcggctcactgcaacctccacctcccaggttcaaacgattaagcgattctcgtgcctcagcctcccgagtagctgggattacaggtacgcaccaccacacctaatttttgtatttttagtaaagacagtgtttcattttgttggcccggctggtcttgaactcttgacctcaggtgatccacctgtctcggcctctctaaatgctgggattacaggcatgagccaccgcacccagccttttttttttttttttgaagatggggtcttgctggccaggcgcagtgggtcacacctgtaatcccagcacttagggaggctgaggcaggtggatcacctgaagtcaggagtttgagaccagcctggccaatatggtgaaaccccgtctctactaaaaatacaaagattagccgggcgtggtggtgcgtgcctgtgatcccagctactctggaggctgaggcaggagaatcacttgaacctgggaggcagaggttgcagtgagccaagatcgtgccactgcactccagcctgggcaacagagcaagactccgtctcaaaaaaaaaaaaaagatggggtcttgctatgttgcccaggctggtctcaaactcctggccttaagtgatcctcctgtctcagcctcccaaactgctgggattagaggtgtgagccaccatgactgcctcattttctaatacagatcaaaacaaacacccccagctcctccctgcccatgtccccgcctctgcccctgaggttcccttacctgtagtggagtagactttccttctacctccatacatccaaatcctccccaaccaacaaaccctttagagccagtagatcactgcagttaagaaagataatgggggaggccgggcttgtggctcacgcctgtaatcccagcactttgggaggccgaggcaggcggatcacctgaggtcaggagttcaagaccaacctggccaatatggtgaaacctcgtctctactaaaaaatacaaaaattagctgggtatggtgccaggcgccttaatcccagctacttgggaggcagaggcaggagaatcatttgagcctgagaggcgaagtttgcagtgagtcaagatcaagccattgcactcaaacctgggggacaagagcgagactgctctcaaaaacaaaaagaaaaaaaaaagaaaagaaagataatgggggccgggcgtggtggctcacgcctgtaacccaacactttgggaggccgaggtgggaggatcacttgaggtcaggagttcaagaccagcctggccacatgatgaaaccccatctctactaaaaataaaaatagctgggcgtggtggtgtgcacctgtaatcccagctactcgggaggctgaggcaggagaattgcttgaactggggcgggggggttgcagtgagctgagatggtgccaccgcatttcagcctaggtgacagagtgagactctgtctcaaaaaaaaaaaaaaaaaaaaaaggcagtgtgcagtggctcacgcctgtaatcccaacactttgggagggcgaggccggcggatcacttgaggtcaggagttcgagaacaccctggccaacatatagtgaaaccccacctctactaaaaaatacaaaaattagctggatgtggtggtgcgcacttgtaatcccagctacttgagaagctgaggcaggagaatggctcgaactgggaggtggaggttgcagtgagccgagatcgcaccactgcactccagcctgggcgacagagcaagactctgtctcttaaaaacaaaacaaaacaaaacaaaaaagatcatgggcccgaattaagaagacccaggttctaatcccggctccacactttccttactcccaggccttatgcaagtgacttaatctttgagccttagttttctgtcttctgaaatagggagttagggctgtagtcacagttcacgtgttgaggacttgactcaacgcaggccctggtgcttcccatgtggaaagtcacctaattctcatgagatcctccagagttggcaccattattatcaccattttacagctggggaaacagacaaagacagctcaaataacttgcccaacagcacatcgtgggtacataatgaagcaatacagtgtttaatcctgtattgctctagtcccagtgcctggagcagggctggcacataaaaagccttcagtaaatgttaggtaaatgcatgtgtgtatctgtgcttgtgtctacggatggacaggtggatgggtagatggggggatgagtggaggcttggtgaatacatgcgggcttgatggtggctgagaggatgtgtgggtggatggatgagtgcatatacaagtgggtggatggatggatgggggagtggatggatggatgagtgggcagacgggtgggtgggtggatgatggatggatgaacaagtgcatggatgaatgatagatggatgaataggtggatgcacgatggagggatgtatggatggatgaacgggaagatgcgtgggtgggtggatggtgaatggatgaatgcatggatggatgatggatggatgagtaggtggatggatgatggagggatgagtggatggatggatgatggatggatgagggatggatggatgagtaggtggatggatgatggagggatgcattgatagatgagtggatggatgtatggatggatggatggatgagtgggtggatggatgagtgggtggatggatgatagatggtgggtggatgatggagggatggatggataggtggatggatgggtggatggattgatgagtgggtggatggatgagtgggtggatggatgagtgggtggatggatgatggacggtgagtggatggatggatggattatggagggatggatggatgggtggatggatggatgagtaggtggatggatggagggatgcattgatagatgagtggatggatggatgagtgggtggatggatgagtggatggatgatggagggatggatggatgggtggacagatggatgtgtgggtggatggatgactggatggatggtgggtgatgtaggtattgatgaatgactggatggatggatgatgaatggctccatgatggatagatggatggatgggggtgatggacggatggatgagtgggtggatggatagatgaatggatgaatggatgggtaaatggtaggtggatggatgaatgggtgggtgggtggatgaataactggatggatggatgtgtggatgggtgggtgggtggacggattggtggatggatggtgggcagatggatggatggatgaatgggtgaatggatgggtcaatggtaggtggatggatgaatgggtgggtgggcggatggacagatggatgatagatagatggctagtgggtagctggatgatgaaagatgaatgggataccattaaaccagttagttaacttacccctagagcacccatctctatagattggcgggggttgctctgaatccctcatcacatcgaggttccgtctggtcctttctcagacgaaaacagacacccagaagctgggccatgggtggggaggatctccctgagaaggtacatttgatcagaaactcaaggcaggaggtaataaagatctgggggcagcgtggggcagagagcacaaccagtgcaaaggccccgagacaggattgagtacatgaaaggcactcagcttggccagctcacctcttctttctgcacttctggtccctaggattacaagaagttctgggcaggcctgcagggtctcaccatttatttctacaatagcaatcgggacttccaggtaaggatgggaatggaggctccagagcaggccttcccttgagcccagagaccaagcagacaatgtagatggtgtggtcaaggtggctgctacatcatccagggggcctggaggccaaggaactggtgcccagatcccctgcttctatgcccccagcacgtggagaagctcaacttgggagcatttgagaaactcacagatgagattccctggggaagctcacgtgaccctggcacccacttcagcctgattctccgggatcaggagatcaagttcaaggtaggtcccttgctggaggggtgcagaggggcggtgcttgcagaagatgctcaaatgctcctaccctccattgtgccaaccacgaaggggcaggtagtacagggccctgtgggccctgggtaagacttgggtcttgaccccaaaggagctgggtgctatgggagggtttattttattttattttattactttttttttgagaccaagtctcgccctgtcacccaggctggagtgcaatggcacgatcttggctcactgcaacctccacctcccaggttcaagtgattctcctgcctcagcctcccaagtagctgggattacaggcgcacgcaaccactcctggctaattttttgaatctttagtagagatggggtttcaccatgttggccatgctggcctggaactcctcacctcaggtgatccacccacctcggcttcccaaactgctggaattataggcgtgagccaccgtgtccagccgagggtttattttttatttttattttttgagtttcgctcttatcacccaggctggagtgcagtagtgcaatcttggctcactacaacctctgcctcccaggtttaagtgattctcctgcctcagcctcccgagtagctgggattacaggcgtgtgccaccacgcacagctaatttttgtatttttggtagagacagggtttcaccatgttggccaggctggtctcgaactcctgacctcaagtgatccacccacctcggcctcccaaagtgctgggattacaggcatgagtcacggtggctggcctatgggagggtttagagcatgagaggtctgggaactgatctatgtttttctattattttattttatttattattttattttgagacagggtcttgctcgtcgcccaggctggagtgcagtagtgagatcatagctcactgcagcctcgacctcccgggctcaagcgatcgatcctcctacctcagccaagcacatgccactatgcctggctaatattttatttttttgtagagacagggggctcgctatgttacccagtctggtcttgaacccctaggctcaagtgatcctcccgcctcgacctcccaaagtgctgggattacaggcgtgagtgagccactgcatccagcctgatctatgtttttcaaatgttgatataataacatcaaaaatcataatatcagccaggcatggtggctcatgcctgtaatctgagcactttgggacgccaaggcagaaggatagcttgggcccaggagttcaagaccagcctggcaacaaagcgagaccctcatgtctaagagaaaaaaaaaaaagctgggcgaggtggtgcatgcctgtagtcccagctactcaggaggctgaggcaggagaatcgcttgaacctgggaggtggaggttgcagtgagctgagatcgcgccactgtactctagcctgggcgacagaagaatgagactccatctcaaaaaaaaaaaaaaaaaaaaaaaaaagaagaaaaagaaaaaagaaaacggccctttgaagcagggactcttccctagtccaatttcattgatgagtagactgaggctcactgacttggattctttcctttcttttgttccccaggtagagaccttggagtgtcgggaaatgtggaaaggcttcatcttaacggtggtggaggtaagagtagtggctctctgcgccctctctcccattctccagatctcctcaaaaagcctcctttttctttctttctttttttctttttttgagacggagtctcgctctgtcgcccaggctggagtgcagtggtgcgatctcggctcactgcaagctccgcctcccgggttcacgccattctcgtgcctcagcctccggagtagctgggattacagaagcccgccaccacgcccggctaatttttttgtattttagtagagacggggtttcactgtgttagccaggatggtctctgtctcctgaactcgtgatccacccgcctcagcctcccaaagtgctgggattacaggcgtgagccaccgggcccggccaaaattttgttttatttttttgagacagagtctcactctgttgcccaggctggagtgcaatggcacgttctcagctcactgcaacctctgcctccccggttcaagcaattcttgtgactcagcctcccgagtagctgggattacaggcgtccgccaccacgcctggctaatttttgtatttttagtatacatggggtttcaccctgttggccaggctggtcttgaactgaccttgagtcatctgcccgccttggccactcaaagtgctgggattacaggcgtgagccacagcgaccaaccgtatttcttattttatttttttgagacaaggtctctctctgttgcccaggctggagtgcagtggtgtgatcatagctcactgcagcctccaactcccaggctcaagcagtcctcctgcctcagcctcccaagtagctgggatacagacacacactaccacatctgactaatttaaaaatttttttgtagagcagggtctcactatgttgcccgggctggtctccaacttccgtgctcaagcaatccaccctccttggcctcccaaagtgataggattatagatgtgagccaccatgcctggccacagagtgctaagtttttaaaaattagctgacattggccaggcgtggtggctcacgcctgtaatcccagcactttgggaggccgaggctggcagatcatgaggtcaggagatcaagaccatcctggccaacacggtgaaaccctgtctctactaaaaatacaaaaatcagctgggcgtggtggcgggagcctgtaattccagctactcgggaggctgaggcaggagaatggcttgaacccgggagtcggaggttgcagtgagccaagatcgcgccactgcactccagcttggtgacagaactaaactccatctcaaaaaaaaaaaaaaaaaaaaaattagctgacatcatttatcaaccgggaattttagtctaccttcctgatttccctctgatttccctgtttcctacctcaccctggcaggccattgagtttgagacctgcctggcccctgcagactttagtttgagaccctagattccagcatctacttttttttttttttttggtggggttggggagcggggaacggagtctcactctgtcacccaggctggagtgcaatggcgtgatcttggcttactgcagcctccgccttcccaggttcaagtgattctcctgccccagcctcccgagtagctgggattacaggtgtctgccaccacgcccggctaattttttgtatttttagtacaaacggggtttcgccatgttgcccaggttggtctcgaactcctgaccttaggtgatccgcccgcctcggcctcccaaagtgctgggattacaggcgtgagccaccgcgcccggccccagcatctactctcatgcaacactcctctgcaaccctctcgaagccctctttgccctctaaggtgtcagagttcattgctctgagctctggcctcaatttgccactctgtgacttgggcacagccgtccattcccggctggccaggtgcagtcactgtccctcgatcgcccctcagctccgtgtcccgaccgacttgaccctgcttcctgggcacctatacatgatgtctgaagtcttggccaaagaggaggcgcgccgtgcactggagacaccctcgtgagtgtcccgcctgtcccgaggggctgcaggatggggacgggaggtggttgtgtggctgagggtgggcggtgagttgggtcccctggagttgggtcttggattttgcatgaggactgccttggggctgggggtgggggagggggagggggagttatggcccatgctggggaggcagggcaggatctccaggagcgggtctaggggcctagaggactggtaaggtcttcagtggcggggcctaggcctgaggagtagggacagggtctgggggtggtcagtctaggtgtctagaaggtgatgcttcgtctccggggaggagttatttgtcggagagggtaaccgggaccctagaggcggggcctggatggggggcggagcatcgtctttgtgggcggttcttggtgatcagggaggcgggcagggcctccagggtaaggtctaggtgtttggagggcgggacaggatctccaggggaggctctaggtgcctacgaggcagggctgggtctccctaggggttggagctgcatctccggggccagaattaagagcctggctggccgcggtggctcgcgcctgtcatctcagcgttttgggaggtcgaggcgggaggattgcttttacccagttcgagacccatcctgggcaacatagcgagaccccatctctaaagaaaaaaaaaaccaaaaaacccggccagatgcagtggctcacgcctgtaatcccagcaccttgggaagccgaggcgggcggatcacctgaggtagggagtttgagaccagcctgaccaacatggagaaatcccgtctctactaaaaatacaaaaattagccgggcctgtgaggaaggggaatcgcttgaacccgggaggcggaggttgcggtgagccgagatagcgccattgcactccagcctgggcaacaagagcgaaaccctgtctcaaaaaaaaaacaaaaaaccccacaaaaactaggagcctggaaggccggactgggtctccgtgggaggggcctgggtctggagagcagggcagggtctcctgggcctaggggatggggatggggctgggtctcagaggaggcagggtttacgtgcagaagagcggacttggtctccggggtcccgagtgggtgacgcggcccgccacaggtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggtgcgcatgcgcgtctggagagccctgggtgggaggagggtgggaagagggtgggcgcgggggcgtggtcagaagcaggggcggagtccgacccgctagtgggtaggccaggggacggagccagagccgagacgggcgtctggggacggagtcagagctgagctgggcggattgggggaggagtcagagctgaggtgggcggattgggggaggagtcagagctgggctgggcggattgggggaggagtcagagctgggctgggcgagctggggcgggtggagtcagagctgagcagagtacactggtggcggaatcagagctacgctgggcgtgttggggcggagtcagagctggggtgggcgggctgggggaggggtggagtcaatgctaggcaggggagcatgggggcggagtcagagctgggcagggagggctgggggcgggatcagagctccggggtcgtgggatcctgaggctggccttgccccaggtatggggttaatgcctagggaagaaggtagagcccaggccgactcctttgcaggaagagccaggtcttgggttaggagctgggactccctgtaggtggagtcagactcctaggttaggatcggcccctccggaacgtcaggtacgcaggggccaggtctgggccactggaggggatgaagtcaaatccagggatgggaatgggctctttgggcagcgtcaggatctacgggggggagtcatggccgtgatcctttttggaagttgagtagggctatggaggcggagccagccctgggggcgaagtcagagccttatgccaaattctcaagcccagtccagggttgggcaaggcgatgtagaaggtagagtcggtgcctgggggtggagccattacagggggcggggcctacctggggcggggtctttagggcctggttctccctaggcgcggtgccagaattaggggcggacctttcctagggtgttgtcagtctggcctggtccctcgctggaggtggtgccaagactagaggtggggtcttctgtgggggtgggtcggtcgggcctggtccccgctgggagcagtgctgggatcgggcagtcagtgctccgggaggtcaacggggcttaggtcctttatggggtggaaccagtcagtggcggggccttctgtgggggcggagccagtatggacctgtttctattggaggcggagcctggagttggggcggggccttccctgaggggcggtgtgggagcctgggctgagccactcactcgctttctcctggtgcaggacgcacgtggtccggcattacaaggtgaagcgggagggccccaagtacgtgatcgatgtggaacagccggtgagcgttgggccagagtccctagaagtgactttgtggggtccgcgtcccttctccagcagcctgaccgctcccccatctgcccccagttctcttgcacctccctggacgccgtggtcaactatttcgtgtcgcataccaaaaaggcgctggtgccattcctgttagacgaggactacgagaaggtgctaggtgggtgccccttcggggagttcgggggcccagtgctcacctctcccgcccccgctcggacggaccgggccgcccctggccgccgcgcttcctccaggccgccctctctgttccaggctacgtggaagccgataaggagaatggcgagaatgtgtgggtggcgccctccgctccgggcccaggtgacgcccccttcccgcgggccgaggtgggagggatcgaggaccccgcattcagccacgccccctcagtcagtttggtggctgcacctcctgcatctgatgttcccaaagttgcagggacagaaatgactcagaccctgccgtcagggtgtgtgtgtgggggagggggcgggggtcccagcttgggacagagctaaacacagacactctcatcctgtagggttgaatttggggtggaggaaaaacctgggctcgggggaggcgcctagagttcgggagaagatgggggcagagcagggaaagcttcccagaagagtgggtctttgcagatggtcccaaaggatctccttaggtagaaatgggcattgaggggtcagagggtacacccggacaagcagtagccccacagggaccgagaatccgggtgggtgttgggaaagaggtggaaatcggtcctgtttatggagtgggaagaggaggcagagaacacactagaaaggaatgtagcgtgggttgtctggtcttccctggtctgggcgtatgcaaggacccccaagtgccacatccacacacacattacacatgcatgatccatgcaactgtggccacctgcctagccagaaggtgacacacacttgtgcgggcacaacagatcacacatgcataaatacacgtgtgccccaattccagtcacatacaaatgctatgtagcacagatacacctgtgtcatgccacaatcacatgtgtacacataaatgcagatacgtccgtgcaccggcacaaactcggacacgtgtagatacacgggcaaaacgcactcatgtagacaaggactaaagcagccacctcagcaggcgtgcagtcacacacgtatacacaccacaggtgtgtgtgtacaaacgttgcactttaacttatctagattcaattagtgtacacgtgtatgccacacaaagacttttttttttttttgagatggagtcttgctctgtcacccaggctggagtgcagtggcgcaatctcggctcactgcaacctctccctcccaggttcaagcgattctcctgcctcagccccgagtagctgcgattacaggagcctgccaccacgccaagctaatttttgtatttttagtagagacggggtttcaccatattggccaggctggtcttgaacccctgacctcaggtgatccgcccaccctggcctcccaaagtgctgggattacaggcgtgagccaccgcgcccggcccagacacagacttatacatgggcacacacacagacacacagggacacatgcctgtctccaggcatgcacacagacccccccgccaacctgcaaggtgtccctgtatgacatgggtcttgacagtgaccacgtttccccatcaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatggtgggtggggaacagagctgctgagagctgggggttggggaaacaggttaacagctgatgtgacacgttacacttttgtccacgcagtggcttcctctagttggccagtcatcctgaagccaaagaagttgccaaagcctcctgccaagcttccaaagccacccgttggacccaagccaggttggggtcccccccatatcccaccctcacctgatggcaggccagcctcagccctcatctgacttttttttttttttttgagacagtctcactctgtcgcccaggctggagtgcagtggcacaaccttggctcactgcaagctccgcctcctgggttcacgccattctcctgcctcagcctctccagtagctgggactacaggtgcccgccaccatgcccagctaatttttttttttgtatttttagtagagacggggtttcaccatgttagccaggatggtcttgatctcctgacctcgtgatccgcccacctcggcctcccaaagtgctgggattacaggcgtgagccaccgcacccagctcatctgtctttattgttgttttttgttttgagatggagtctcactctgttgcccaggcagtggcgcgatctcagctcactgcaacctctgtctgccgggttcaagtgattctcctgcctcagcctcccaagtagctgggattacaggcacctgccaccacgtccatctaatttttgtatttttagtagagaaggggtttcaccatgttgcccaggctggtctcgaactcctgacctcaagtgatccacccacctcagcctcccaaagtgctgggattaccggcgtgagccaccacacctggcctcatctgtcttctcttccagagcccaaagtctttaatggtggcttgggcaggaagctgccagtcagttcagcccagcctctcttccccacagccggtaaggggtctgcggggtcagtgcggggcgggcttcccaggtgtgtgaccgtacagtcacacaagtccccacactccgaagcgccctgtcttttaaggttctgctgtctctgtcttgaaattcttaatgccttcgagcacactgtcctgttgcacggggccctgcaaatctgtagctggtcctgggtggctgtcagggcggtgggcatggactggggatccctgagccagctgcagctcctggtcctgaacccccagggctggcagacatgacggcagagctacagaagaagctggagaagaggcgggcactggagcactgattcggacacaccagggaccagcgggctagtcccagggcatggcccagcggccagattctttttcccaggattaaaactctgaccccagg

SEQ ID NO: 38685 - DNA, 74562 bp, Homo sapiens
cccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtgagagcgtggagtcgagtcacagctgtcaccgccccctcccggccgcccgagccctccccgcgctctcttggggcctctctgcagccaggcctggctcaccccgaggcttttcccgccactgggccggctgcgtcccggccccgcggttcattcactggtctactggggatgagcggctgccgggcggaggcgggagacccccgggtgggtgggggcggccctttgggttgtgctttcgtgaattaaacactttgaaaatttaaagtgccttcccccaaagtacccatcccctcggctagtaccctcttgggatcgtgggtagggtgaggccagctcagggcactgtggggttcgcggctttagttgcctggcagggtcaggtttcagaacctgatgtgtggatgggggagggtcattttaggagaagctgtgcagggtatgggggaggctggggtgggatggctgggtgacgagggaagctggagctttgctccactcctcagggaacattatttaatacgggccagtggacccccttccctgcgttttgtgaactcgtgtcctttggaaaaaaatcgacttttacgatgaagacttaatttcgaaaatctgcactttagcataaagccattattctactttttaaaaagtaaattatatgtattttgtcataaaaaatcacaggctaccagaaattaatctacaaaattgagtcttcaagaagcatagtacccataaaatagtgctaatgaaatctcagaattgtactattcatttaaaagttttattgagctctgcaatgtgctttgggtacgttaataaaggctgtaaaatcagaacatgcattctgccttctagtcctggcattgccactttctagctgtgtgaccttgggcaagtcactgtgcctatcttcctttggtgaagttggggtaataacatctacctcatagggttgttataaggagtaagttggtatgtgtaaagcacttggaaaaggcctagtatttgctcttactctgttttcaggcagctcacagtttagtcaggaagacagatcctataatcaacattcatttgataaatttgtgtgttaaacacctgttatgtgctaggagctcagctccatttcagggttacaacaaggaaagatatgctgtggccagtttaactatatgtgtaccaacagtgtagtaaagtagtaaaaaggagagcaggatccacttggcttaaccaggggttcctaacctggggccctcagctcctcaaaggatctgcacatagatttcagaggatccctgaactttgatggggaaaaaacataactatttttagcaatctccaattggaattgagcacttcctttagttacgcatatgggtaatgtctcagttatctattgttgggtaacaaatcactgcaaaccagtgccttaaaacaagaattgtttctcaaaatctgggttggctgggcagttctgctggtgacttgactgaaagttggcttcactcccatgtctgggggcttggtgcccctccatgtgcctaggttggacttcctcacttggttactgacttccaagagggcaagtcccaaggcacaaacacagcatcatgtttgctgatgtcaaaacaagtcacgtagccaagtccagagttgatatggtggggaaccacacaaggtcatagatatgagttggtgcacttcgctgggggccattcattttacaagttcctactgtaacaaatcacagtagtattagcagtacctgttaccagtagaagtcacagtaccagcacaagtcacagacattttcatattacattacagttgttgcagatgtcaaaatatcacttatgctcattactacttcagaactatggtagttataagactcactgctagatctttttgtttagtgggctagtaaagaagcacatactgcttatatcagatatttgagtttaaaaaataagattatttcaatatagttgggacttttttgtatgcaattagaagcattattttgagaaggagtctataggactcactgacggccaaagaggtccacggcagaaaaaaaggtaaggaacccctggggacttcagagaaggcttcacagacgggacacttaaatttagttttgagacaggtaggagttcttcaggtaaaaggggtggggaacatcagtggtattccattgggggaagtgctggaagctcagttttgatgtgtcaagggaaagacatagtgagctgagattattattattattattattgttatcattattatttttttcagacagagtctggccctgttgtccgggctggagtgcagtggtgcgatcttggctcactgcagcctccgcctcctgggttcaagtgattctcctgcctcagcctctgagtagctaggattacaggcgcccgccaccacgcctggctaatttttttgtatttttaataaagacggagtttcaccatgtgttggccaggctggtctcgaactcctgacctcgtgattcgcccgccttggcctcccaaagtgctgggattacaggtgtgacccaccgcgcccgactgaactgagattatttcaggtgaacatgtactttgggtagaaaagatcacaacaaaccttggaggacaccaaaatgtaggagtaggcagaggaaagggggaggccagacttgagaagcagaagtaggagcagaaaagagtgatgtttagaaaatcgagggagaaaagtttcaaggagaaatggctatgttaggatgctttcagctgggaaaacccaactgcttaaatagtaaggaaaattctctcacaaagtccagaggaagaatggattccaggctctgattcagttggtcaacagtgtcaggccaggcacggtggctcacgcctgtaatcccagcacttcgggaggccgaggcgggcggatcacgaggtcaggagatcgagaccatcctggctaacatggtgaaaccctgtctctactaaaaatacaaaaaattagccgggtgtgttggcgggtgcctgtagtctcagctactcgggaggctgaggcaggagaatggcaagaacccgggaggcggaggttgcagtgagctgagatcgcaccactgaactccagcctgggagacagcgagactccgtcccaaaaaaaaaaaaaaaaaaaaaaccagtgtcatcaaggacccatctcttcttgggtttccacagtcaggttggtttcctttagggttgcaagatgactactagtaacatacacactttctcattctctagagcaagaggaggaggagagagaaaaaactcccacacttggtccttcagtctgattggaccaacttaggtcagttgtctgaccctgtaacagttgtcagaggaatgccatgatctgattggcttagactaaacaggatcaacccagggtggcgtcacttaatcacaggggagaggaatgcattcatgaacacaatggagttcttttaggaaggaagagggagaatagagactggatatgcaaccaacaatgtccatgacggagatataagctagatgagatatgagttagttacatatcatgagtcgtgttcactgatttgggcactttggaaagctttcatgatccttatactttaggtttactgatggaagtgaagggtagattaacctgggttggtgactgagggccaagtaagtggacactatgatggttgataagcttgactatcaagggaaggagagagaatttggtaactagaaggatatgttcagtcaagattctagagagaatacctcagctgtgcaagggagagatattcccacccgagagatggaaggaaaagaaaggtgcgagagattgtagaccagtggttctccatagaatggtacgactcaacagaatggtatgttttggaaacttgtggggttgttctttttttcttttttcgtttttaactttgcaaaaattataactgaaaatggggttgttctttatgtctttagttgtgttgaacatttacatactgaaatataattcacataaatctttcctttttattcacctttatgctaccatcagagtatactgatttactttttggacttatgcatgtaacttagtgatgaattttatttcaggataccagaagagtgtcagaaaatatttgtcataaaatggtgatgttaggtctagtagttgagaaccagtgcttgtcaaactttaatgggcatgtgactcttgttaaaatggattccaattcagtaggtctgggatgcggcctcaaatgctccatttttttttttttttctagatggagtctcgctctatcacgcaggcttgagtacagtggcgcagtttctgctcactgcaacctccgcctcccgggctcaagcaattcctctgcctcagcctcctgagtagctgggattgacaggtgcgcgccaccatgcccagctaattttttgtatctttagtagagacggggcttcaccatgctggccaggctggtctcaaactcctgaccttgtgatccacccgcctcagcctcccaaagtgctgggattacagacgtgagccgccgcacccggccagattctccattttttaactagttctatagttttcgttggtcccctttgactagcaagaattgaagccaatcggtagatgaatggttcttgtgttttcgagatggatggtcttatgaacatggtgggatttgggagaggcactgaccaaggaacaaaaagataggccagaccctttgagggctctgctgagagcactcctgtatgtttgtgcagagtggggatggagtaaacggtaggattgatcggggtttgggagttaacagcttgggttaactagaactggagggcaaaggagttaatagtataggtgttggtagtaaaagtacaatggtagtaaaagtgcagtgtgtctgactagttatgtgcatattaagtacacattgtacttaaaatatatactgcgatgttttgatatagttattcatcttcaggtcactagggggcattggtggattaaaaaacacatttgaaaagctgcccagtatttgcattccattgtaggaagcagcttttccttgtgctgctgcaggaagtttgaatattggatacatatacccagattcacgttattagatttccttcattacacagattttatcctagtccaactatgggctgggcatcatgctggaccctggtgggtacaagtgaaaagacccagttcttatctaggagagaggtcccaaatctggccacaaatcagaattattcaaggagacagtttccaagcccctgcgcatggttctgactgactttttagttggcgtccaggaactgctagttttgaaaaagccccccaaggtgattatgaaactttcatttcagaagctcacaatgcacttaccagcacagacattaaaggtccgttaacgatgcagtgggtctcaaccttgactgcatgttagagccacctggggagcttttaaaagtcccgatgcccagtctagaacctataccaatgacatcaagaatctctaggggtaggattaggcatctagtttttggagcaagcagccagccttgagatctactgacttagagggaagagcaacagcagggggcatcagaaggctttatagagaagaacatgcctatgctgatctttggagctaggcagacaaggttgaaagggccttccaaacagagaagaaaagcacatgcaaggacacagaagtgtgagagtgttcagaacagtgttaagaccttgggcttcactgtgttccttgtgagagatactaaagttttctgtagctgcttcctcatttgtaaaacaaggatgagatgcttaccaacctcaaattattgtgtggattaaattcattcctacgcaaagcttagaacagtgcttggcccaaagtaagggctgaagaaatgtgagctgttacttttagttggcatcttgtaagatggcatcttgtaactacctgtgttacggtggtgcacggtcttggggctctccaaaagtattttttatttcaaaacttggtagtcagttggatgtggtagatgagggagaaggataaattaaggtttctgcccaggcttttgacttttgactgtgggatctattcattgaggtgggaactattcattgaggtgggaaagtggaagaaggttgaatttggtttgagggggaggtgatggtttggttttgaacaggttgggcttgctgaaatatctgggcattggaagggggaaatcagttgatgtagaaccccagggtatggacttttcctgccacagacgtgggctggaaattgggaaatcatcagctgctaactgaagcctccagggcaagaaggtggcctagtgaaaactggtctgtgtcacttccttcctcaagggcaaataacatgacctgtactcagagctcaccacaccaaggagcctgagtgaacatgtccatgactatgaggtgttattacctcacacattctttgtggcttagtgtaatacttacattgcctgtcttcctgaaattaattttcttaccatgttactagtatgttactagaactgcgcggagaattacaatgctaaatggaaaaggaaaatcatctgtaaattggaagagtaatgtaacttttatacttgagcattattttaaaagccacatatttggaaagataatgaaggttttttttccctaacagtttaagcatcttcaagggaattcttcttgaggaattatagtaactacatttttactcacataaatacattttttatgtgcagaatcaattggttgtttctttttcctttcttacctttcgaagaagttagacagtggatcacagagacgaagaaaaaactgctctgtagctctggatgcaatcttttcagcctcaggttctagttgtgtttctggctgagcgaccttgttgagatttctttttttttttttttttttttgagccggagtcttgccctgtcacccaggctggagtgcactggcgcagtcttggctctccgcaccctccgcctcctgggttcaagccggtctcctcccttagcctcccaagtagctgggactacaggcatgcaccagcacgcctggcctagtttttgtatttttattagagatggggtttcaccatgttggccagactggtcttgagctcctgaccttaagtgatctgccctccttggcctcccaaagtgctgggattacaggcatgagtcaccatgccgggccagttgagatttcttaatctctcagcgtcctctgatcatgatcctgtggggatagtagtatgtccctctgtatctcacaggattgttgggagattcaattgagataatatgcgaaaagaaccgtgaactacaaagcactatatcaatgtaaggtgttttctgttcctcttgtatcacatttgtccactgaagtaatctatgcttgcaggttagcactctggacttaacaactgtaaaacgtgaattaacttgggttatttcacttctcatttggaaatgaattctgctcaggacactgtagcattcttctatctacttctgaaatgcagatagcctcacagttgtaactaacactggaagaggagaaagaagaagtaaaacgatacattaaaagaacggagagattagaggcacagtggaggagaaaagtagatgatgtaccagacatttatgataaatgaattgattaccccatgaggcctgttgatatttgtagacttttatgacgtaaaggtttaatttataatctatatgtatatgtgttccacacccatgtcctttctaggctagactggaacttcttagaggctaggaaacgaacttgcatatttgtttgtattgtacatttaaaattagatatataaatgcatgttattaggtgtgtaataaatctcaatagcaaagatatctgtttcaaaaagtttagacttatttttaatatgacaagaaagtactaagagatctttaaaataaaggaattgaaagagtgtatcagttgattttccccaataatgcttaagtggaattttacagttagttcatacagcatgaaactttatatattttcagggacaaaaaaatcctagtctaaagttatattttagaatttggaagttatttatttttcacttttgctgagtttttcctaatttttgcatagcctcatgccagttttgttagaaaatttaatcagtgccaatttcttaatgtggtaggtttttaaacttattttcagtgttcactaaaacttggagaagcaggaatgtagggcaagggtcgtagagttttcagtatgctgaaagcctatgactttgattgttaagctatattttcctgatacagctttatgcattatggatagtatagttgaattttaagtgaatattgttttaaaggcactttaagtgcagttatcctttgtcttcctatttctggctgtttgaagcaatgcagcgtgttttattcaaagcccacactggctcccgcttaaggacttctttgtttggttccatgaggatgaggagccccctctgtgggagctagagatagatccacaagtgcatgttcattgccttagtgtggaggaattcccagtagtttcttttttcagatattcctgaaaagaagtctattccttcttctgaacagtcttttaaaatggaatatatgaaactaactaataaaggttctttttttcttttcccccattccacaaacttcagtccttgtgaactagcctgtttttgtttgtgcttgctgaaaatgagtctcctctcctattagagatgctgattcatgtgacatgggttagactggtgagtgagtaagtaagcaaaaagtgattatacgggctccaagaagtttcctacattgtctgttgatggtttacctcacttggcagatagaactgagcctgtttgtggagtcacaccatttgggagtcctgttaaagttgctgggtatagtccaaacatttactttacttgtttttgttccttatttttgcacagattttcattatgaggtcagatggttatcaaccgaattgagtcttgtacatgattttttttttccaaaaaaggcttacagttttccttaaagaagaaaaacgcacatgaataactgagatgaagtcaaaggcagttttcattagtgagtttagagttctctgtgcacatggtggtctgttaagatatgaaacccgggtctaggcccgacgtggtggctcacacctgtaatcccagcactttgggaggctgaggcaggagaattccttgagtccaggagtttgagaccaacctgggcaacatggcgaaaccccgcccgtctctacaaaaaatgcaaaaattagccaggtatggtggtgcctgcctgtagtcccagctacttgagaggctgagatgggaggatcacttgagcccaggaggttgaggctgcattgagctgtgattgtgccactgcattccagcctgagtgacagaatgagaccctatgtcaaaaaaaacaacaacaaaaaaagagatatgaaacccatgtctaggtagattttttttttttgagacagagccatgtgtctagatagaaacctgtgtctagatagatttttttttttttttttgagacagaatcatgctctgtctcccaggctggagtgcagtggcacaatcttagctcactgcaacctccacctcccaggctcaagcgatcctcctgcctcaccctcctgggtagctgggactatgggcacgtgccaccattcccagataattttttgtattttttgtagagagggggtttcacctttagcctgttgcccaggctggtcttgaactcctgggctcaaaggatccgcccacctcggcctcccaaagtgctgggattacaggcatgagccagcatgccctgcccagatagattttactttgacagactagctctcctattaaatgatgtacattttattagttgcttggaaacacagatgcatttgaaaagctaaacttgaagtaaatgtttcccaacgattttttcctccctatatttccttaattcagaaaagattgagtgggtcccaggatgccattctaatagagaaaaaaacacatatatataggagtcttaagtagcagtaaatttctgtctggatgaggaagttcaaaataaattctggacttgataaattacatattatctgtgttccaagtctttaaaaccagtatagcccaactggatgactcaaaacctgcctaaatgaacaattatctcactctttggccctaaggttttcttcctgtttatcgcacaagtttattatttttctacatgaattttataaaatctaatcgctatctttaaagagtagaaaatgaaacaattgcagatgagacattttgtttgctttgctgacctaattttgtggtgaattctaccctccaaagatgaaacagaacttggttttctgtgagaaaaagataatattagtcttgaaaacagcctcatttttttctctgcttatctctttagattgtagtctgtttacagtggatgagaaagagctaggaaataccaattactgtagtacagaactaaagaattaaaaatttctcataaaatagttctatgtttgttgtattaggaagagtttttttaatgttgtttgaagtctaaactttactgggcatggtggttcacacctgtaatcccagcgctttgggaggccaaggcaggaggattgcttgagaccaggagtttgagaccagcctgggaaacatagtgagactccatctctaccaaaaaaaaaaaaaaaaatagctgagtgtgctccgtcacacccatagtcctaggtacttgggaggctgaagcagaaggattaggtgagcccaggagttcaaggccacagtgagctatgattgtaccactgcactccagcctgagtgacaaagggagataaattcttggctttatatcctcctttgctgtgaaacagatcgaaatgattgtgggttttattgttattgttaaagtatgagtgctcccaaattttacattcaaatgaatgcatcaaaacagtcgttttgagaggatagatttaattatactgtcattatatttattccaaaaattctatcactgatcaaaacatttttactcttcctcatttggaattatcttcaaactttgtggcaaacctttataatatcctcaggagctagccatttttgttctttgcatgttacaaaacaaatcaatggtttttttgtaaaaacttcaggaaatagagataagaattacctttaatatcaccacctatagacaaccactgttaacatcatattttttttttttgagacggagtcttactctgttgcccaggctggagtgcagtggcgccatcttcgttcaccgcaacctccatctcccgggttcaagcaattctcctgcctcagcctcctgagtagctgggattacaggcgtgcaccaccacgtccggctaatttttgtgtttttagtagagacagggtttcaccgtgttggtcatgctggtctcgaaccactgacctcgtggtctgcccacctcagcctcccaaagtgctgggattacaggcatgagccactgcgcccggccctaacatctttttagactccgttctggacatattcaaatatacccttggtatgacattttcaaaaaactcggtggaatcatactacaagtccccttcctcttttttttttttaaaaaaaatgccattttcttttcttcttcttcttttttttttagtagaatgagataatcttattattgaccaagtttacataaagcttgattctttaccgccaccaccaccacaacagaaagaaaagtttatgttggacactacgtttaattaggagatgtagaaaaggttccagtagagattgttttaatgaagactaatattgtaatttttttttctattttactctaagtcctgggatacatgtgcggaacatgaaggtttgttacataggtacacatgccatgttggtttgctgcacctatcaacctgtcatctaggttttaagccccgcatgcattaggtgtttgtcctaatggtctccctccccttgccctccatcccctgataggccccagtgtgtgatgttcccttccatgtgttatcattgttcaatcccacttatgagtgagaacatgtgatgtttggttttctattcctgtgttagtttgctgagaatgatggtttctagcttcatccatgtccctataaagaactcattctattttatggctgcatagcattccatggtgtatatgtgccacattttctttatccagtctatcactgatgggcatttgggttgcttccaagtctttgctattgtaaatagtgctgcaataaacataggcgtacagatgccattttctcatctttgtgtgtgtgtgtgtggagataatgaatctttttttttttttgaggcggagtctcactctgtcacccaggctggaatgcagtggtgcgatctcggcccactgcagccttttgcctcctgggttcgagcgattctcctgcctcagcctcctgagtagctggggctacaggtgcccaccagctaattattgtatttttagtagagacagggtttcacactatgttggccaggcttgtctcgaacccctgacctcaagtgatctgcccgcctcggcctcccaaagtgctgggattacaggctcgagccaccgaatccggcccattctctattctttaccactcttatttaaaatatatcgagactgattttctttactttttttttttaagcggagtttcactcttgttgcctaagctggagtgcagtggcatgatctcggctcactgcaacctccgcctccagggttcaagcaattctcttgcctcagcttcctgagtagctgggattacaggcgcactccaccatgcctggctaattttttctatttttagtagaaacagagtttcaccatgttagccaggctgctcttgaactcctgacctcaggtgatctaaccaacttggctttccaaagtgctggattacaggcgtgagccacggcgcctggccgagactgattttcttttaggcttaaaatgtgatctgaaggcatttagaaatggaagccatatgattacatattaaaagtaaattttggttgggtgtggtggctcatgtctgtaatcccagcactttgggaggcctgaggtcaggagtttgagaccagcctggccaacgtggcaaaaccccgtctctactaaaaatacaaaaattagccaggcgtggtggtgtgggcctgtaatcccagctacttgggaggctgaggtaggagaatcgcttaaacccgggaggcggaggttccagtgagccgagatcacaccactgcactccagcctgggtgacagggcgagactctgtctcaaaaaataataataataaaataaattttaaaaaataaatttcacttatgaaatttatataaatagttgtagtaaattccgactccatatatgatttatcaaggtaactgctttgaaaagaaaacatctatttaaaaaaaatgttgtaagtaatactgaaatacttttccttgtaaaaagtcaaaatagtacagttggtcaggttgctattgtccacctccccccagccccctttccagagaaagcctctgttctgtttggtgtgtggccctacatgttagaaaggattgctggccgggcatggtggctcatgcctataatcccagcactttggaaggccgaggcaggcagatcacctgagatcaggagttcgagaccagcctggccaacatggagaaaccccatctctactgaaaatacaaaaaaaattagctgggcgtggtggcaggcacctattattccagctactcaggaggctgaggctggagaatcacttgaacccaggagacggagattgcagtgagccgagattgtggcactgcactccagcctgggtggcaagagtgaaactctgtctcaaaaaataaaaaatataaaaataaaagattgctgtataaaatgtagatactgtcctgaatgctccttatggaggagagtattctgtattcttttgacgtttcaagaattgtggactcatttctcttgatttttatttttatttatttatttatttatttttcagacggagccttgccctgtcgcccagactggagtgcagtggcgtgatgtcggctcactgcaagctccgcctcccaggttttctcctgcctcagcctcctgagtatctgggactacaggttcccaccaccacgcctggctaatgttttgttttttttttttttgtatttttagtagagatggggtttcaccatgttagccaagatggtctcgatctcctgacctcgtgatctgcccgcttcggcctcccaaagtgctgggattacaggcgtgagccaccgcgcccggcctttctcttgatttttcattcaatttacaacacgttactgaggacaacagtgtagcctgattttgacaaaatttttttattgtcttcatcattttgttgtattctgagttctttcacatagttcttttttttgtgttggttacttagaataagaataatctcaaaagtattgtcagtgttcatagtttgttttttttttttgtaaaaaacccatttcagatttttacctcctaaataattagaatcagattaaaatagttttgtttcgagtgaaaaatgctgtcagaatggaaattattgcagaaaaggttgactgaggccaggcgcggtggctcacgcttgtaatcccagcactttttttttttttttgtgacggagtcccgctctgtcgcccaggttggagtgcagtggcgcgatcttggctcactgcaagctccacctcccaggttcacgccattctcctgcctctgcctcctgagtagctgggactacaggcgcccgccaccatgccctgctaattttttgtatttttagtagagatggggtttcactgtgtttctaggatggtctcgatttcctgacctcgtgaactgcccaccttggccaattccagcagtatgagaggccaaggcaggtggatcacctgaggtaaggagtttgagaccaccagcctagccaacatggtgaaaccctgtctctactaaaattccaaaaagtagctgggcatggtagcgggcgcctgtaatgccagctacttgggaggctgaggcaggagaatcgcttgaatccgagagacggcggaggttgcagtgagtggagatcgcgccactgcactccaggctgggcgacagtgcgagactccgtctcaaaaaaaaaaaaaataattagctgggtgtggtggtggctgcctgtaatcccagctacttgagaggctgaggcaggagaatcgtttgaaccccaggggcacggaggttgtcttgagccgagattgcgccacttcactccagcctgggtgaaagagcaaaactctgtctcaaaaaaaaaaaaatttattttcattctttatcattaaagagttgcttttatgttgtcctttgtgtggcttgtaggatcattaaataaggtagagaatctcataaaaacagttttggagaaagatagttgaaagcataatgtcatacattttaaatatataaatgtaaactatatatagaaatacataaagtattatatatacttaaactatataaactatatttttaagtatatatagtatgtataagtctataagtatatatatacatatagtttatatacatatatataaacttggtagaagggtaagatactgtaagtgtatatatacttacatagagagagtttaaattatttacatggaaaatagaaataatatattccatcactccaaaaaaaaggtcacctttggatatagcctgtttgaagtagcagttgaaaagcctggtaacatgtccctcagggagttagaaacacaggaaacacacaagcctgaggcttagggagaggcccaggctagggatactgatttgagcatcagtagcatatgagtgggagttaaagacttagattttggccaggtgtggtggctcacgcctataatcccagcactttgggaggctgaggcaggtggatcccttgagcccaggagtttgagaccagcctggccaacatggcgaaaccctgtctctactaaaaacacaaaaattagctgagcgtggtggcgggcgcctgtaatcccagctacttgggaggctaaagcatgagaatcccttgaacccgggaggcggagattgtagtgagccgagatcaggccactggactccagtctgggtgacagagcgagactctgtctgaaagaaaaaaaaaagaaagaattagattttaatgaaattgccctggagtgagaagaggagagagttaaagactactccatgactcatcaaccttgaagagctatgcagaggaagagaaggcccaaaaggggaggagagagtacctagaaagcctctagaatggggatagggtagaatcctgtaagccaaagaaaggggttgaagatgtagagtagtcaccagtttcagggtgcaaccaagatgccagatgtccagtggggtttagcaactgggaggctattggtggtcttgggaagaaaggttttaggtgcatttagtagtaaagggaggaggagataaaattgagaaagcaaacagaatctgcctttttgactttgtgcttaaatgcggatgctcctcagcttgtggtggggttgcattctgataaacctatcataagttgaaaatatcattaagtcaaaaattaacacacctaacctaccaaacatcataatttagcctaccctcccttaaatgtactcagaacacttccagtagcccacagttgggcagaatcatctaacacaaagcctattttataataaactattgaatgtttcatgtacattattgaatactgcactgaaagtgaaaagcagaatggttatatgggtactcaaagtgcggtttctacagaatgcgtatcgcttctgcaccatgtaaggttgaaccatttgtaagtctgagaccatttgtataacatacatataggaaagtaaacggggcataagtgaatttttacaaactaaacatactagcactctagaagctcttctcgtggcccttctagtcactacccagcttgctaagggtatccactattctgccttctaaccatagtctacttttaaaataaatttgtcaatggaagttggtagaagggtaaggtagttgttagagagggaattaggggtggagggtatttgttgtgttttgtttaagacgggagagattttcttgaatgtaaataaatgtcataatttctctagtgggtggccagtcactctgtttctttttatatttaggacagttttcattttatactttcaaatgtttttaaaagtatgtttgagtgcttatacaaacttaagttgaataactgttctctaagcatatgtttgtggaatggtggttttcaaaactttgcttatcttgggaatagattcttgggcccctcttagattcagagtcagacactctgggggaagctgttagaatctatgcttttaaaaaattccccaggtgggccaggcgcggtggctgacgcctgtaatcccagcactttgggaggccgaggtgggcggatcacgaggtcagaagattgagaccatcctggctaacacagtgaaaccccgtctctactaaaaatacaaaaaattagccaggcgtggtggctggtgcctgtagtcccagctaccaggaggctgaggcaggagaatggcatgaacccaggaggcggagcttgcagtgagccaagatcgcaccactgcactccagcctgggcgacagagcgaggctctgtcttaaaaaaaaaaaaaaaaaaaaaaaacaactccccaggtgattctgaaacctcttgtgtacacaggcctgcaaaagccttctatcatgaagctggcatatattataaatggaagtctaataagataatagttctgtaattgtgggagaaaagagtcaccctttttttaaatgggagagagtattcactagattctctataaagttgaaaaagaaagcaagttgttaggtatttgagccccaccattcatgagagtctgaataattctgagggtgacttatttagcttaaggtttttatttgtctttaaggcagttttactggaacataatcacaacatgatcccagagctatggaattctgggcagtcagtgtacttttatttgcaaagcaagaacagtttagccttctggacacccattatgatttgtttgtttacgaccttaccagattcatgtcttggtaaactgtgtctaagaatctacctttaaagctgagggagctgactgataaactcaatctttttattttattttattttttgaggcagagtcttgctcagtcactcaggctggaatgcagtgacgcgattatagctcactgcatccttgacctcctgggctcaagtaatcctcccacctcagcctcccaagtagctgagaccataggcatgccccaaacacctggctaatttttttttttttttttgtagagatggagtcttgttatgttgcccaggctggtcttaaacttctggcctcaagtgatcctcccacttcagcctcctaataaactcaatcttatgcctgaatcttttttttttttttttttttttgagatgaaatctcactctgttgcccaagctggagtgcagaggtataattttggctcactgcaacctccaccttccaggttcaaacgattctcttgcctcagcctcccgagtagctgggactacaggcacatgccaccatgcctggctaatttttgtattttagtagagatggagtttcagtgtgttggccaggctggtcttgaactcctgaccttgtgatccacctgcctcggcctcccaaagtggtgggattataggcgtgagccactgtgctgggccctgaatctttttttgaatgttaatttattttttaaattgtggcctgagtctttgattaaattcataagcttcctggaagctctataagagcagggaccttgtctgcttatgtgttttatctgtttagtaccatgtctgacatgatgtgggtgtgcagtaaatatttgtttttgaaataaaaccctggttgacctcttctaattgttatatataaccttgcttgcctgaccagatttgttttgccaacatcagtccttcgcaagcttcagtggagacagagtaagaaccaaatgtctttaagatgatgacagcctacccctttacacttcttgttagggcctcatctaacccaacaccaatactggttgctctgtttccattgacaagccccttgcgggctgtgcgaaacaaaagttttgagacatagagagtctaaggtccaagatagagtgtaccttgatactttgctggggagtaggatcagaccagaaagaaagaagagttagccacaagagtgagaaaactcaatgacactccctctgaggtttgcaaagctaagggccaccagtttacctttaagccaaattttcgttttctctgtgactatgggtcttacagctgtattcaaaacctcagagaagccaacacattagagtccttactttgagacccccaactagctgaatgccaagaaaggcatttagtaactgaagggtatactcccgaggggctggatctaaagaaatgccacctttgatctagcctgtaacttagcactaattggagattcagctcttaacagagcttgcttgactttgattgagcaagcctaactcatataatgcaaagtagaccatatctaatcagttcttggcaggtgcatatgtactcattttctgagccaactcatctgccctgaccagggagtgtacctggcaacaaggcttctcaaggactatcacttgggaaagggagtgctcagggcgtgggtacatgcagtctagagattacagccctgcatcagaaaaagtttgggggaggccgggcacagtggctcatgcctgtaatcccagcactttaggaggccgaggcggacggatcacaaggtgaagagatcaagaccatcctggccaacatggtgaaaccccgtctctgctaaaaatacaaaaattagccgcatgtggtggcgcacacctgtagtcccagctacttgggaggctgaggcaggagaatggcttgaacccaggaggcggaggttgcagtgagccaagatcatgccactgcactccagcctggcgacagagggagactctgtcgcaaaaaaaaaaaaaaaaaaaaaaagggaaaaagaaaaagtatgggggagatttcacttcttgggaggtatattcagtccgattatatcataatgggtcaggactcctcatggagagagaatacctttgtgttcatgtctcacaaagcaacccatccagagtgcgaacaggaggaaagttgataaggctagagatttttttttattatgtcccagaccctgaaagttgattgtgtttcttcaaagaactggattgttcttccttggggagacaaaagattgaagaaggttcatctcctctttgtgcccttacactgtcctggggtgattctacccatcttagcctttcccttcttaaatcctgattttgaataggttggcctgaatactcaatatgagccctaacaaattatgataaccacctggcaggcacacagtgtcgaagatggccatttgtgatgacatctggtctggccagcttcctttttactgttaagagggaaaggtggtgagcatgctgaggcagggtggggtcatctcgcaccaggaggagccccctttgaagctaaaaaggaagatgaatcagccaagatgttgagtgcatcagcttcagccatgtctacctggggaccttttaccaaggctcctcccatgggtttccatcacacagatctataccagttccttaccatggtcaggtgtgtggctggctccttaggaatgagcttggcatggattaggtgtgctagagctgatggattttttaaaaagtctaatttacatagagtgaaatacatagatttttaagttgtacagtcttagttgtacaatttgagctttgacaaatgtatataccttgaataacccataccccaatcaagattgtttcaccccagaaagttcacttgtgccacttctcagtaagtccacttccttccaactcccacctccccggcctagtagtgattgttctggtttctcactatgtttgaggccatgggttttaaaacatacagattttcttcaagtctagatggtgagagatgtcagaaagtaatacttactcaagtaaatcagaggttctcagtgggagagttgctccccaggagacatttggcagtgtctggagatgtttttgactgtcgtgactgggaggaggtgctactggcatctagtgggtagaggctagggatgctgccaaacttcctgcagtgcacaggacagccccacaaagaaggacccaacccaaatgtcagtagtgctgagtttgagaaatcctcgagtaaatcatgtgttctctgcaaactaagaattatggtcctggggagtgttcatttgtaggtctcccaggtctcctggggtgaggtttgctttttctttgttttgtttgcttgtctgttgagagcctgctggaagctgaaaaggccgctgcaggagccagctttctttggtgctaccacccttgtggccacagttcttgctgtggaatgggtatcagggtaggcttagggaggaaaactaataggagaagaggaagaagaagaaaacagtttaggcagtaaagggaggcaggcctagaataatattaaaactagaaaaacaagtaagataagaggggaaggtaaagtagaaattaataattaagaatccaataaaatgttaaaggaaatgagttgagatttaaaatcaaagataggctgagtgtgttggctcacacctgtaatcccagcactttgggaggccaaggcgggaggattgcttgagctcaggagttcgagaccagcttgagtaacatgatgagaccctgtctctgctatatatatatagttatgtatagatatagttatatatttatatatatatataatatatatatttgccgaggctggagtgcagtggcacgatctcggctcactgcaacccctgcctcccagtttcaagcaattctcctgcctcagcctcccgagtagctgggattacaggcgtctgccaccacgcctggctaatttttgtgttttttgtagagactggatttcatcatgttggccaggctggtgtcgaactcccgacctcaggtgatccacccacctcggcctcccaaagtgctgggattacagacgtgagccaccgcacccggccttactgtgctttatgagaaataaatacacccctgaagtgctgaggaagtccagacccaaaaaacatgttcttatggacttaaaatttcaggtcaactttttcttaatttccaaaagacaacagtttctaagtttgcctactttagcttttcaagtaaaataaaagatacatagatagatgactagacctctagctgtctgtcggtctctggaacatgtccaaaaccaactcatcatttttccctcagacttgcccctctttttctacttcctctctcaggaatgctgtgtcaccacccaactagaaaaacccatcggaaaccccaaggtcacttaaaatctactcttttcctgattttcgaaaatccaatacattgttgttaactctagtcattatgttgtacaacagatctcttgaactactcctcctaactgaaactttgtacttttgaccaatatctccccaactccccccagcccttgccctggtagccaccattgtgctctctacttccattagttcaacctttttagattccacaaaaattaatttgtgaggtagtgcatatgttaattagctcaatttagccattccacaatgtacacatatttcaaaacagcatgttgtacacaataaatatacacgattcttgtcagtttaaaaattaaaataaatgaaaataaaaattaaaccaaggtcatcgtcactcttcctttccctttggtcactaagtcctgctaattttgcctattaaactatctcaattctactttctcctctttctcctctcctgtgcaatctttccttgggcccttatttctttccttcattgttttagcagcaccataactggtcagctggccctttaatgacttaaagcgccacactgagaaataatcgtctttctaaatggcaaactcgattctatattccatccttatttgagatcttttggtatttattacctaggacttttatgtgagccacacgagtcccattatgatctggctacaaccaacttctctgactcatctctctgtcactctgctccctcccacaaaactcgaactccctacacttctcccatgctgtttcccagcttcgtggcttcacacatgctgattcctctgtctataatgtcctatacttgttttgtctttctgtagaactgcctaagagccgggagaattcatgcttttgaaacaaggggaatttcccttgtccctcttacagggcatgtgatgggagtgtggcccacttcttaggtgccccactgctcaaaacccctagggaaagcaggcagatgggcaggtcgtggggagtgtgggctccaaccccatggcagcgtctaggggtggatgtttacagcttctgcagccccagtgggcgtgtgttacgtgtgctcttttagttttgctgtcagtaggcagcttgtgttcatcagctcagttagaccctctgccttattgcaaggacagagggctttctgtatcctagggttcttgcctgagtataccagaaaaaccggatcacacgtgggcttggaggatgagtgcaaggttttattgaatggtggaagtagcactcagcagatggaaacggagccagaaggggtatggagtgggaaggtggttttcccctggagtcaggccgcttagcagccaggctctcctctgaccgccctcagccaaactccgcgttgtcctgccgttctgctgttggtggcctgccggagtctgtcactgtgttcttctgctggtatgttgttccttgcctctgcttctcttgacgtccagccgcttgtgtgcctgcccgctagggtctcggggtttttataggcacaagatgggagtgtggtgggccagggtggtcttgggaaatacgatatttgggcacaaaaacagaaatgcctgtcctcacctaggttggtgggcacaggcccaggggtggagccctagccagggaccacgcccttctctacccagcatttccctgcctgcccctcccgtatcacttttcttttatttatttactttttgagacagggtctcgctctgttgcccaggctggagtgcagtggcagtatcttggctcactgcaatctccacctcctgggttcaagcgattcttgtgcctcagcctcccttattttattttttaatctgtcccaggccaagtgcagtggttcacacctataatcccagcactttgggaggccgcggtgggtggatcgtttgaatccaggagtttgagaccagcctgggcaacatggcaaaaccctgtctctacaaaaattacaaaaatgagctggacatggtggtgcatgcctgtagtcccagctatttgggagacaagacaggaggagtgcttgaacctgggatgggaaggttgcagtgcagcagaaatcctgctgctgcactccaacctaggcaacagtgtgagaccctgtgtaaaaaaaaaaaaaaaagtttgtccatttatttacatctatcaagttcttcctaccagaatggaagccctttcagggtgaggatatgtcttactccatattcctatttctatggctgtgcctaacacacaaggcatgctcaataattgtttatttcctgctcaaatgagacaaaaggaaatggatggaggagaggtggaaaataaatgagtgattgatttctctctaactatttaggcatgatttagcatcttggaaatcatattactgagatttgcagtgcctgtaatgtgaaagatgaggctattctgtaatacaaaacgtaatgccagctaaaatataacaaaaatatctgttgaaacgtatggctgcaaattcccatatttcagaagcaaataaagagctgaaagccattaagaaaaaaaagggtggttgttactttaactggtttaaaaacaattgatacatcttgaagtattaagtgtgcatcttgaggtcttaatttcaatgcagttttgctacagatttcttttgcttccacgatacagattagccagctagtgctgacattagttcatgtggtttgtgcccatcacaattattaggcagaaccagcagcaccaggatacaacctaaggagatcaacgtccctcctagaaaactgccacggccttcgcaggaggggtctgaatttttttttttttttttttttttttttttgaggtggagtctcgcactgtcacccaggctggagtgcggtggcacaatcttggttcactgcaacctccacctcccaggtgcaggtgattctcctgcttcagccttctgtgtagctgggattacaggtgcccgccaccacgcccagctaattttttttttttttttgtaattttagtagagacgggatttcactatgttggccaggctggtctcgaatgcctgacctggtgatccacccacccgcctctgccttccaaagtgctgggattacaggcgtgagccactgcgtccagcacattttttatattcacaattaaattaataaaccataactctcctcctctcagcccatctttttttttttttttttttttttttttttttagtggagcgattattttgtgtgtgtgaaacagagtctcactctattgcccaggctggagtgtagtggcatgatcatggctcactgaagcctcaaactcaagagttctcccacctcagtctcctgagtagctgggactacaggcacacaccaccatgcctggctgattttttaaaaaaatatattttgtaggccaggtgcactggctcacacctgtaatctcagcactttgggaggccgaggcgggcgaattacctgaagtcgggagttcgagaccagcctggccaacatggcaaatccccatctctactaaaaatacaaaaattagccgggtgtggtggcagacgcctgtaatcccagctacttgggaggctgaggtagaagaatcgcttgaacctgggcgttggaggttgcagtgagctgagatcacgccactacaccgcagcctgggtaacagagcaagactccatcttgaaaacataaaaataaataaaaataaaataaagcacagtaagcctttcagggtggggagtggctgaggttatgaatatgctcatgttctgcacattcggtctgtaacatagagaggtttaagattgcttctgcatttcaggtaattcagaggtccgtggggccagccagcctgagcttgctcaccttcaaagtctatgcagcaccaaaaaaggactcacctcccaaaaattccgtgaaggttgatgaggtaacatgttgttcatgttgcgatatattttgagtgtctgatttagttactgtaggataattttttacaaattgtatatcaggaagatgtgactgtttaaaatacatttatttatttatttatttatttatttatttatttattttgagacggagtttcgctcttgttgcccaggctggagtgcaatggtgcgatctcggctcattgcaacctcctcctcctggttcaagccattctcctgcctcagcctcccaagtagctgggattataggcatgtgccaccacgcctggctaattttgtatttttagtagagacaaggtttcaccatgttggccaggctagtctcgaactcccgacctcaggtgatccacctgcctcggcctcccaaagtgctgggattacaagcgtgagccaccacgcccagccagaagacatttaaacagagaaaatatatttccttatagtttgtttaatttgtgggaaatattaaactatggctttttcaacagataaactttaatgatacttaggtaagggcacaattaaggaatactttataaatgtttactggggaatccactgtgtcccaacaggttataagcacaactcacttttctaagtggtctgcctgattcttggcttatcttgattcttatcgagccaagaatatattcacattttttcctctctaagaaattagagatctggatcctttctgtttcttggctagaggagccgctcataagtatgtacttaataaatactaaatttaaaaaaaaaaaaaacaagaaatcttctctctactgtttacattcctttttggtctgtacttcccactaattattttggatattcagtttctgttgcctttgaataaagtgaggtaaggatctaccttcagtcctgggtagggttactagattggtgtttacataaagctaattagcttatcttttgccctttactcgcttctcaggccttggcacagtggcatttttgagggtaaagaaggcagccagcagtggctgtaagaagttctctgggtggagaataaacctgctgtcctgctttgattaacatcagaccaatcatttgaactgaatgacatgccctttggttactctcaagcttttttaaccccttcacccaccctttagagtaataaaatcttttttccaagctcaatctaaggtggaataccaaataccagtatataaaatggataaagaggagctgctttgtttgtagtcagtgggtggggagaaagtaggacacctcatagccctgcccttttggccttggcctcgttgattatggaaataaggtgcagagatagtttgagataaagttcaggttgcttgtaacccttagagtcactggaattcatgaagtattattattattatttttgagatggagtctcactcttgcctaggcttgagtgcactggcacaatcttggcttactgctacctccacctcccaggttcaagagattctcccgcctcagcctcccaagtagctgggattacaggcgcctaccgcgacacctggctaagttttgtatttttagtagagactgggtttcgccatgttggctaggctggtctcgaactcctgaccttaagtgatccgcctgccctggcttctcaaagtgctgggattacaagcgtgaaccaccacacccgaccacagagtcactgtaattcatgaattactagaaatattatattaaatacttacaaatttgataaatgtatcctgtagacagtacatcttttaaatctttgttttgttttaatgtgcgcagctttcactctactcagttcctgagggtcaatcgaagtatgtggaggaggcaaggagccagcttgaagaaagcatctcacagctccgacactattgcgagccatacacaacctggtgtcaggtacaactgttctgaaaatggagtgaacgcatttctgtttagagtccatagaggaaagtctgtattggctgcatgtttttggaaaaaggcatgataaagggccctgagatggttgacagaggctgggaagggtagtgggggtctgggggaaaggtggggatggctaatgggtgcaaaaaaaaaaaatagcaagtagcaagaatgaataaaacctatttgatagcacaacaggatgactgtagtcaacaataatttaattgtacattttaaaataacttaaagagtgtaattggattgtttttaacactaaggataaatgcttgagcggatagattccgcattctccatattgtgcttatttcacattgcatgcctgtgtcaacacatctcatgtgccccataaatgtatatacctactacgtacccacaaaaaatgttgaaatacaaggccccaagttaaaagtgcctgacttacagatgttcttcagtgccatctgaggaggggttgcagagatgccctagcttcctggtgacagctgttgccacagctacagagagaatttccctctccctgggcagtgcgtaacgccttaactagagagcagaggggctaggaactaccttgttgcttgcagttatgaaaacattgttgtctaccaggggaggcttgtgggctggaactctaaacaaaggaaaaagatgcaacgtaaacacttacataaaaattgcgaagtttttctccccccactatacaaatcagtgccacttaaaccaggaggggatatggcattttgaatgctatactaaaatagggtagaattccatactggattactgaactatttgttctagtgaccaaagaactacatatacagattggtttctgtccctgcctgggttttaggtcaggcatttgtcattacgtaaatgaaaagtatttctgtgatttttaacatcagtaaccaacgtttacaatctatagaatgcttttgtaggctttgatacatatgtttgttgtacttgatcttgattttgaaaattgaaattaataaaaactaatagatgtagatatgtgggaaattgtctagatttaccttgcttgagatttataaatttagtctttttgtttttttttttttttgagagggagtcttgctctgtcgcccaggctggagtgcagtagcgtgctctcagctcactgcaacctccacctcccgggttcaagcagttctcccgcctcagcctcccaagtagctgggattacaggcacgagctaccatgcctggctcatttttgtatttatcgtagaggcagagtttcgccatgttggccaggctgatgtcgaactcctgacctcaagtgatctgtccaccttggcctcccaaagtgctgggattacaggcgtgagccaccatgcctggcctaaattcaattttgatccagagcttgtttaaaaatttttaatttccgttgcctatgctgctgttgaacttttgttcaccaatttagaaagaaaatagtaaagcatggactctatcaacaataagaattaggccattatacttaagtatcataaccatattattgagttaagtaatacctaaagactttaaacataacatgttgtaaaatgattagactttattctcttgttctagaagatttttaaacttctggtagttaagataaagtcagcaaatttgtgtgtatatttttgtatcatgtaggcatgactactgttacttgtagtctgtctgttttttttgtttgtttgtttggtttttttggcaataaaagtactttgtaccttttagcctaaggttgctttttgttttttaccttttcttccatgcgtgatactcagtgcagcaaaatacctctctggatgatggattagttatctatatgtttatttccactactactaaatataaaaacttgcttgtaattataatagtttttgtaattataatggttttgttttcctgggtagaacaaagcctttatgagtagaaatatttctaattcctggttcctttttcagaccagcaatttctagcccttttcttgaagaaccaatttaattttgtttttttgttctttgtttttctttttttgagacggagtctcgctctgttgccaggctggagtgcagtggtgcagtctcagctcactgcaacctccgcctcccgggttcaggtgattctcctgcctcagcttcctgagtggctgggactacaggcgtgtgctaccaagcccagataatttttgtatttttagtagagacggggtttcaccatgttggccaggatggtcttgatctcttgaccttgtgatccgtccacctcggcctcccaaggtgctgggattacaggcatgacccactgtgcccggccttaattttttttaatagtaaaaatattaagctagcaaaagaagtcggcaatcattctagatattgatctgaagttttttcttttttttttttttttttggtagagacaaggtttcaccatgttgcccgggctgatctcgaactcctgggctcaagagatctgcccacctcagcctcccaagtagctcggacatcatacacataccaccatgcccaactaatatttttatttttatttttattttttttatttttttgagacggagtctcgctctgtcccccaggctggagtgcagtggcgcgatctcggctcaccgcaagcaccgcctctgggttcacgccattctcctgcctcagcctcccgagtagctgagactacaggtgcctgccaccacgcccggctaatttttttgtatttctagtagagaccaggtttcactgtgttagccaggatggtctcgatctcctgacttcgtgatccacctgccttggcctcccaaagtgctgggattacagccgtgagccaccgtgcccagcctaatatttttatttttttgtagagatggggtctctgctgtgttgcccaagctggttctcaaattcctgacctcacgagatactcctgtcttagcctcccaaagtgttgggattacaggcgtgaaataatggattttaatgaagcgatactcagttctttagatcttctggctaattcggcatttattatttcaggtcatttaaaagaatgaggatagcttgttctgacttgaactgaattacacaaaacaaatccttttccaggccgggcgcagtagctcacgcctgtaatcccagcagtttgggaggccaaggcaggtggatcacctgaggtcaggagtttgagaccagcctggccaacatagcgaaaccctgtccctaccaaaaatacaaaaattagttgggcgtggtggcgggcacctgtaatcccagctactcgggaggctgaggcaggagtaatcacttgaatccaggaggcggaggttgcagtgagccgaggtcgcgccactgcactccagcctgggcgacaaaagcgaaactctatctcaaaaaaaaaaaaattaattaataaaaataaaaataaaaaaaaaatcctttcccaaatggcaactagttttgataccttctgatacccatgtatctcttcttgtcttcactgtagacttcttgaaggtgggtaccttctagcgggtccctcgtttcctttaggatcatgtgatattcatgtacaaagccttttttttttttgagacacgcccaggctggagtgcagtggcgccatctcggctcactgcaacctccgcctcctggattgaagtgattctcctgcctcagcctcccgagtagctgggactacaggcgcgtgccaccacgcccggctaatttttgtatttttagtagagacagggtttcaccatgttggtcaggctggtctccaactcctgacctcaggtgatctgccccactcggcctcccaaagtgctgggattacaggagtgagccatcatgcctggccacaaagcctttttattgtttttaagagaatgttgacacctcatttgctttgggctatagcctttgtctcattaaagctggtcattcttgcttcaaatgggcagtttccagatgtaggctctaattaatggcagatcaggaagtagttaatatgaaagacaggtttaatctcatggagaaaagcttgccacttaaatatcaaggggattgatttttagtctattttttccattttaatggaagagtgaaatggctggattgttgaaaccactctgtttggaatctgcttcctgtggcagtagtaagccattctgctgagtaatttgcagtgaagggaagattataataggaaaaacaaacaaaaagacccagacagacagtgtatccctttgttcaaaaagcgttaataacatgataatttattcagtaaaaacaagtatatttattctgttaactttctaatcagcagatcctgtgaatagtttcattcagtttctttttacctttttaggaaacgtactcccaaactaagcccaagatgcaaagtttggttcaatgggggttaggtaagttgattttaaattaggcataatcagctacttcattaacattgaactctttaatcggagttccatgaatgagctccaagaaatctgtgtattccttaaaattatatgcagaattttagagctatgtggatttttctgggaagaggagctgttgttttcatcagatttcaggcaactagtgtccccaaatagtcaggtaagtctcttcaagatcgttaggattcttgggctagcaagtacagatacactgctttaaaaaaaagaaatctcatttctaggtgcagcgtaatacaccatactaattcatcaatagattttctgaatcggaatagctcatttgcattgcaattaatagatgctctagaagttttgaagcaggaaggagctgagttggtactcctataaaaggtcttactgcataattgatagtgttcttacttttttttcatttggttttattttccttgattatttttcagttgtgggccacttatcacatacactcacaaactggattcacagtccatgttctgactaatcttaatcagaaactggtaaattaataaagataccgatcatatttcattccccttattaggcatctcgcaaacaaaatcttgtttttacaagggtttgtttccatgatagaacaaaataaacataagtacagtttctttggtaagatcaccatggtgtattgatgtcctgatatttctgagactgtcagataaatttatcgtttgaagacaaacataacaatagctgcctactggttttttgtttttttttttttgagacaaaatatcactctgtcacccaggctagagtgcagtggcatagtctcagctcactgatacctttgtctctcaggttcaagcgattctcccaccttagcttcccgagtagctaggattacaagcgtgtgccaccacatccacctagtttttgtatttttagtagagacagggtttcaccttgttagccgggctggtctcaaactcctgacctcaagtgatctgcccgcctcggcccaaaatattgggattacaggcgtgagccaccgtacctggccccctactggttctttaaattattaaggcatgttaataagtaacatcttaattttattaatttcataaacacttatttaagacttatatgtcaggtactattctaagtgctttacaaataccaatttattgggggtggagtgaggatggttaatgagtacaaaaatatagttagaatgaataagacctagtatttgatagcacagtagggtgactgcagtcaataatactttattatacattttattttttattattttatttattttttatttttttgagacagattctcactctgttgcccaggctggagtgcagtggtgctatcttggctcactgcaacctctgcctcccaggttcaagcaattctcctgtctcagcctcccgagtagctaggactgcaggcacacgccaccacacccagcctattttttgtatttttagtagagacgggtttcaccatattggtcaggctggtgtagaactcctgacctcaggcgatccacccacctcagccccccaaagtgctgggattacaggtgtgagccaccgcgcctagcttattgtacattttaaataactaaaaaagctatactcttttaggtattgtaaataaactgaaagagtataattgggatgcttgtaacacaaagaaaaatgataaatgcttgaggtaaaggatacttcatttaccctgatgtgattattatgcattgtatgcctgaaccaaaatacctcatttaccccgtaaatatatacacctactatgtacccacaaaaattttatatatatatatatatatatataaattctcataacaagctgacagataccttattatcttcatttttatccgaggaaactagagaactcctgatatagtcttttatctgtccatgtgtggctgagaggtctcttgtttaaatttttctgagacaggatctttctctgtcatccaggctggaatccagtggcgtgatcatagctcactgcagcctcaacctcctgggctcaagcaatccttccagctcagcctcccgagtagctaggattacaggcatgtgccatcacattttttccactttttgtagaggcagggtctcacttttttgcccagactccgtacagtcttaaaacatatcttctttcccctttctttgtgatttacccactttggcccagctcaccagagccatctgggtgtccctctgtcaactgctctgtgtacacatctagaattgagcaacactgggctagtaggcaaaaataaagggaagtaaaaaattgcctcaaatgacccagactagaggatggaaagtaaaaactaggctaaaggcaaaataagtaacaggccagacagtaattaatgcaaacataatacaagtcctatagtagtatttaaaatgatcacatttcccaaagaacccaggaaaaggaaaactggcgtgtatctggtattacttaggggacagaattgctgagttttccagtttattagttcagttctgtatatattttttaagtcaccattctgccaggcctcgaaaattgagattggttaagacagtggtcacaaccactgagatgcgtgtaatatattattcagtactagtgcaaatacagagataatcacagaccattattgaaggtacagaggaaggagattagtttaattgaaatcgaggaggtgggagcagtcagggaaggacttctgaagtgaatcttgaaggagcagtgttagccactccaaaatgtgggggtgggactgctggaagcaggcattgcacactgggcccagcatgatcaggcttagaggtgtgacttggtattggatgtttgaggaaccctaagtagatagggagtgctgaagatgagattgagaaggagacatgagggctttgtgtaagtcatgacctagctaaaattcatttgttaattcatccagtatttttttttttttttttttgagacggagtcttgctctgtcgcacaggctggagtgcagtggcgcggtctcggctcactacaagctccgcctcctgggtttacgccattctcctgcctcagcctcccgagtagctgggactacaggcgcctgccaccacacctggctaattttttttttttttttggtatttttagtagagttggggtttcaccatgttagccaggatggaatacatccagtatttatcaactcctggcagtgtgatttttgtttttttgtttttttgttttttgagacagagtctcgctctgttgcccaggctggagtgcaatggtgtgatctcggctcactgcaacctctgcctcccaggttcaagcgattctcctgcctcagcctcctgagtagctgggattacaggcacacgccaccacgcctggctaatttttgtatttttagtagagacggggtttcaccatgttggtcaagctggtctcgaattcctgaccttgtgatctgcctgcatcggcctcccaaagtgctgggattacaggcgtgaaccactgcgcctggcctgtttttgtttttgtttggagacagggtctcattcagtcacctaggctggagtgtagtggcatgatcatagctcattgcagtcttgacttcctggactcaagcaatcctcccacctcagcctcccaagtagctgggaccacagacatgcatcaccacacctggctaatttttttttttaattttttgtagagacagggtttcgccatgttgcccaggctgttcttgaactcctggactcaagcaatcctcccaccttggcctcccaaagtgctgggattacaggcgtgaaccactacacccagccatcattcttaataaatatctattgaatgaacatccattattaccactgagggaagataacacagaagtgtaagcaatctatcattaaggagcttacattctccttggggagacaccagatatacacctgaataattaaacacagggtactataggattaggtaccaagtgatggtacagagaataaatatgatgggactttagaggagggagagaggtgtgaactgatgagcttaggaaaggcttttgtgtggaagtaggactcaacttggcttttatgaggtgggattggctcagtggagaggagacgaggcattatgtgaatgaagtcagaaggcatgttcagtcatgatgaataggtcacatgttgtatttatttttattctatcaccatcaacagcgatcaacagtggctattttctgagtgaaattacaagtttcctttattatccaaatttattctgttcttctgttcgagtaatgagttcagatggcaaaggatgcttatttttctgagtctaatgtatttgatttctttcttttttttttttttgagaaggagtctcgctctgtcacccatgctggagtgcagtggcgcgatcttggctcactgcaacctccacctctcgggttcaaatgattctcctgcctcagcctcctgagtagctgggattacaggagcgtgccaccacgcccagctaatttttttgtatttttagtagagatggggttttaccatgttggtcaggctggtctcgaactcctgacctcgtgatccgccctcctcggcctcccaaagtgctgggattacaggagtgagccaccgcacctggccttcctttttttttttttttttttttttttctttttaagaggctgtgtcttgctctgtggctcaggctgtcaggctgtcaggctggagtgcagtggctcaatcctagctcaccgcagccttgaactcctgggctcaaatgattcttctgccttagccttggaaagtgctgagtttataggaatgagccaccactcacagcttgtttttggttcctgagtttcagagagcaagcagcaaagcttcagatagcaatagatctatccaaagatttatccaaatctattctgtttttgtgtttccataacaagagtttgaatagcaaaggatccctgtatttgtattcctccctgtgcaaattgctgattcagatctgttgctttcaggaatatgaaagtaatttaacatttacttcattgtcagtaggttgttggaccaaaggtacttgaaaattggacacttgcagccgggcgcagtggctcacacctgtaatcccagcactttgggaggctaaggcgggtagatcacctgaggtcaggagttcgagaccagcctggccaacatggtgaaaccccatctctactaaaaatacaaaagttagctgggcgtggtggcgggcgcttgtaatcccagctacttgggaggctgaggcaggagaattgcttgaacctgggaggcagaggttgcagtgagccgagatcacgccattgcacaccagcctgggcgacaagagcaaaacttcatctcaaaaaaaaaaaaaaagaaagaaaagaaaattggacacttgctatgtgaatagtaaatcttgtttatatgtcacataaaaagagtatgttgaagagaagtatagtagcaggatgcagagaatatgtggtttgaaaagcacttgatactatatatacatattatatactgtataagacttttgttttgttttttaatgagaaatttatggaactgcttcctggtctaattctattgtagacagctatgactatctccaaaatgcacctcctggattttttccgagacttggtgttattggttttgctggccttattggactccttttggctagaggtaggtgcaattttatggctttaacagtcagctcataaagcagagatagaatatatgtttcattctttcccttcatttaccaggtttcagaataatgagttggttcctaaatacggctttcttaatgtataatggatatggttatcatatttgattttaaacataaatagaaattgtatactcttggtaaaaaaaagaagttatcctttataggcacatttacttgatcaaatctctgttgttctttggtacagaaagagcaaaattttaaagtctttcacacctgagaaatcaactgtttctaaacgtttcactattaagatcaagctatattaatcacagtagatagagcagtgatttaatagagattttattaccttcttgatttgtcatgccttcagtcagtgatgacaaaaactttaaaaatgctttaaatactaacaaatgccaacttaaaaatattactatactgctagattataaaatatctataggaaataaaggctaataaaatactttgctatgatgagatgaatttgttatcaactacttgaagttttgctagttggaaactaaatgtttatgatataaaattctgacattaccatcattcctaatgaagaaagtttatgaatcctgtaatcagacccctgtaaaagagaaccatagagactactctggtccctgtattagtttgttttgcattgctataaaggaatatctgaggctgggtaattataaagaaaagagatgccaggcgcagtggctcacgcctgtaatcccagcactttgggaggccgaggcaggtggatcacaaggtcaggagatcgagaccatcctggctaacacggtgaaaccccgtctctactaaaaatgcaaaaaattagccgggtgtggtggcaggtgtctgtagtcccagctactcgggaggctgaggcaggagaacggtgtgaacctgggagacggggcttgcagtgagctgagttcgagccactgcacttcagcctgggcgacagtgcgagactccgtctcaaaagaaaaaaaaaagaggtttatttggcttatggttctgcaagctgtacaagaagcgtggcatcagcatctatttctgttgagggtttcagaaagcttccaatcgtggtggaaggcaaagggggagcaggcgcatcacatggtgagagagggagctagagagatgccaggctcttttaaacaaccagccctcatgttaactaatagagtgagaaatcactcattcccacagggagggcaccaagccattcatgagggatccacccccatgacccaaacacctcccagcgtgggggttcacatttcaacatgagatttaaaggggacaatcattcaaactgtatcagtcctattcctccaatttaaaaaatcttccctctacatgcaatagcttttactttagtttagtttagtttcgtttcgtttcgtttcgtttcgtttcgtttcgtttagcttaatttgagatagagtctcactctgtcgcccaggctggagtgcagtggcacaatctcggctcactgcaccctccgcctcctgggttcaagtgattctcctgcctcagcctcccaaatagctgggattatagatgtgcaccaccacgcccaactaatttttgtatttttagtagagatggggtttcgccatgttagccaggctggtctccagctcctgacctcaagtgatcggcctgcctcggtgtcccaaagtgctgggattacaggtgtgagccactacacctggccttattttttttttaattgatttcttttttgagacagggtctcactctgtcacccaggctggagtgaagtggtgtgatcatagctcattgcagcctggacctcctgggctcaagtgatcctctcaccttagcctttcaagtagctgggattacaggcgcctgccaccatgcccaggtaatttttgtatttttagtagagacggagtttcgctatgttgctcaggctgaactcctgaactcttgaactcttgaactcctgaactcaagccatccacctcccttggtgtcccccaaagtgctgggattataggcatgagctgccgcacccagctaatggctgttatttttgaatctggagggtagacactgccctggtggcactaccagctcacctgtggaagcaactcatgtcacagtctttgtgccctcctcccatctcatgcagaatatgtcagaattaaatttccagcttatttttgtaatcaacttatgaaccaacatttttccctaaacttctttcacctcatttcttgcaaagctgttcagaagagcattcggtcttatttagatagcgtttgagattgatgaacatcccaaggccagggtgttgggatttcagctatcgttagggagataggaatgtagaagtgagtgagaggagcttccccctccctctcctggttagagcatgtgggaaaatcttccaggtccaaagaaagcactttttctgtgctgtgggtacgttcctacagtgccgagagcttgtccctggaacatccactaggatgaccatcctaaggaggattggagatggtgctctcctggccagagcagcagcatgaggacatctgctacagtgggtcctagtcctctgattttgtttgttcgttctgtctcttttcttccttttcctggggagagcttggtagtattaaaataatttgacaccttaattctttttcacaaatattcacacaggcacgcacacacacatgtgcaatagcaggtcttttctcctgagcgttgggtatagaaagacctgaggtgagcagcatcagaggggttcaccaagcaagatgagtggggtgatagggatgtctgtgggtagccagaatggtttgcaggcccctccaggtgaatgggcccctttgagggcagcagcagggtgggtgggtgcagaaggtccctcctgataggagtttcttttttttttttttgagacagtcttgctctgttgccgagactggagtgcagtggcgccatctcagcctcactgcaaccctgcctcctgggttcgggtgattctcctgcctcagcctcccgagtagctgggactacaggcgtgcaccaccatgcccagctcatttttgtatttttagtagacacgaggtttcaccatgttgaccaggcttgtctcgaactcctgacctcaagtgatcctcccacctcagcctcccaaagtgctgggatcatagttgtgagccactgtgcctggcctggtggggtttcttgagcgtatctgctaaggtagtctgcttcagttgttgaggattgccacaactgtggtggtgacaagaggctctcagagaggtgaatggatgtccattcagaggaagtgggcccagccagaccactccaagatgacacgtggttgttgacactattgttgccttctggtggctctccccagcattggccaccagtggttccccccgcccctggcagtgctgatagtgacaacctgtaccactggcctcttgggagatagggcatggaggtgggggcaggggagtatgattacacctccttcctgaagttcttgggtctctggctcattgtgtgaaccagcaggagctggaggcccgagagctgccacttctcggctctccctggaggagtgagaaatgactgggtggcaggttggctgctctttccctggtcctcacttgggtgagctgcttcaagtggatgggggcaggggaggggccatatgcagggatatcacaggcttttctcttctaggataattataccctttcaattcatgcaacaggatcaggagagaaacagtaaatcattaatagtctaggttgataacatttgtattctcttcagcagtcccagttccatcgttggggatttctctgtttaaagttttaaagccaataaacagtacttatgtgattagaaccgtttaaggattaatgtacacattctgtcggggtacagtggctcacacctgtaatcccagcacttcagaagttcaaggcggatgtatcacctgaggtcaggagttcaagactagcctagccaacatggtgaaacccgtctctactaaaaatacaaacattagccaggcgtggtggcgggtgcctgtaatcccagctacttgggaggcgaaagcaggagaatcacttgaacccgggaggcagaggttgcagcaagccgagatcgcaccactgcactccagcctgagcaacagagcgagaccccatctcaaaacaaacaaacaaacaaacaaatcagccgggtatggtggctaacacctgtaatcccagcactttgggaggctgaggtgggtggatcacctgaggtcaggagttcgagaccagactgaccaacatagtgaaaccctgtctctactaaaaatacaaaattatttgggcatggtggcgcatacctgtaatcccagattcttgggaggctgaggcaggagaatcacttgaacccaagaggtggagattgcagtgagccgagattgcaccattgcactccagcctgggcagcaagagcaaaactccatctcaaaaaaaaaaaaaaaaatcaataacacacacattctgctagcatctatatgggtcccacagcaaaaaacactatgcctctcagtggagtcaaggccatgtgtattctctagtttcatcctctactggtttttttaacctcattctcaggtttctccaggctctgtgtcctgctgtctcttctgtccatttcccttgctccacagctctatatcctcctacaatctggcctgagacttcaacacagttcttgttttgggactggtcttcttcacactttcttgggtttaagcccccttttcctgggttccatgtcatcttctccttggtttactctgccgtgctgttgaactacatgcttaagtcactttcaaaaaagcgtatgttggaggtaaacttcccaagaccttccatgtctgaaaatcactttctgccctcataccatgtgacagtttggttgggcactgaattttgtttgccatcaaaactttcaaagccatgtattctagcatctggcgttgtagatgtgagagtcagtagccattctggatatttgctgcttctgaacaggtgatacattttttttttcttcctggaagctttgaagatcttctgtgaatctttagtgttctgaatttctttggtgctgtgactagatagaagtcttttctttttttttgagacggagtctcactctgtcacccaggctggagtgcagtgtcacaatctccgctcactgcaacctcctccacctctgggttcaagtgattctcacgcctcaacctcccagttagctgggattacaggcgtgcaccaccacgcctggctaatttttgtggttttagtagagatggggtttcaccatgttggccaggctggtcttgaactcctgacctccagtgatccacccgcctcagcctcccaaagtgctgggattacaggcatgagccaccatgcccagccttggatatagtgttttcattcttgcccaaacaatatggcggcttgcagcatccagctgaaggaaaatatcttcttttcctccctccctccctccttctcccttccctgccctcccctccctctctccccttccctccttctccctccccttccctcctccctccccttccatcccctgcatccctccctcccctccctccttctcccttcccttccctccttcttccttcccttctcgtcccgtccctttctcttctcttctcttctcttttctttctgagagatgatctcactctgtcacccaggttgtagtgcagtggcatgatcagggctcactgcagtcttgacctcctcaggctcaagcaatcctcccatctcagcctcctgagtagctgcgactataggcatgcaccaccacacctgactaatttttttttttgtggagaccgggtgtcaccatgttgcccaggctggtctcaaactcccgagctcaagcagtcttccttcttcagcctcccaaagcgctaggattataggcatgagccactgcgcccagcctatcttgtgtatctttgaaaatttactctcattctttttccttcctcaacgcattaattagcaattgagttatttaaaaggaccctatgtgtctcttatattttcttgattattttattttgttccttttgaattttttttgctttggtcatttccaagagctccttcctgttctttgaatgttctttttttcatagaattatttttttcttttaatgtagtggcttttaaaatttatttgatgatacttagtaataggtttagttttgttttgaagttcttctgtttcctttgtgcttgtcttggtctttctcctttatgtttcaggctttccacaaatgactggtgattcttggttatccagtcatgtttcaaagtgaggcagctgaaatgctaataagaactctttcacctgtaatcccagcactttgggaggctgaggcaggcggatcacctgaggtcaggagttcaagaccagcctggccaacatgggaaaaccccatctctactaaaaatacaaaaaatagccgggtgtggtggagggtgtctgtaatcctagctactcaggaggctgaggctagagaatcacttgaacccaggaggcagaggttgcagtgagctgagatcacgccactgcactccaacctgagcaacagagcaagactccgtctcgggaaaaaaaaaaaaaaaaaaaaaagaactccctgtctgtacatggggcccactgacgggcaggttctacctcaggggagctgggcaggaagtgaccatatacaagggtgcacccagggccagtgtgaggagggcttttctctcaggcactgacatactcaccccttccagctctcttggttctcagcaggaaatccatggtgtttctttagtgataccctgcccccactgttttaactcttttttttttttttttttttttgagacaggatcttgctttatcacccaatgtgttaggccattcttgcattgctataacctaacactgggtaatttataaagaaaagaggtttagttggctcacagttctgcaggctgtacaggaagcatggcaccagcatctcctcggcttctggtgaggccttgggctgcttgcaatcatggtggaaggcaaagggggagctggtgtctcacatggcaagagtgcgagcaagagaaagaggtgggggaggtgtcacacatttttaaacaaccagatctcaagagaactcactgttgcacaaggacagcaccaagggaatggtgttaaaccatctgtgagaaatccaccttcatgatcaggtcacgtcccaccaggccccacctccaacattggggattacaatttaacatgagattcagagagaacaacatccaaattatcacccaggctggagtgcagtggcatagacacagctcacagtagccttgaactcctgggctcaagcaatcctccagcctcagcctcctgagtagctaggaccacaggcacatgccaccacaccttactaattttttaattttttgtagagatgtggtctccctaagttgcccaggctggtctcaaactcctgggctcaatcagtcctcccacctcagcctcccaaagtgctgggattacaggtgtgagccactgcatcaggctcattttttttttttttttaaaggaatagagatggggggctgggcgtactggctcatgcctgtgatcccagcactttgggaggctgaggcaggtggattgcttgagctcaggagttcaagaccaacctgggcaacatgaggaaaccccgtgtctacaaaaactacagaaaaaaaaaaaattagccaggcatgatggcttgcacctcttgtcccacctacttgaggggctgaggcaggaagatagtttgaacctgggaggtcgaggctgcagtgagccatgattgtgccactgcactccagcctgggagaccgagtgaggccctctctcaacagaaaaaaaagaaatggagatggagtctcgctatgttactccagctggtctcaattcctggcctcaagcaatccttatgcctcgacctccccaagtgctaggattacaggtgtgagccaccacacccagtaaccctggtttactgggttttttaacattttgaactggtgtgacttcctggccaggggtagttttgtactgggatggcataggggaaggaaaggccatgctggtccatgcatcggacttgcgtttgtcctgtgcccttgtcttgctccctggttgccatctccactccccatggtacctgccatctctggatctggaatctccctggggctgcctgggacagatctgctccctctgaggctgcactcctcctcaagatttcaagatttcaaggcagtgtgtcctcttatttccgttcactctccattttctgaaaattgattgacacttcctttctgccagtggcccttccacacattttctcttcattgtgggtttattaatgttttttcttactgtttttttaacggggttgcagaaaggggagaagaagaacgcttgtgtttagtatttatataggaagccagattgctataaaagaacataaaccctagaaaccaaaatactcatttgtttatttttaaaataatctttttttctgctctcttagggaaaaaaaggtgttcttttgaaaacacttggtgctgagtgaaagaagccagtcacaaaggaccgtatatttactgcatgattccatttatatgaaatacccagagggccgggcgcagcggcttacacctgtaatcccagcactttgggaggccgtggcgggtggatcacctgaggtcaggagttcgagaccagcctggccagcatggcgaaaccccatgcctactaaaaatacaaaattagccgggcatggtggcgtgtgcctgtaaccccagctactcgagaggctgaggcaagagaattgcctgaacccgagaggcagaggttgcagtgagccaagattgcgccattgcactccagcctgggtgacaagagcaaaactctgtctcaaaaaaaaaaaaaagaaatatccagagtaggcaaacacatagagatagaaagtagatcaatggttgcctagggctggacggtacgggggagttgaggaatgactgctaatgggtttcttttagtgattatgaaaaagctctaaagttaattgtaatgatggttacacacctctgtcaatatactaaaagccattgaactgtactttaaatgggtgaatatgaattttatctcaataaagcagtgcaaaagcgttttggtgcacatgactttatttggcacattctttcagtttaggaccaaagaaatcttattcagtggtggggttattttggttttgttgtttgggtttcttaagagacacggtcttgctctgtcacccaggctggagtttagaggtgtgatcatagctcattgtaacctcgaactcctgggatcaaggaatcctcccacctcagcctcccaagtagctaggactataggcacacactaccacgcctggctaatttttttattttaatctttgtagagacaggatctgactatgttgcccaggctggtgtcaaactcctggcctcaagtgatcctcccgcctcggcctcccagagcttttggattataggcgtgagccactgtgcctggccttgttccgtattaaatggataaggtaaattgtgatggtgaggataatgaatcatctgatggcgtgtacaaccttttatttatcaggttcaaaaataaagaagctagtgtatccgcctggtttcatgggattagctgcctccctctattatccacaacaagccatcgtgtttgcccaggtaagagaaactctgtaatccatgatgtccctcattcttgtttgtgtgtgtatgaatctgatgcttaattttattttattttgcagttcttataacaccagactaaaatttgtttgtacatatagatgaatacagaaaatttaaatgattttctccactatatgcctcagttctggcccttcttccagtaatgccagtgttcacagaatttgaacacgaatttgcgtgattgtttgaatgttcatcagcaaaaatttaatatacattttttgtatacttacatggaagtctagagactcaaattccaaagctgataattatgggtcactcagtttatgcatgtccggtcacaacctgctctcgttggtattgtagacccagactactctgacttccactcctccctagtactggtgcccttgctttccttgctggggactttggggactgtaatcccctctgcttggagtgcccttttcggggctttcagttggctgctcctttcttatccttgaagcctcagtcttatggtaccctggcaagcaggtctatcacggtggcaggcaacatggataaagctgtaccaccgattcttaaaatgtgttaccagaccagaagcagcagcatcacctgagaacttgttagaaatgcaaactctcaggccccaccccagactgactgaatcagaagctctgggagtaagggccagcagtctgtgttttagcaagccctccggtggtttgttattaatgcctatggtgtttgagaaccactgatggagaccagtaggtagcctgaaaagggtgatatctggagtgagtgggactctagagatggtgtccctcaggaactggtaagaacaagacaggctctaggttttgaggtcctgggcagattgtggacacagggactttagctgctggaactaccacatcacatggaaactcagttccaggagcagacagcagtgcagtcacccaaattggactctgagccagactgacctgagactgagcttccttggttgttcatgacagtattgaatccagattccttgattgggctacagttgtatgtgagagtccagtggccccagcttggggagcttgatggctttgatgacaaataccagtactttccagcatttgctcaacattgtttgtaacagtcctggaggcagatagttaatgcttctgtccctgctccagccccaggtcaggaacagtgagtaacatcttccagccctagatataaaaataattaaacattatttcagcctgttatggtttaagcagtaaatagctagagtggagagggtgaacttggttgctcgttgagaagcatatgtggctgtccccagagtaggagtcttttttttttttttttaaatttctttcttttttaacttttagcgttaggtgtacatgtgcaggtttgttattgtaaatcgtgtgtcatgagggtttggtgtacagattattttgttacccgggtaataagcctagtacctgatgggtagttttttgatcctcgccctcttctcaccctccaccctcaagtaggcctcggtctctgttcccttctttgtgtccatgtgttgtcaaggtttagttcccaattacaagtaagaacatgtggtatttggttttctgttcctatgttagttcacttaagataatggcccccagctccatccctgtccctgcaaaggacatgagctcattctttttggctgcatagtattctgtggtgtataagtaccacattttctttatcaagtctaccattggctgggcatgttggcccacgcctgtaatcccagcactttggaaggccgaggtaggtggatcacctgaggccaggagttcgagaccagcctgaccaatgtggtgaaaccctgtctctactaaatacaaaaaattagctgggtgtggtggcacatgcctgtaatcccaactacttgggaggctgaggcaagaaaattgcttgaacccaggaggcagaggttgcagtgagccaagattgcgccattccactccagcctgggcaacaagagcgaaaactccatctcaaaaaaaaaaaaaaaatctaccattgatgggcatttaggttgattccatgttttgctattatgcatagtgctatgatgaacatatgcatgcatatatctttatagtaaaatgatttatattccattattattcccaataatagggattgctgggtcagatggtaagatcttttctattttgttttaaggtcagtggggagagattatatgactggggtttacgaggatatatagtcatagaagatttgtggaaggagaactttcaaaaggtgaggagcatctttttcattatcttccttttggtttaaatatgtggtttctctagggttttgtaaaatatttgataaccctgttgatttattgctttttctgtttgcttctagttctgtctccagctcagatttttcaggtgacctttcttggtagagcagtagaacttctgagtatttggttattatcagcagggccaaataagtggtgaccataaaatgcaatgcattccaccgtagtcttagaccatattttccattatattgtattcctagtttcctctaagtgtagcgtattatttaaaagtcttattgaaactgaattcaaagggaatgtactatgctcccaggaaaaagacataattgagagcctcttcctcttggtttttcacttatcatgagttctgttctttccttagcactgctgtttctgtttatcccccaggcttctcagctcagctgagggtgtgagccatcgtatgttggggactagctaccagctaaaggccacgttctctgtgctgtctagtacatgagcaacagagggaagaagttgtgtaattgtaagaacttgtcacctttcatctcttttagtggccacatagccgattaaatgttgcctatgttcgcttggaacattcccttcctcccactgataaggaagaatgagtagagaataaggtatcatgtctctactaagcactcagaggcacagccagctaaggaagaattagacttcttatattaatataccttctacatcacagattgaaggaagttcatttttcaatgaaaatactttttaaaaaaaaataaataactgagcttcaaatcattgacaagttaaaaaaatacatataaataactatctcagaattaaaatccagaattttgaactgggatttggaagtaacagaataaattataagccctctttattatttacataaataatcttctagtgaaatcttaagactcattttttggccaggtgcagtgactcacgcccagcacattgggagtccaaggtgggaggatcacttgagctcaggagtttgagaccagcctaggcaacatagtgagaccctatctctccaaaaaataaaaaatttagctgggcatggtggcatactttgggaggctgaggtgggaggattgcttgagcccagaaggtaagggctaaatagagtgagccatgattgcgccactgcactccagcttgagcaacacagtgaggccctgtctcaaaaaaaaaaaaaaagaaaaaaagaaaaaaaaccccactaatttttatactggtggtttctaaaggaattagtccttctcgagcctatttaaactagctcttgaataggaaattctataccaatatcaagagtcttttggcaatccctgtttttttgattgttttttgttttatttctctgatattttctatggaagcttcctttcctttttaaaaaattccttaacaaatgcggccaggtgcggtggctcatgcctgtaatcccagcactttgggaggccgaggcgggtggagcacctgaggtcgggagttccagaccagcctggccaacatgatgaaaccctgtctctactaaaaaaatacaaaaattagctgggcatggtgatgcacgtctgtaatcccggctactcaggaggctgaggcaggagaattgcttgaacccaggaggcagaggttgcagtcagccaagattgcgccactgtactctagcctgggcaacagagcgagacttcatctcaaaaaaacaaaaacaaacaagcaaaaaaacaaatgcacactaaattttatatgggaaaggaagtaaaatatcaagaaatctctaaacagccctagacagaaatgtggaaagtgagactaaaagcctcaactgcgagccttcattgtggtgtgactgcagactgaagcacaccaaagccagagggagtcccccaggctccccggagtgctcactgtggtgtctgtgcagacacacacgcacaccaaagctaaagtgagggctgcgggagcctctggcttggaaacagcattctctgactgtgctaagaattcagcccagtgcagaagcagctggactgtggttaggataccagttaagcaggccaacattttctggtcatttgaagacattagatattaaagctacccaaatttatatgcagatctttttagagtgaggtggtaaagatttttaattagctcatgattggtttgcatttctctctgtctttatacccttgccttcttcagagtcattgagaacttaaggctttctcctgtttgttactctccaaggataattttattgacagctgtctgttctcaatagaaggtaataaaatcagggccaggcacagtggctcatgcctgaaatcccagcactttgggaggctgaggcaggcaaatcgctttgagcctaggtgttcgagaccagcttgggcaatatggcaaaaccctgtctctacaaaaactaccaaaaaaaaaataataaccaggtgtggtggcatgcacctgtagtcccatctacttgggaggctgaggcaggagaatctcatgagcccaggaggtagagtttgtggtgagccatgttcaccccactgcactccagcctggtgaatgggagtgaaaccctgtatcaaaaacaaacaaacaaacaaacaaaaaaaaaaaacggtcgggctcggtggctcatgcctgtaatcctagaattttgggaggccgaggtgggcggatcacgaggtcaggagatcgagaccatcctagctaacacggtgaaacctcatctctactaaaaatacaaaaaattaatgttgactgcattaaatatttattacaagttttaaaggaaaaatagcagaaggccctattaattcaaaattcaatattcttaaatttcaggaattacttgatataatgaagtggcattgttttttgttgatcttgcttcaccccccccactttagatttcatgggcttcagggggatttttgttttttattttttggtttatttatttatttttgagatggaatcttgctctgttgcccaggctggagtgcagtggcacgatctcggcttactgcaacctccacctcccgggttcaagccattctcctgtctcaacctcctgagtagctgggactacaggcgcacaccacaacacccagctaatttttgtatttttagtagagacgggttttcaccatgttggtcaggctggcctcgaactcctgaactcaggtgctccacccatctcggcctcccaaagtgctgggattacaggcgtgagccaccacgcccggccttgtttttgtttttttaatgagagctaagatttaagctaccctggaaaatgaatctttctggggccttggagctgagtatattctcttcatagactatcaaataattcaaaatctagtaaaggagataaggaaagcatatgaccaaaatacaagataaaatgtgataaatgccagaagaaaggcacacacaaaaatgtatgatttttggatgaagatatcttgtcttcattgaagggaattaagggacgcttcatgaaggggacttttttgtttcttagcttgttaggaagttggttttcaagtccagctttaattaccagtctcaattaagtatcatctaattcatattttttttttttttgagacagagtctcgctctgtggcccaggctggagcgcagtggcacgatctcggctcactgcaacctccgcctcccgggttcaagcgattctcctgcctcagcctcacgagtagctgggattacaggtacatagtaccacgcctggctaatttttaatagagacggggtttagtatttttagtagagatggggtttcaccatgttgtgcagggtggtcttgatctcctgacctcgtgatctgcccgcctcggcctcccaaagtgctgggattacaggcttgagccaccgtgcccggccaattgtttgtattctaatcatgtaacagatgtactggcttttggttgtacatagtcagagaaactgtggacactatgtttaaaacagggtgctggccaggtgtggtggctcacgcctgtaatcccagcactttgggatgtggagacgggtggatcacttgagcccagaagtttgagaccagcctggacaacatggcgcacccccgtctctactgaaaacacaaaaattagccaggcatggtggcacacacctgtaatcccacctacttgggaggcggaggcacaagaatcacttgaacctgagaggcggaggttacagtgagctgagatcgtgccactgcactccagcctgggcgaaagagcgagactcggtctctaaatacatacatacatacataaaacagggcactgaaaatttttaaattaggaatgatggcacaattcttaacggtattatttcccatgggggtatattactctgaaatatcccaaacaggtctgtggcattttgctgctctgccacatcccttttccctcttacgaaatgattctaaatgtttgtgctgagtcttctaccaataaagtagtgtttcagtctgtcatcattggttacttaagaggaatttatctgcttcagttaaaatgaactttttgtcagaactatgaagcaaagataggtgtgtccagaaatattgtcatcttggtacagtctagggctttcttttaagttacaagaatatataacatatgtatagtttaaaatccaacactataatgaccatgtacataccaaccaattatctacctttaaaactaggaaattaccgtggggcgcggtggctcacgcctgtaatcccagcactgtgggaggccgaggcaggtggatgacgaggtcaggagttcaagaccagcctggccaagatggtgaaaacccgtctctactaaaaataccaaaaaattagccaggcatggtggcaggtgcctgtaatcccagctactcgggaggctgaggcagagaattgcttgaacctgggaggtggaggttacagtgagccaagatcgcgccactgcactccagcctgcgcgacagaacaagactccatctcaaaaaaaaaaaaggaaattaccgatgcctttcaagtcttccatgggtcccctcacccccaagtctccccagagggaaccattatctggaattttatttcattcccttgtttttctttaaacttttcttccagtttaaccatatatgtctgtattctgaaatactattgttgagcctgcctgtttttgcctttataaaaatataccaaatttaagtctaaatatacatattatatatatataagtttatctagatgagtcttactacatattattttgcaacttgttttgttcccttaacattttgtttatgggttatgtatggcagtagtgtattcatcttcactgctgtagactattttctttgtgttgttgttgttgttttaatagacggagtctcactctgttgctcaggctggagtgtagtggtgcagtcatgactcactgcaacttccgcctgctgggttcaagcaattctcctgcctcagcctccagagtagctaggactacaggcatgcgccaccatccctggctaatttttgtatttttagtagagacagggtttcaccatgttggtcaggctggtctcaaactcctgacctcaggtgatccgccctcctcagcctcccaaagtgttgggattacaggcatgagccactgcgcctggtcatattttctttatgggaaaatacccatgttggtggctccttgggtgggtttcagtatattactattacaacacagcatggcttcataatttgtgaagaatttttctagaccagggttcctgattcatagggtctgcatatcttcagttttactagatgatgccaagtaattgttaccatttttgccagtgtgatggctttaaaagagtttttcatcatggagtatatgtgtatgtggctttactttatttcccaattttcattttgagaaaatttcaaaactacagatcaggtgcaggactagtacaatgaatatacccttcacttagattcactaacatttgctgcatttgcataatctatcttttcacctatgcatggtgttcatacacacgagtatattttattttcctgaaccatttgagaattaattgtagatatcattgcattttccatctgtatctaattcagcatgtatttccaaagaacgtggacattcatttatatgatcacaataccgttattgtactcaggaaagttggcatttcattatttacacaaatgttatctaatatatagcccatgttcaaatttccctagttgccccaataatgtacttgccttaaacaacttttgattttttttttttttttcgagatggagtgttactctgtcgcccaggctggagtgcagtggcgtgatgttggctcactgcaacctctgccttctgggttcaagcaattttcctgcctcagcctcgcgagtagctgggactgcaggcgcacgccaccgcccccgcctaatttttgtatttttagtagagatggggtttcaccatattggacaagctggtctcaaactcctgacctcaggcagtccacctgcctcggcctcccaaagtgctgagattacaggtgtgagccaccatgcccgaacttttttttttttttttttttttttttaagtctctcttaatctacaggctccccttccatcttttggagttgacttccttacagtttatctgttaaaacagtctggcacatttcacctatagagtttccaacggtttgggttttgctgattacacatttatgctatagtttaacgtgttctctgtactccctgcacattggcagctggatgcacgggctacttgaaccagatcctgtttgatccttttggcaatgctctagatccacgtaggcacataagtctggtttttgctttgtttttattggttttagcagctgtagatgctcaatgcctagacccattgaatctttgggggatagaaatggtgatattggccgggcgcagtggctcacacctgtaatcccaacactttgggaggccgaggagggtagatcacttgagatcaggagttcgaaacctgcctggccaacatggtgaaaccccagctctactaaaaatacaaaaaaattagccacacatggtcaggagattgagaccatcctggctaagacggtgaaaccctgtctctactaaaaatacaaaaaaattagccaggcgtggtggcaggcgcctgtagtcccagctactcaggaggctgaggcaggagaatggcgtgaacccaggaggcggagcttgcagtgagctgagatcctaccactgcactccagcctgggcgacagagtgagactccatctcaaaaaaaaaaaaaaaaaaaaaatcagccgcgcatggtggcacgtgcctgtagtcccagctactcaggagactcagtcaggagaattgcttgaagctgcaaggcagaggttgcagtgagccaagatcatgccacctcactccagcctggttgacagaacaagactctgtctcaaaaaaaaaaaaaaagaaaagaaaatggtgatattttgcttctattgtttcattttctcaaattagctgaaatattttgataaagaaccccttctcttatctactagttacccagttatagtttatataggaaaaacaagataattacttgatttttttctcttatttatccagtttcaaaataatgaattcattccctttcctcagaagatcacctgttagtttttctttaaaaataatggccaggcacggtggctcacgcctgtaatcccagcactttggcaggccgaggcgggtggatcacctgaggtcaggagttcgagaccagcctggccaacagggtgaaaccccgtctctactaaaaataaaaaattagccaggtgtggtggcacgcgcctgtagtcccagctactcaggaggctgagactggagaatcacctgaacctgggcggtagaggttgcagtgagccatgatcgcgtcactgcactccagcctgggcgacagagtgagattttgtctcaaaaaaatagggccagacgcggtggctcatgcctgtaatctcagcactttggggggctgaagtgggcggatcacgaggtcaggagatcgagaccatcctagctaacatggtgaaaccccgtctctactaaaaatacaaaaaaattgggcgtggtggcacatgcctgtagttccagctactcgggaagctgaggcaggagaatcgcttgaacccaggaggcggaggttgcagtgagccaagatcccgccgttgtactccagcctgggcaacaagagtgaaactccatctcaaaaaaataatataaataaataaatatatatatatatttatatagagatggatatatatgtgtgtgtgtgtgtatatatatatatatataattataggctgggcacaatggctcacacctgtaatcccagcactttgggaggctgagacaggaggatcacttgagtctaggagtttgaggctgcagtgagcgctgtgttcgtaccactccactccagcctgggtgacagagcgagaccctgtttcttttcttttcttttcttttttttgagatggagtctcgcactgtcgcccaggctggagtgcagtggcatgatctcggctcactgctagctctgcctcccgggttcacaccattctcctgcctcagcctcccgagtagctgggactacaggcacgcgtcaccacgcccagctaattttttgtatttttaatagagtcggggtttcaccgtgttagccaggatgatctcgatctcctgacctcgtgatccgcccgcctcggcctcccaaagtgctgggattacaggtgtgagccgctgcgcctggccaagaccctgtttcttaaaataataaataaattaaaaatcattacgggtttatagatttaaacatatttgatagttttgaatgctttgtaattcttggtcttattaaagttcaaactgtcccattttgctagtggaagttggctctgagtcctcttgacatgacccaagtagtctgtgatagttacctcactatctagcatgtgaagatgttcccagaatttcccatcgtggttttcatttacattgccctgattgagcatcttttcacaggtttattggcttcttcttgaaatgcctgttcatgtcttttggccactttttatatgggtcatttgtcccttattgatttataagggttctttatttttttcctagatattaatagttttggccagatgtttgcagatgtcttttctcaatatggcttgtcttttcagttttggtgtcttgatgatcagaagaagttcttcatgtagttgatttattgaccttttccattatggttttcactctttgactctaggagcttaataaaagcatgaaatatttattgattgtccattgctaatccgaaaccctttcagaatagtcctaacccaaggtctcagtatcagagatgaaggccagttgtgggtgtcaggaggtcagttgtgggtgtcagtcctcagggtcacagatggctcttttagagttgtcttttttttttttttttttttgagatggagtcttgctctgtagcccaggctggagtgcagtggtgcagtggtgcgatcgcgttcactgcaacctccacctcctgggttcaagcaattctcctacctcaggctcctgagtagctgggattacaggcgtgcgccaccacgcctggctaatttttgtatttttagtagagacagggtttcaccatcttggccaggctggtcctgaactcctgacctcaagtgatccacccgcctcagcctcccaaagtgctgggactacaggcgtgagccactgcacccgactagagttgtcttttttttttttttttttttgagatggagtctcgctctgtcgcccaggctggagtgtaatggtgccatcttggttcattacaacctccgccttctgggttcaagcgattcttccgcctcagcctcccaagtagctgggattacagtcattcactactatgcctggctaatttttttttttgtatttttagtagagacggggtttcgccatgttggccaggctggtctcgaactcctggcctcaggtgatccccctgcctcggcctcccaaagtgctgggattacaggcgtgagccaccgcacccagcttagagttgtcttataattagctaaacacagcagtatgtctcagtaaatatcatattttagtttttcactagcttttttttaatgcaacaaattactatcacagaattgtacaatgactgctgaaggccaacactaattatttaaaaggcaggaaattaataaagaagcataaacctgttaccaatgtgaaaactgagcagaacttctaaagctgagctgttaatagttttattcaggcccttgctggctcagcaggaaaatgaaagggaagcagcagccaccaccctgagtaaacatgccctgctttttcttcctccattagaagttcctcggctctctaaacatggcaaagtttggctgaaagtaagtcatgtagttttaaaatgttcatctttgaagtaagctaatcacagaaggacaattactgcatgattctacttgtatgaggtatttaaaatagtcaaactcatagaggcagagaatagaatggcgattgccagggattgggggagggagagatagggagttggtaatcaacaaagttttagtcaagcaaagagaataagttctacagaccccttgcacaacactgtgcctatagataacagtaccgtattgtacacttaaaaatctgccaagagggcagatgtcatgttaagtattcttaccactgtattttttttaaatgacagcttgatgggttttccataaagttatgagtttgtgctttgtaattttttgctgtctaaaattctaagaactacaggtattaggaaatgattttgaaatgattttttctttctttttaaaaacaccattatttaccaaaatgaaaagttagaaatcctgaataatgtcatctcctctttagaaaggaatgcactcttggtatcagtgggcaggatacagcgttgtccagtggactaagaggagcgggagcaccagactcctaccccacctctgcctcttactagccctgaaaccttgggaagttactccagctctgtgggaactggcatagtacctcctggagctgttttgaggattaaataaggttatctcatgtgaggaacatatgaaatggctggactctagccacatgatagtcatcaaccaccactcatgtgatactgcacattttcgcttctgcctgagaagataatgtccactgatagaaaatggaaccataccctgtagtcaggaatccttatgtcattgttttagttttccattgctgccaaaataaatgactgcaaatttacaggttgaaagtagtgcaaatgattatcttagttctgtgggtcagaagtccaattctaaatcaaggtgtcagcagggttgcgttcctttctagaggccctaggggggaatttctttcctgctcatttagattgttgacagaactcagttcctcgaggctgtaggaccaaggtctgttttgctggctgagggctgtttccagcttccttcctctattgtcgaagcctgcagcaagtcgtttgcagatcccccttctgacctcttcttctgcctccctcttagactgcaggcactcttatgcttgaatcaagcccacccagataatccaagatcatctccctattttaagggcaactgattagtaaacttaattccaatgcaaccttaatttccctttgctgtgtgaggtaacagtcacaggttccagaaatagaagacatctttgaggggccattattctgcctacctcatcaagtgaactagaattgtgttggggtctttaacaggtcatttatccttaccttttattttcttcatccaaaaaataaagtggcctgccatataggatagataatgtttattgagcacttacttgctgtgagcttggcccttggcgctaaactctttgctcaggaagagtctttgaggtgggttctattattatccccatttataagtgaggaaactgcattttggagaagttaagtaattgttgaaaataattcaactggtgagggagtcagacatttcagtaggctgctgtacctcaaaggtttggctggctggcaatcagccttcacatggcaggcatactaattagaaatcagtgtcttgattttcttaaaaagttttggttttgctagcagaaattgtcatttgtgcccaggcacggtggctcatgcttgtaatcccagcactttgtaggccgaggcaggcaaatcacctgtggtcgggagcttgagaccagcctggccaacatggtgaaaccctgtcttcactaaaaatacaataattagctgggtgtagtagtgggcgcctgtaatcccagctactcaggaggctgaggcaggagaatcgtttgaacccaggaggcagaggttacgtgagctgagattgcgccactgcactccagcctgggtgacagagggaaactccgtctcaaaaaaaaaaaaaaaaaaaaaaagaaattgtcatttgtgttcatggacgtggtaagaaaataaaaactgaaatcagatatgtatgaaaatgagttacaaaatattctagataaaactttctctgtctgaaaatgcaaaaaaaaatgatttctggcttgtgctaaatcacgaactgttttttgaagtcagaatgttgttttgtctgagatcctggagttctctgccaagagagatctgatttgtgacagggtggtggatgggctcaatatttttttaatgagatattggactgtgctgttttgttatactataagtgatatgtaaccaaacaagaaaattttcctagcaacaaagttgttttcctgaatcagaagaatgcttttgtgtgctcattttcttattgtccaaaagataaaaaagcttgtgaatttagcatcttatttttttgagattgaggtactggcgagtatagatagtagaatatataagaatatcattggaagtatttggcaagcagtatgttaattcagacctaaactgtatttaagtagagaactaacttgtttttttgtttgtttgtttttgtttgtttttgagatggagtttcactcttgttgcccaggctggagtgcaatggcgtgatcttggctcactgcaacctccgcctcctgggttcaagcgattctcctgcttcagcctcccgagcagctgggattacaggcatgcgccaccatgccctgctaattttgtatttttagtagagacggggtttctccctgttgttcaggctggtctcgaactcctgacctcaggtgatccacccaccttggcctcccaaagtgctgggattacaggcgtgagccaccacgccctgccgagaaccaccttgtttttatgccagacccgattgttggacatgattatctcactggcccttataagcctttttttctctcttcttgttcttcattagtctggtgagggacccagacatttcagtaggctgctatacctcaaaggtttggctggcaatcagccttcacatggcagtcatactaattagaaatcaatgttttgatttttttttaagttttaattttgctaacagaaattgttattcgtgttcatggatgtgttaagaaaatagaaacccaagcttttttacattcatcagatctctaagttctaccccattccatttgtttgtttgttttgagacagggtctcactctgttgcccaaactgtagtgcagttgtgcagtcacagcttactgcagcctcaacctccctggcttaagtgatcctcccacctcagcctcctgagtaggtgggaccacaggcatgtgtcatcccacctggctaatttttgtattttttttagagacaggatttcagcatgttgcccaggctgatcttgaactcctgggctcaagtgatccacccgcctcggcctcctgaagtgctgggattacaggtgtgagccactgcccctggctttccatttgtttatgcaacaaatatttgaatagtgtgtgctaggaggccctagggatattgtgccctcatgaagcttacaggttaatgaaagactcaaacatgaaagaaataattacacaatcaggaagtacatgagtgctatgaaagggaatagaaggttctgctaaattgaaggacagggtacaaagaaagccttgatgtaaaggatgaataacatttagctaggcaaaaattgggattgtctggtctcggtcagtggggtatattttgcaaaggtcttgtcccagtagggagtttgtcaatttcgagcaacagcaaaaaggcctctgggttgtaggtgggtgtgtgttcacatatgggtatgtgtgttcgcttgtgtgcatgcatgtgaggaggcagggtggggagtggctctggaggaggagaagggcacagattctcagtcctgtagcactcttgttcagagcatcaagtagacctgagaattgtatgttgatcattggtccgccaagcagttcgtatggccttgtttcccagaactccatcatcaagtggatgtggtgaccatatactttatcatcaaaaccaggatactctttttttttttttttttttttttaaacttctttttctatgttgcccaagctggtcttgaattcccaggctcaatggatcctcccgcctcggcctcccaaagtgctgggattacaggcgtgaaccaacatgcccggcaaaccaggatactcttgagagtgaaaggggacactattaattatgttgggacaacgggtataaaacagtacttatagaccagttctcagccactccagggagccccaaagttgcctagaaaccatgctctgaaatgacagggttagtcacgtgctcctgctttctcaccttttcctcttccttcatccatgaataactctgaaagaggggcaccaggagaaactgctccaagtctatacaacagaatcttagcccccatggcccgcccagctgcagcctcctgtttttcagactgccatctgatctctgactattaatgtgttttcagaattaaagtctaaaaaacgtatagaaaagaaagtaaggccttaaaagtttagcacgtgaacttttcccactagaagcttttcctacactgcttcttatggattacatggcctaattatatgttcccggagggccactgggcagaatgggtgtggtctaacttctttcagagtaaacatgttttgtggattggcccctatggtggataatggtgaataatgcatggagtaaatacctacaggaagccttcccataggtgtaaaacctttatttcaggaaataaaaggaagatatattgattttttaattagaatcaactgtttggctgaatctgcataatgaggattaatggagctttatttcctgctctctctgcccaagtcactctacagtagggccctcagagagccctagtaacttcttcaatttactgacagatggatcactttgcagtaaaataatatttaatggtcggtaactgcgagaatgtgggatctcattgtcctcctcagcctttcttcaacaaccccccaagtcctcaataaaatggtttgaccctgtcccccataataatttttaatgttcatgttcagccaaatactcaggacactaaggagttgcactatttcttttcaaactgcattcaagctctttcttttgttttaaaagccaggaaatgtgaagaattcacctggaactaagtagaaaactccatgctctgccatcttaatcaggtaaaaaacaagaaatttctgtgattattttcagcattgtagtgccagctgaaatgacttgtttttaattaatttaatttaattaattataacagtttcaatttgatgtgaaaatattttattccatcttttagtttctgggcttaaatgctgtgacttacttatttgtgtttgttccactaatgttacctgggttttttagacaagctagaaccagacagttgggatttgtctacaaatgtatttcaaacaattgaaaagtgtcattattccttaggtttttttcaaacaacactttattatagtaagtacacttgtatttatctaatactcagtgaacactggaatgcatgactgttacagagaggctcaaaacactagttatattgtttgtgtatatatgaaaaattgtataatagcacttgtgatttcctggtaattagaagactgtaattgaatttggaagcaacctagatattcaactacaggaaaatggcttaattatggtatatctataaagaagaatattattattctgtttctacagtatttaattgcatgggaacgtgtgcacaattattgttaaatgaaaaaaaggtagtgtgatatgtttatagaggggatgaagccaggagatacgacagaaagtgtgtatctttcagtggcatgatgatttttatatttttttcttctttataactttctgtatttaaaaaattttctgcaatgagtatgcattttataatcagaaaattttttgaaaattggtgttacatttattgtaaatcatggcccttacttaaaatttatgaaaaccctgagtttgaagggtcttttttcctcaagctttctttatatttttggagacccaaagagtcacataaactgagaatttgagagtggttatctggcccaacccccagcctcaagcagactcccctgaaaccctgtatgttccttcttttacaccagcactgatgggaaactcaccctatggggcagccatcctgggacaattctgagtttttggaagctgtttcctctgctaagcaaaaatatgtctccttagtggtcacagaaaacaaatccagttcctctttcacagcatagctgttcatacagtaacccaacatcagtatgttctcagatacaaactattacccggggagcttggtaaaaggcaaagggcaccccagaatcagtatctctggtgaatggggccagatatgcatgggatgtgccattagaaggatgactggagggtgagcagccacagagtgacacatgtcctctagagacttgacttttaatatggttatatttctctctttttttaaatccctgtcagccagaatggatatatttctgtacagggacaatgaaaaagacatagaataaagggaaattaggtaaatatccatttcaattttcaaagatactctgcaccagagttcagcttgctgaaatacacaaccttgacttcattctttattgtttttagatctttattggaggaggtgtagcttttaattataaaagtgattcgtgttggttgtaaaaaatgtttttagctaactgttttaaaagcttgtcttggccgggtgtggtggctcacgcctgtaatcccagcactttgggaggccaaggtgggcagatcacgaggtcgagagatcgagaccaccctggccaacatggtgaaagcccgtctctactaaaaatacaaaaaaaaaaagccaggcatggtggtagttgcctgtaatcccagctacttgggaggctgaggcaggagaatcgcttgaacccaggaggcggaggttgcagtgagccgagatcgtgccattgcactctagcctgggcaaaaagagtgaaactctgtctcaaaaacaaaacaaaaaagcttgtcttatcctttattcttttctttttctttctttcttttttttttttttttttttgagatagagtttcactcttgttgcccaggctggagtgcagtggagcaatcttgctcactgcagcctctgaggcctcccgggttcaagtcattctcctgcctcagcctcccaagtagctgggattacaggcatgcaccaccatgcccagctaattttgtattttttagtagagacagggttttagcatattggtcaggctggtctcgaactcctgacctcaggtgatccacctgcctcagcctcccaaagtactgggattacaggtgtgagccaccacatctggcccctttattcttttttccagaggtaatttttgttaatagtttggtatatcattccagacttttaaatatagatagatagatagatagatagatagatagatagatagatagataggccgggtgcagtggctcacacctgtactcctagcactttgggaggctgaggtaggtggattatatgagtctggcagttcgagaacagcctgggcaatatggcgaaaccctgtctctacaaaaaattaaaaaaattagctgagtgtgatgacgaacacctgtagtcccagttacttggaggctgaggtgggaggatctcctgagcctgggagaaagaggttgcagtgagccatgatcactccactgcactccaacctgggcaacagagtgataccctgtctcaaaaacaaatatatatatttatttatatttaaaatttatttataaattaaataaatttatttatacatttataatatattcatgcatacatgcatgtttttggttttttgacaaaatgggatcatattccacatattgttttacaagttcacagaaaactttctttttactgttatttatctggggggatgggatcttgctgtgttacccaggctggacttcaactcctgggtttaggtgatcctcccacttcacccttctgagtagctgcacagaaaacttactgaaggcatataattgtaattatattatcatacataaagaaattaggctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaattttttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggggaaaaaaaaaaaaaaaagaaattaggctggggctgggcgtggtggctcacgcctgtggtcccagcactttgggaagctgaggtgggcggatcatgaggttaggagtttgagactagcctggccaatatggtgaaaccctgtctctactaaaaatacaaaaattagccagacatggtggcgtgcgcctgtagtcccagctactcgggaggccgaggcaggggaatcgcttgaacccgaaaggcggaggttgcagtgagccgagatcacgccactgcactccagcctgggtgacagagtgagactctgtctcaaaaaaaaaagaaaaaagaaaaaaaggaaattaaggccgggcatggtggctcatgcctgtagttcaaactactcaggaggctgaggcaggagaattgcttgaacccgggaggtagaggttgcagtgagccaagatcgtgccactgcacactcccagcctgggcaacagagagagactccgtctcaaagaaagaaagaaattgcactaattccttaacatcatctaatatccagttcaatgtacacattttcctggttgtttcatgaataactttttacagttggttcgtttgaaccaggatccaaacaagatctgcctgttgtgtttgactgataggtctcttagaactgtaatagtttccgctccctcattgtcccttgctatttatctgttgaaaaacctggcttatttgtcctttagaattcctgttttctacaaggattgagctgggaggggaaaaaaagaatttctcatgttctggctgtggccgaatgtatccatttagtatcattctgtttatctcttggtttctttcttctctatatttcccataaacttatagttggatccgaaggcttaattagacttaggttcattttttttttttgccatagacagtactatattaatctatgctgatgaatgaatgaacttgttttacataacatattgtgtaagtatttccctgtcagtacttaatagagctacgcattccttctctagttgcttaatgatttcctagtatggactaccatgatctacttaatccttaccaacataggttgtttccagtttttagtttttaacaatgcaataaatctatcaaattcctggggaagacaaaagcagattaataaactgagatagaaaaaataagctagtagtttacatgtttaagaatttttggttgtatattaaaagatcaagtgaatagtcactggcctctaaaatatttagaaatctccaattgtgccgggcacggtggctcatacctgtaatcccagcactttgggaggctgaggcgggtgaatcacctcaggtcaggagttcgagaccagcctgcccaacatggtgaaaccacatctctactaaaaatacaaaaaattagccgggcgtggtggcgcctgcctgtaatcccagctactcaggaggctgaggcaggagaattgcttgaacccgggagatggaggttgcggtgaaccgagaggacgccactgtactccagcctgggcaacaagagtgaaactccgtctcaaaaaaaaaaaaaaatctctaattgctgagtatattcattacaaattatgaaaaaaagccaggcgtggtggctcacggctgtaatcccagcactttgggaagctgaggcaagcagatcactttaggtcaggagttcgagaccagcctggccaacatggtgaaaccctgtctctaccaaaaatataaaaaattagctgggtgtggtggcgggcacctgtaatcccagctacttgggaggctgaggcagaattgcttgaacctgggaggcagaggttacagtgagccgagatcacgccactgcactccagcttgggtgacagagcaagactccatctcaaaaaaaaaaaaaatatgaaaaaagcaatctggagaagactcagtttgtctttgacatgtctttgactatatgtgtattttattccagaaaagtatgatgggggtgatgcgaggaaaattacacatcaaactgagggtgatgtaatcatgctttccagcagatagatggaaatgtagttgtttaatcttcagatgtgatgtgtactgtgccatttaggcatttgttttttatttattcatccatctagttggttaattacactcagatacacagccaattgaggatctgaatgtagtgtatatgtaatgttgatggaacacaaaatcttttttttttttttttttttgagacagagttttgctctgttgcccaggctggagtgcagtggctcagtcttggttcactgcgtcctctgcctcccgggttcaagcaattctactgcctcagcctcccgattagctgggattacaggcgcccgccaccatgcccggctaattttttgtatttttagtaaagatgggatttcaccatgttagccaggctggtctcgaactcctgaccacagatgatccacctgcctcggcctcctaaagtgctgggattacaggcatgagccaccacactcgacctttctgattcttagtttaactgtctttaaaatgggaataattacagttttctctggctcatgtttcttatggtcatataatggtgatgtaaatattttctatggtttctctatttatttatttattttgagatggagtttcattcttgtcgcccaggctggagtgcaatggcatgatctcagctcactgcagcctctgtctcctaggttcaagtgattctcctgcctcagcctcctgcgtagctgggattacaggcacttgccaccatgcccagccaatctttttgtatttttagtagagacggggtttcaccatgttgggcaggctggtctcgaacttctgacctcaggtgatccacccgcctcggcttcccaaagtgctgggattacaggcatgggccaccgcgcctggcctggtttctctatttaaatctgaagaattttcataatgcaaaattttttctggcacagttacttatgtttttcttttctttcttttagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaa

SEQ ID NO: 38686 - DNA, 8955 bp, Homo sapiens
cagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcaggtttagctgagggggttgaggtgtccaagaagtgctggcaccaagggctgagcgcggggaccctgtgtcctcaattccggggtgggattgctagggggagagtgcgtgtcttcatggttgccgtgggttttatgattgcccatttttctgtcttccgacgtttcccgatcagtagaggcccgagctgtgctctgtggtttcctgcagtcacccgcgcgttttcaacacagcgcatggagggcatctacacacatacacatccctctccatcccctcaactctggaacaaacactcaaagtcaagtatactggttggagaaatgggtaatagttacttatctttaacatttattttacaaacaacctattccttttctcgtcatggtacacacttggtattgtttgggtttttttttggttttgttgttgttgttagtgtgtgggcgtggttttgtttgtttttggagacaaggtctcgctctgtcgcccagggctggagtgcagtggcgcgatcatggctcactgaagcctcgacttccagggcccaagcgatcctcctgcctcaacctcccggatagctgggattacaggcgtgcaccaccacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagaaagagtttcactatgtaggtcaggctggtctcgaactcctgacctcgtgatccgcccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctcccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggttagtacttcctcagcctgtgtctggcagctggcttaccctccagtttggcccaacctccctgctgtccctattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggtgagggaggtggctcattcagggggccactgtgagctgaatgttctgggcagagccaagatggaagtcagttacggcccctgcattcagcagtgccaggcacacagcaggtgctcaataaatgtgaagatgtgggagagaaaaggcagctggcaaagttgatgaattgtagagagcagttttggtatcagaatgggtgccatcctttaatctgtactttctttttcttcttttttttttttttgagactgagtctcgctctgtcacccagactggagtgcagtggcgcgatctcagctcactgcaagctccgcctcctgggttcacgccattctcctgcctcagcctcccaagccggccagtcttggggtaattttatcttttcctgcagcaatgtaaacattttgaaagtacagattaaggctggccgcggtggctcacgcctgtaatcccagcactttgggaggctgaggcgggcagatcacaaggtcaggagatcgagaccatcctggctaacatggtgaaaccccgtctctactaaaaatacaaaaaattagccgggcgtggtggcgggcgcctgtagtcccagctactcgggaggcaggagaatggcgtgaacccgggatgtggagtttgcagtaagctgagatcccaccactgcactccagcctgggcaagagccagattctgcctcaaaaaaaacaaaaaacaaaaaaaattaccccaagaccaactacctaaaaatagtttacatattcgataccttctcttctagacttttttcatctctgtgtactgtttttttgtttgtttgttttggttttggtttttttttttgagacagagtcttgctctgtcccccaggctggagtgcagtggcaatgacctctgctcactgcaagccctgcctcctgggttcgtgccattctcctgcctcagcctcccgagtagctgggactacaggcacccgccaccacgcccagctaatttttttgtatttttagtagagacagggtttcactttgttcgccaggatctccttaccttgtgatccgcctgcctgggcctctcaaagtgctgggattacaggcgtgagccaccgcgcccggccccgtctgtgtactgttacagaagctacttttttttttttttttttttttgagacagagtcaccctctgttgcccaggcggagtgcagtggcaggatctcggcttactgcaacctctgcctcccaggtccaagcaagtctcctgcctcagcctcctgagtagctggggctacaggttcaggccaccacgcccgactaattttttttgtattttagtagagatggggtttcaccatattgcccaggctggtctcaaactcctgagctcaggcaatctgcccgcctcagcctcccaagaagctacattcttttgagcatttactatgtaccaggtactatgctaaacacttttacttcatgattttcagaacaacccaatgaaggtacttcccctttataaatgagaaaattgaggctgcgaggttaggctcttagtgatataattgctctatttttttataagcaaaaaataccacagaaattaatttttagctcaagtgcagcagcttatcatggcccattgcagctttgacctcccagggttcaagcagtcctcccagctcagcctcctgagtagttggaactacatgcctgtgccactatcccgggctcatttgtttttgtagagttaggggtgtcactttattgccagggctcaagcaatctgcccaccttggcctcccaaagtgctgtgattataggtatgagccagcatgcctggcctagttttgtaatttgataatatatcagtaatatttttgtcccctctcttcctccatcccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggtaagtattgttccctccccctcaaatatctcatccaggtttatgaagctccttatacccatcctcttacaatctccttttacaggtgacaaaaatgaggcttacaggttaggccactagattatacaagtcagtcagcgcaggggttttgattcagttcctgtctgctgcttttaggagctccagttagttgaaactggggaatgacccaattgtaccttctcttttcagcattcattttgtgctaaatattgcgcacatcattgtatgtaatctccgtaactccaagttattctcactctgcagatgagtaaactggggaacagaaacattcagcaatatggcacccagctagtaaatgtggaagccaggactcaaattctcactttgcagccagatagcttgcaaagacagttcttcagccctctccttgcccacagaaatactagggtcaggactactaaaatgtctttaatgagagccttgaatcaagtaagcaaagtaggtgatgcccctgaacgggcctagctcctgcacagtcacagtccagccataggacccttgttccaggcagggcagtcgcacatcagggtcctcatctgagaactgaatcagggtcccctgagggtttagaaccctcaagcattctgatagaagctggtaagccctaggcagacctccccgggcaacagcatcccatgtgcctttgtccagcagtagttggaaagagcctgaagaagccacagcccccaggttctgagcatcggcgtgcatgaagtggaggcttgaggcagggtgtccagggcatagaggtgtttggcctgggccaccctccaggaggctattcatgtgggccacagccacaggagaaaagtccacccccagcacatccactgggtgtggagatttggtgtagaggcctgtacataggctggaagtcccacagcccacatccagcactcgcagaggactggcagcctgtgcctcctgcagcaatggcagtaggagcccctggacttcgtcgtatccaaagaaccagtcgaaggtggggacagtgcccaaacgaggctgggcatgcagccgatcccagagacagcggtccgccaggcaactatcagccagtgagcctgtgggcacggttggagggtgtcacttggtctatgtcgccactgcaaaaacgtcgtatatacacactggcgtcttttttttttttgagacagggtctcactctgtgacccagggttgagtacagtagcacaatgatggctcactgaagcctccacctcagcctcctgagtagctaggactataggcgccatcgtgcccggttaattttttttgtagacagggtctcgctatgttgccctaggttggtctcgaactcctgggccaagcgatctgcccgcctcggcctggcaaagtgttagcattacagccgtgagccaccacgcacggcccaccgtagggtttgagaatcacaatttcagggactacactcctgactcacgaggaacccaccttaccctccccactctgcccccaccttgccctctccactctgcccccacctccctacccgcaaaggggcggcacgtccccatcatcaggctcggcaagtggagcattcgacgcagcgcggccatctggagattcgggtaagttcgaccagagaagcttatgtgaagcgtccaccctactccagccggagaggcctgaggtccaggggaagatctgcaaattccgcgtagcgaaaggcggcgtacagcttccccgaactctgcagtcccggaaaaaagaacgcggacacagactatggtaggaacggcctttattggctgcagcgggaagtggaggagggtatacagcgtccgcagacctgaaatcaaatgagaaagtgtgagcaccccgatggaggagccagctggatctcggttgtccttctccgagattcccggtgtcccggcgtttgaggatagaaccagcggatgggaagccgccagcaccgaagacatgacgccgagggggccagagccctttccctcttcctccgtacattacggggagcggcaccacaagcccgatccccgccaagaaaaggagggtcctgagaccccgcccagagccttccacccggcacccccaccactcccggccgcccaatctggctactacagctaaaaccacacttactagctcaccaccctccgaaaggcctcccgcaccgcggagctcctttatatagcccgaggacccgcccccgagttgcgattggcccgcggaaggccggggcggagccccgcggatccggcgctgagcggaagtacggaccgtgaactggagtggaatcgcgactatgggagctccggggggaaagatcaaccggccccgaacggtgactgtgtgggggccgcgactttgtttcctcaagcgttcctgagcccttttatctcgcacgagatgggatcagtgaggggccggggctgcctggtggaggggccccgggtcgcggcgagcccactccatctgattcgcatctttctccccggcaggagctgaagaagaagctgttcaaacgccggcgggtgttgaatcgggagcggcgtctgaggcaccgggtggtcggggctgtgatagaccaagggctgatcacgcggcaccacctcaagaagcgggcgtaagtactagaccctcttcctgttggtcgtccccaccgagtcttccttcctccctgcagagctccggagcagcttcacctctcagctcaccttgtgcactgacgcttatgcggggaatgtctgtcggctgttagttcctaagctctgatagcctctcacaatacctgtagcagacaacctttctttgggttttggattctgttaagaatctcaggaaagccggggatggtggctcatacctgtaatcccagcactttggggggctgaggtgggcggatcacctgaggtcgggagttcgagaccagcctgaccaacatggtgaaaccccgtttttgctaaaaatacaaaaattagccaggcgttgtggccggcacctgtagtcccagctacacgggaggctgaggcaggagaattgcttgaacctgggaggcggaggttgcagtgagccgagatcacgccactgcactccagcctgggccacagagtgagactccgtctcaaaaaaaaaaaaaaaaaaaaaagaatatcaggaaatctgttggctctccattctccaagtaatgttatacattcacacagatttttataagtaaacttatttttacatacagaaaagtgcacacataggcgcataaaactcgaagaattttcccaaaggcactcataggatttcacttgtaagtttcaaggcctcctgtgtcttgaggaagagttcccatcccattaattactttctgtgtcctttttttttttttttttttttttcctcttttttgagacagagtctccctctgttgcccaggctggagtgaagtggcatgatctcggctcactgcaacccctgcctcctgggtttaagctattctcttgcctcagcctcccgagtagctgggattacaggtgctccccactgcacccggctaatttttgtatttttagtagagacggggtttcaccatgttggccaggctggtcttgaactcctgacctcaggtgatccgcccacctcagcctcccaaagtgttgggattacaggcataagccaccgcccccgatctatgtcctttcattagcttcttcaatgtaaatatttagggtttctattactatttatattatatttatttaatacttttccttttttttttttttttgagacggagtctcgctttgtcgcccaggctggagtgcagtggcgcgatctcggctcactgcaagctccgccttctgggttcacgccattctcctgccgcagcctcccgagtagctgggactacaggcgcccgccactgcgcccagctaatgttttgtatttttagtagagacagggtttcaccgtggtctcgatctcctgacctcgtgatccagccgcctcggcctcccaaagtgctgggattacaggcgtgagccactgcgcccagcctatttaatactttttctatagccagaactatttgtgtgacctcagttggttcaggttaacctagctctctttatttccacttacccatcaggtccagtgcacgtgccaacattacactgtcagggaagaagcgcagaaaactcctccagcagatccggcttgcccagaaagagaagacagccatggaaggtgaggctgggacagaggtgggtgaggggaatcctggatttatttgggataatacttccttcttccctttactcagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctgaga

SEQ ID NO: 38687 - DNA, 41747 bp, Homo sapiens
gcaagggcgcggtctggtactcgtgcgtcttttatcgcctcagtttccctccgccgactagcgcgcggggcccggttctccatcgcgcgcacggcagcctagcgcaatgaggcgggcagcactgcggtaggtggcggggcgtggaaggggctggcagggcggtagcctggggtgccatcgtcttcccctagagcttcgggctggccccggcggaagaagtgggccacgcatgggcatttgggctctatgataaggggcgctcgcccactgtacctccgaccggacataagcccgccggcctttggttgggagaacctcgcccccactttggcgacttctagcactgagtttgatattaaaagcaaagcagcacttttaagggaggaagttgggtgttccctaaaattcctttggccttgctcatccggggtgtggttggtagccgcgtcggggtagccccttgtcagaaagataatatttggagttctatgttacctctagcccttcatcttcctttggagaacatttttaggattaaatgcttgacctacttcggctcttacttaagtttgttgtaacattggcagagattacagggtaccttttggctcccaggaccctaggactgtgcgtctaggaccctggtgccaatttgaacttaactttaatgagccgcaaagcccttataagaggctgggtgctttgattgggccacgtgggtaagggaggatgcctttttgtatatgtaatcttcccagctggcacagttaaggcctgagggccttagactccagagcgtgtctagctctccctaatccctttcacccgagcatgccaccctttccaagttttctgcctggctgcatcccagggggctcacacctgctccagtttctgaagttatctcgctgccagtgggcctgtccccctgatgtgactcatagtgcttttgactcacattaaccccatcaattctcttgggggtcctggatatctctctctctctctctctccctctctctctctctctctctctcactcactcactgttcctggggactttgttatcagttgtaagggttctgtcttgtttatagtacttaaaaacaaacaaaaaacctttgttaaactatttgaaggcagactgaaagtcattatgagaggggccacagttgactttagcttgcaatgtgaaaggtcttctacaaaagctccatggtcttgttcaggtgctttctcttataaccctgtgttcctttcttgaaaattctattgaggccgggtgtggtggtgcacgactgcagtcccagcgttttgggatgctgaggtggatggatcacttgaggccaggagttcgagaccagcctggccaacatggtgaaaccccgtctctattaaaaatacaaaaattagccgggagtggtggtgcatgtctgtagtcacagctacttttggaggctgaggcaggagaatcgcctgaaccggaaggcagaggttgcagtgagctgagatcgcgcccctgcactccagcctgggcaacacagtgagattctgtctcaaacaaaaaactattgaaccttaagcggataatctcttagtgtctagtgagaggaggagttcacaaatgaatatagactgagatgattaggttctttgactggtgggcaacctttgtagcttcttttcttttttagacttgcaagaggcacctttgtttagtctctaaatagaggttatttcctcagagtggagggcatatgagtggtattgcctgttattgcactgaacactcttccttgccaactgctgtaagcttgggacccagggctgagccagggtgagttatgtgactccccaggtaggccatggaggccttgagttttcttttttttttttctctttgaaatactttttttatttctttgggatatatgtccagaagagaaattgctggatcatatggtagttatatttttaatttttggaggaactgcctcattatttttcaaaatggctgtaccagtttacattttcaccaatagtgtacgagggttcccttttctctacatcctcaccaacacttgttatcttttgtctttttgtaataatcatctttttattattattattattatactttaagtttagggtacatgtgcacaatgtgcaggttagttacatatgtatacatgtgccatgctggtgtgctgcacccattaactcgtcatttagcattaggtatatctcctaatgctgtccctccccactccccccgccttgagtttcttgatctcctttgattggaaaggttcagttacaaggtcctgggatttgagtgttgcaaaggcctctccacagtaaaggcctagaggttttgctataagtaagactcctgagggcttatcaggagataagccagtaaccctgaggtactgaagtgttgagtattgattaaaaccattctcccacctcctccacctcagtgcggtgtgtgtgtgtgtgtgtgtgtgtgtgtgtgtgtgtgtgtgtgtgtatgtattgggggagatcggaagaactgggctctatctggactctgctggtgtgcctgttgactggcactgggggaaagtcgtctgaaactggggcctcagtttcttaaggaggttggtttgaatcagaatcttcaaatatagggggatctgagggtacaaaaagggtctgtgcacctcctgaaatagtatataccattgtgtgtgtgagcaaaaatgtattccaacccttcccacgcccgctcgaggtccacagtttccatcagattatcagtaaataggataccaaatgtagtgaaaagttaccattacatgccaggcgcggtggctcacgcctataatcccagcactttgggatactgaggcgggcagatcacttgaggtcaggagttcaaaaccagcctggtcaacatggtgaagccctgtctgtactaaaaacacaaaaactagctgggcatggtggtgcacagctgtaatcccagctgctcgggaggctgaggctggagaatcgcttgaactcgggaggtggaggttgcagtgagccaagatgttgccactgcactccagcctgggtgacagtgagactgtctcaaaaaaaaaaaaagttaccattacccgaatactcttgaatgctatgttgacagtatgatatagatttattattaccaatatgctattggtataagcaacatttttttaaaaagtgttccaattatgcctttgttgtgccacaggaatgtatttccaaattttttaaggcagcatgcaaagcaatggggctctaggactacaattttccaaataaattggcccaagtgtttctctgtattcattaactcccttcttttctctcctcatttgattctatgtttggcagtggtccgtgatagtgcctggcttaggctatctttcctttttttttggagacagagtcttgctcttttacccaggctggagtgcagtggtgcgatcatggctcactgcagcctcgacctccccggggctcaagtgatcctcccacctcagcctcctgagtagctgtgaccacaagtgtgcaccactacgcctgactaatattttaaaatttttttgtagaaacgggatctccctatgttgcccacactggtctcaagtgatcctcccgcgttggcctctcaaagtgctgggattacaggcgtgagccattgtgcccagcctggttctttttgatctttaggggagactttggagaagcatgactttctggaataatgatagctagagatttttgaggacttgtcagtatattagacatgctcttctagacgtgcccttcagggtttaatatgtgttaattcctttatccttttgacaatcctatgggataggtagtattattatccccattttacagatgaggaaactgaggatcagggaggttaggtaacttgtctaaggtaactcagctaacaagcagcatgattgggctcttttttttttgagacagagtctcgctgtgcagtggcacgatctcggctcaccgcagcttccgcctcctgggttgaagcaatactcctgcctcagactcccgagtagctgggactgcaggtgcccgccagcatgcccagctaattttcatatttttagtagagacggggtttcaccatattggccaggctggtctcaaactcctaacctcaagtgatacgcctgcctcggcctcccaaagtgttggcattacaggcatgagccactgcgcccagcctttgggttaacccctatactgtattgcctctcacacaaacaggatggaatgattttcatccctcttcagaaaatgctgcttcttagtgtaacaaaacaatttctgtgtatatgtgtatttattcaggtatgtgagactggttatatagctcctgttagtgatgcgtattcagggtatttagccattcagaatcagatcccatttcttatgttggatacatttaacgtgtctattatagttcctattaatgtgttgggggtcatgatttttttgctctttcagctaatggtagcaatagaaaggattagctttttccagtgtgttctttaaaaccagatatattcagttgtagaatgctagtttcttttttgagatggagtcttgctctgttgctcaggctggaatgcaatggggccatttcagctcactgcaacctctgcctcctgggttcaagtgattctgcctcagcctccagagtagctgggactacaggtgtgcgccaccatgcctggttaatttttatgtttttaatagagatagggtttcaccatgttggccaggctggtctcggactcctgacctcaggtgatctacccacctcagcctcccaaagtgttaggattacaggcatgagccaccatgcctggctgcttgtttctgagatggaagaatgaaggaatacttactctgtttccttcagtaaggcatatgaacctatagaagatacataaaacaaaataatgaaaaaaatggaaaattcaaatcacgttctgagaaaatgcagattagatggtcaaaaacaaaaagacggccaggtgcggtggctcatgcctgtaatcccagcactttgggaggccaaggtgggcagatcacagggtcaggagtttgagaccatcctggctaacatgatgaaaccccgtctctactaaaaatacaaaaaattagccgggcgcggtggcggcgcctgtagtcccagctactcgggaggttgaggcaggagaatggcgtgaacccgggaggcagagcttgcagtgagccgagatcgcaccactgcactccagcctgggcgacagagcgagactctgtctaaaaaaaaaaaaaaagacaaatattaatctgtatacgaaagtacaggaattgaatatttatcgtgaaaaagtgaagctaaaatatttaagagagaggcttgttagctgtgtgattgaagaataaacagatccaaaaccccaaaccctccagcaagaattttggtcttagtggaccagcagggattgtattgcaaccaaataagatgactggtgactaagaagttcaattagccaatgagtatgtgctcatatttctgtgttctgtgcaattagatgatttgacttggtgaaaggataaggatttgttctaacagcacagtgtcaaaactgcatgtagattttacagaatactgtaaatactgagaggctttctctgaatgctgtcattcagaagagaaacctatagtagcttggtctgtaaagaaaactaaaaatatctcttttttttgttgttagtcattgcttattcccacattaggtggtgagaatttactagtaaattgaactggaatgagtgacagtatctggggttctgggttttttttgtttgtttgttttatttttgtttttgttttgagacagagtcttgctctgttgcccaggctggagtatagtggtgtgttctcggctcactgcaacctccatctcctgggttcaagcgattctcctgcctcagcctcacaagtagctgggattacaggtgcctgccaccacacccggctaatttttggatttttagtacagacagtgtttcaccatgttggccaggctggtctcgaactcctgacctcaagtgatccacctgccttggcttctcaaagtgctgggattacaggcatgagccaccacgcctggcctgcggggttcttaacctattcagtgccttgccttcttcaactgtgctctcacagatcagtttattaatctgtgatattgcctgtgtgctacccctgacataatattgtgtgattaggagtcaatgcttaagcaataatgaaccaaaatcaacttattttgggagagtaggttaggcacatttaggtagacagcttttattttttatttttttgaagcagggtctcactctgttgcctaggctggagtgcagtggtacaatcttggctcactgcagcctcgacctcctgggttcaagtgatcctcccatctgagcctcttgagtagctgggaccacaggtgcatgccaccacgcccggctaatttttgtattttttgtagagatggggttttgccatgttgcccaggctggtcttgaactcctgggctcaacctgtctacctgcctcagcctcccaaagtgctgggattacaggcctgtgccaccgtggccagtagatagcttttattttattgtgttgggactctagaaaatttctgcgtaagttaaataaatactttctttgcatctggaaagggctaattcaattttcaaagtttactttataattgggtttatcttatttattgaggaaatatggtgcgataataaagaacagaataaattgttcataatgagtttgctcagttgtttactaaatcgattatggacttctgaaactaataaaatagaaagaccaataataaatgcattaaacctagttgccgtcttttatttattttgtagataattacctaattggtctctgctctcaagaaatgtttactctagtgggagagatgatttatggaatagcctcatgaaaacatacatatacttgtgaaacagctacagactcctacaagacaatatatactaagggtgatatggccagatactctgggaggagggtaggtctttagggttgccagggaagaagctgtgggatctgctctgtgttttatcttgttttataggctttgtgccttgggcaaagggcagcttactcctggaagaggactgactcaaggaccccagaaccccaagaaacagggaatcttccacattcatgaaggcaagcatggtgtctctgtttgatgcctatgtggtgaaaaaccttgttttacttttatttgaaaggtatatagagtgatagtttagagcaaatgaggcatattaaaggtagatctttcataaacatttcattgacaaaatgaccaggatagctgcataatattaatagcttcagatagaagtcacattcagattttgaactattgttcctgggagccttgaggactgagctcttttagttaggtgatttccacttcctgtgtgtaggttctgaaggcatggaaaaaaagagatgggcccattagttgtatcaagtaaacactcctagtccatagttatgttcgagggatcctgttagtccatgcttaattaaagttaatttcaattaccaatatgatacgtaaactatggattgtctttattaaactaggagtattcgttataattaaaattgcggcttctttaaagggtccaaataaatttatattatgtgtgtatataaatatatatgtaagtaaaattaaaaagtttttccttcttggccctcaatacttgcctctcttcttacactgattaagctagtagtaattattttatgtcagtgagcatcagtagtccatgtactatttgaggtactttctgtccattcttttttttttttttttttttttttttttttgggatggagtcttgctctgtcacccaggctggagtgcagtggcaggatctcggctcactgcaacctctgcctccctagtagctaggattacaggcatgctccaccacgcccaactaatttttgtatttttaggagagatggagtttcgccacgttggccaggctggtcttgaactcctggcctcaagtaatctgcctgtcttggcctcccaaagtgctgggattacaggtgtgagccttttttttttttttttttttttgagatgaagtctcactctgtcgcataggctggagtgcagtggtgggatcttggctcactgcaacctccgcctcccaggttcaagtgattctctgcctcagcctcctgagtagctgggattacaggtgcccaccatgccaggctaatctttgtatttttagtagagacggggtttcaccatcttggccaggctggtcttgaactcctgacctcatgattcacccacctcggccccatccattcttttattcaaggaacttaggaggaaaaaatcagaaataagactaagttactaatggttgttgtttgcagttctctaacatttagttgtaattatacatcaaatttatggtgtatccaaaattgtttgatagaaaaatcaaccatttttcatgaaagttaaaatgcatgttcatataaattatatttggttttgatcagttagttattgaaggactgaggattgctatagttaatttcctataactggaatgtatattttgaagtgctaggaaaaacacataaactcaacacagtatttgaaatactacagatttatcttttagttttgaattattgctggttctctaattgattttccctttattcatatagcatgttcatctatacatgtgaatcatggtgtgtgtggtaattagtatcagcttttcttttaagagcttaaattttgtaagcactaatatacgcttgcacttttgggcagtggcattaactaaaattgcattctttgccttagcttgatgtaagtctttgcttcatttttctggcttaaacttttctaacaaccaggagactataaatatatgagaaattaattataatgagactcagatttggatattagtattagtctctgaactaagtaatttgatctattactgcgtataagaagataggtgggggccaggcgcagtggctcacacctgtaatcccagcactttgggaggccgaggcaggcggatcacctgaggtcaggagttcaagaccagcctgaccaacatagtgaaaccccatctctactaaaaatacaaaattagcagggcatggtgatgcctgcctgcaatcccagctactcgggaggctgaggcaggagaatcacttgaacccgggaggcggaggttgcagtgagctgagatcgtgctattgcactccaggctgggcaacaagagcgaaactctgtctcaaacaaaacaaaacaaaacaaaactacaaaaattagccgggtgtggtggcacagcgcctgtaatcccagctacttgggagactgaggcaggagaatcgcctgaacccgggaggtggaggatgcagtgagccgagattgtgccaccgaactctagcctgggtgacagagtgagaccatctcaaaaaaaacaacaaaaaagaagataggtgggaatcctgttcatatctccatcataatggctcttactggctaacactgatacagccccattaagtgaataattgaagttatccttttttgtttgtttatataaaccctagtgattggcacaaaggtattcatttgtgcacctttaaagagacagtatagttctttcaggtttttagggagcagaggcttgatcctgtccctgagctgtttgttgtggcattaaatggaaatctatggatctttaaatcttttgagtgcatgaattgctttttgtagttcttgagctcattgccataatccgtttctcatatttctttgtttcatggaatgacctctttatttttgtttcagttcgagataagttgcgggagatagtaggagcatccacaaactggaggtatgcatctttgttttcattcattcttttcatccccaaggtattatactacactgtatttaggctcagttgatggtctcacagtggggatggggagccctatgttcagagataggttgagaagtattttgcttgggggagaaggtcaacatttcaacatactcatcagatgacacctcattgtcatgaaagaagatgatttacgtatattctgcattttcaaagtgcatttaggtgtatattacttcactgattctcataacaaaacttgtgacgtgcttacgacatatgttcctgttcctttttttacacatgaaactgaaactcagagattgaatgattaaatgtcagggtttgggacttgaacccaagtcgctaagtttctctgtttcatgcaacttgactcctttattgcttcttgtcagttcaaaattagtcaggcctcccatattgtctttctctttctcgcagtatttccttgttgtaaagtaggatcatatccctcttggtgtacataattttgaggctaaaatgagatagaaaaaacacgagtgatcactagatatataataatctattgttggtatagaaattatctaatgacttatttttaaattctttatatgaaaaatttcactttactaaaaggtagaaagaatgaatacctgtgtacccaccacctggattccatacttattaatattttgccaaattttccaatatacacatattgcctgaaccatttctaagtaaattatagacaccatgacacttcagcgtgcatcttcagtaaacattttataaaaccagccttcgcttatctccaacaaataagacattctctcatgtaatcaaattgacagcaattccttgctagtatattactcatccatagtcacatttcctcaactgttaccattttgtgtaatagattactccttttaacaaaaatgtttttatagctgtttaaaaaacatcaagatccaataaaggattgcatgttgcatctggtggttatgactctttagtcttccctaatctagagtaatggacagtcgtccttcccctattcttcccccatgagcttgactttaaggaggccaagccatttgtcttgagaatgttccacattctggatttactggtgtcatttaactcattcctctatctcctgtagtttttgtagggtaaacatttctggaaataatactttataagttaagcttagaaagacatcttagctaatgttcttatcaacattgtcgttccgtatccccttgtctttcttttctctttcaccttaatcttctcttctttttcttccctttctgtctccttttcatgttatgttcttctttaccttttgttctgccttccatacttcctttggatatagtccattttccctcctctgtctctctttcctgaaattgaaggcagagagagagagagaactggggctcaaagaatccgagaactgtcaggtgagaaatgggaatataaagtagagtggccaagccattctttagcatatatatttatatgtatatatatatactattttgtccatctctctaaatttttaatttaatttcaaatattctggtctttgagtaaactttttgataagggtgaatatatggctcatttgggtatatctatatcagttttaagttttcttttttttttttttttttgagacagtcttgctctgttgcccaggctggagtgcagtggtgtgatcttggctcattgcaacctccgcctcccacgttcaagcaattctcctgcctcagcctaccaagtagctgggattacaggtgcccaccaccacacctggctaattttttgtatttttagtagagacggagttttgccatgttggccaggctggtcttgaacccctgacctcgtgtgatccacccgccttggcctcccaaaatgctgggattacaggcgtgagacactgcacctggccttaagaatgtttttaagcttgagaaatgataccggaaatgatcaatttcaccaagtggcaggtgggaagggagggaaggaagagaaggtgaaagtaggcccagaccttctttttcctcctttgatggtatcttactggcctgtgtaccactggaattgtgggctagaactgctcttgttttatgaatcctgcatcctttcttctcagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaaggtaacacagtgctatttttatgtatttgtttttatttccttgttttataacaattttgaaatataattcacacaccatacaattcgcctgtttaaagtgtacagttccatggttttgatatatttagagagttgtgcatccatcaccacagtcaattttagaacattttcatcaccctgaagtgtgttatttatttttaaagggagaccaacatgatttgcatttaattcactgtttgctttatttcacagatttggcaggattcttgaggatcttgacagcttgggaggtactggtattattttagtctttctaatagatacctacagatatacattgaattctgtgactggaaagggctcttttattctttaacctgcacagatgatgatattctaaagtgcacaaaaaaagaaggacatcggccgggcgtggtggctcatgcctgtaatcccagcactttgggaggctgaggcgggcggatcacttgaggttgggagtttgagaccagcctgaccaacatggagaaaccccgtctctactaaaaatacaaaattagccagttgtgttggtgggcgccgtaatcccagctacttgggaggctgaggcaagagaatcacttgaacctgggaggcagaggttgcggtgagctgagatcgtgccattgcactacagcctgggtaacaagagtgaaactccatctccaaaaaaaaaaaaaaaaaatggcatctactacttctgaattgtcataatttttttcttataaatgtagattcctatttaatggaggtatagtctgaataatctttcttactagtaactttaaaaaaagaaagtcttaaacttacagaaaagttgcaaatacagtataaagaatttttctgtggccaggcgcggtggctcacgcctataatcccagcactttgggaggctgaggcaggcagatcacaaggtcaggagatcgagaccatcctggctaacatggtgaaaccccatctctactaaaaatacaaaaaattagccaggcgtggtggcatacgcctgtagtcccagctattcaggaggctgaggcaggagaatcacttgaacctgggaggtggaggttgcattgagccgagatcgcgccactgcactccagcctgggcgacagagtgagactccgtctcaaaaataaaaaagaaaaaaattttttgtccctgaattatgtgagaataagtggctgacatgatgccacatcacccccaaatatttgaatatgtctttcctacaaacaaggacattcttctacataactacaaaacaaccataaaaaatcaggaaattaacactgatgtgtcatactgtctaatcctcaggtcccattcaacttttgccagtggtccttcatagcagaaggatccagttctgaatcatatgttgatttaattgtcatgtcaggactagttccttaatctttctttgactttcgtgactttgacatggttcttttgtgtattgtccctcaatttgggtctgtgtggtgcttcctcatgattagctttgggttatgcatctctggcaggaatgtcacagaagggatgctctgttcttattgtatcctatcaagtggtgcatggttttgatttgtctcattactgatgatatcagctttgcttactggatgacgatgatgtctgccactgttcttcactgtaaagttactcttttcccctttgtaattaataagtaccttatgtgggggggggtggcaggtaactttgagaccttcatcagactttcaattcattatttttaaatcagtatggactcaggaattcctatgttactgaatggactataatatgttactatcatctatttgatgttcacatgatcccaggagtgtcccagtcccttcaggctagcttctgtgtggttttctttgatgtgtccccattattctttgagcactttctcactttctggcacaataaaatattctaggctcatcttatgcttttccctgccccagtcctagaatcacccacatctccaaggagcccttttttgaaatggagaatgatattttgaagtggaggatgatattttgaaatggagatatgtgcgttgggagtggtcattattcctgggtatcactgctcccataccctcttagtggaggagctgggaaatatatgtgcatatacgtacatatatgttatttctaaatctttgtacagatgtatgtatgaaaaccatgggatcgcactgatagctccaattccagttcagccaccacggggttcattctcatttccttcctttccatatttgtaattcccttctccaactggctccattctccttaatatattgacttatttaatcagttccgctgtatgtgaccaatttcctatggctgccacccctcatgcatcatggatgctcccctcaccttacctgggctctggtaccccacaccaggtccccctctgcaggctcaccctcttcattgtgctcaagctgtgacatgctctgccatcactcttgcagcctctctgcaaggatgtcctcctcaccgtgcttggatgccagcaccctactctaggttaccttacttgctcccacctaatgatatttgggctgaatggttgggaaagggtctgaaaaagggttctaatatattgtttaaaaaactatttttttatagagatggggtctccctgtgttgcccaggtttttcgtgaactcctgggctcaaaggatcttcctgcctcagcctcctaaagttctgattacaggtgtgagccgccgtgcctggcctttttttttttttttgagacagagtctcactcttgttgcccggcctggagtagagtggtccgatcttggctcattgcatcttctgcctctgggttcaggcgattctcctgcctcagcctcctgaacagctgggattacaggcacccgccatcacatctggctaatttttgtatttttagtagagacggggtttcaccatgttggccagtctggtctcaaactcctgacctcaggtgatctgcctgcctcggcctcccaaagtgctgggattacaggtgtgagccaccatgccaggccctaacttttaaaatatagatacaagcttgttgttaagcttacgcctagcaactacttttctctagattaaataaacccagttaaaaattcttggctgggcacagtggctcacacctgtaatccttgcactttgggagatcgaggcaggaggatcgcttgaggccaagactttgagaccagcctgggaaacatagtgagtccccatctctacaaaacccaaaaaattagctgggcatggtggcatgcactagtagttccagctactcagaagactgaggtgggaggattgcttcagcccaggaagtcgaggctgcagtgagctgtggtgacaccactgcactacagcctgattgactttggtttgcttaggtgtccttatatatacaaactcccctgccactaccctctttcttgctcattaacttctgttgatggccagtccctttaacctgttcacttgattctattccttctatttcttcaaggaactgccttatcacttggctttctccctcatttcctgagccttttctcaacttcacttttccctcaagttataaacatattcaaggttcttccatcttaaaatgaaaaataggccgggcagggtggcttacgcctgtaatcccagtagtttgggaggccgaggcgggtggatcacttgaggccaggagttcgagaccagcctgggcaatatggtgaaaccccgtctctactaaaactacaaaaagtagccgggcgtggtggtgcgtgcctgtaatcccagctactcgggaggctgaggcacgagaatcgcttgagcctgggaggcagaggttgcagtgagctgagatagactccagcctggacaacagagcgagactctgtctcaaaaacacaaaaattagccgggtgtagtggcatgtgcctgtagtcccaactactcaggaggttgaggcaggagaatggcttgaacccgggaggtggaggctgcagtgagctgagatcgcaccactgcattccagcctgggtgacagagtgaggctctgagtcaaaaaaaaaaaaaaagataagtaaaaaatcctctttccttataacacctcacactttcttccttacttcatagctcactttctgaaaagaacctagaaaatcacctgctctcattgcctctttatgctaacttcctgttaattaaacatttcccggtcggctgtgttccggcttctgctcctccacgccattgaatctgctcttgccaagctcgccattggcccctttactgcacagttgaatggatacttttcagggctgacctgacccctttgtggcttcttatatcgtccagcccatccttgggctttggtgacatttccttctgcttctctggctgctcttttgtagtcccctttgtaggttcctctttttctgttgatcccttaaatgtaggttatccccagggttttgtcttctgccctttcaaaaactgattattttttgaatttattttattttattttgtttatttattttttttgagctgtagtttcgctcttgttgcccaggctggagtgcaatggcgctatctcagctcactgcatcctccatctcccgggttcaagggattctcctgcctcagcctcccatgtagctgggataacaggcacacaccaccacgcccggctaattttttgtatctttagtagagacggggtttcaccatgttggccgggctggtctcgaacttctgacctcaggtgatccactcgcctcggcctcccaaagtgctgggattacagacgtgagccactgcgcccggccttttgaattttataatttgttcatattaattaaattttaaggcattttaaaatttaacaataaaattgttaaatcttttaaaattatttatttagtttttgagacagggtctcactctgtcacccaggctggagtgcagtggcgtgatcacagctcactgtagccttgacctcctggctcaagcagtcctcctgccttagcctcctgagtagctgggactacgggtgcacaccaccatgcccagctaatttttttgatttttagtagagacaaggtctgccatgttgcccaggctggtcccaaactgctggactcaagggatccccccacctcggcctcccaaagtgttgggattacaggtgtgagccactgcgcccagccctattttttcagttgaggttaaaatataaaatttaccatctttatctttttttttttttttttttgagacagagtctcactctgtcacctagactggagtgcagtggcaccatctcggctcactgtaacctctgcctctcgagttcgagcagttctcctgcctcagctttcgacgtagctgggattacaggcatctaccacaacgcccagctaatttttgtatctttagtagagatggggttttgccatgttggtcaggctggtctcaaactcgtgacttcaggtgatccccccacctcggcctcccaaagtgctgggattacaggtgtgagccaccgcgcctggctcatctttatcatttttaagtgtactgatcagtggtaaaaactacatttatattacattttcctccgtctcttctctacccttcccttctgcccttttttgggttgacgttgcagattctctataaactcatctactcccagtgtttcagttgctatcagtatgctgaatacttacaaagctacattttctggcctgcttttctgagtttcaatcaatttttcctcttagctactagatttatttttcttttttagagacagtctcactctgttgcccgggctgtagtgcagtggtaaaatcatagcctactgcaaccttaaacttgcgggctcaagtgttccttctgcctcagcctcctgagtagctgggactataggcacactgcaccatgcctggctaatttgttttgtttttttggaatagggtcttgctctgtcacccagggtggagtccagtggtgcgatcaccactcactgtatcctcgacatctcgggctcaagcatcctcccatcttagcctctcaagtagctgggaccacaggcacacgccaccatgcctggctaatttttgtattttactgtagagacgggatctcaccatgttgcctgggctggtctggaactcctgggctcaagtgatccatctgcctctgtcttccaaagtgctgggattacaggcttgatccaccatgcctggcctaatttttaaagttttttgtagagacaggggtctcactctgttgcccaggctagtctcaagctctgggctcacgtgatcctcctgctatggccttgcaaagccctaggattacaggtgtgaacaactgtgccctccccaataccttcatttggatgtgccataggctcttcaaattcaacgcattgaaaatggcccattcttttcttcctatattctctttttattttgagacagagtcttactctgttgttcaggctggagtgtagcggcatgatcatggctaactacagtcttgacctcctgggttcaagcaatcctcctacctatctcccgagtagctgggactacaggcatgtgccaccacacctggctaacttttgtgtttttggtagagatggagtctctgctgtgttgcctgggctggtcttgaactcctaggctcaagtgatcttcctgccttcgcctctaaaagtgttgggattacaggcatgagccactgtgcccagtctctcttctctttttcagtgactagtacaccacgcttacctatgcaagctagaaaactgaatttattcaagtcttctcaggtttaccttcttcttaactcatagtcttttcatttctactcctgttgccataggttggagccatctgatttctttgctggacaaagacttttaaatggagtttattgcctttagcctatcattcccccagtgtgtcctttagcaggtgcatagatggaaggatttacacttactcaacaagtatttattgagccacatatcttgtctgagagtttgtgatacaaatttgaatggatcatgggggaagcagggagccaatcaacatataatcatacaacttttttttttttttttttttttttgagacagtcttgctctgttgccaggctggagtgcagtggtacgatctcggctcactgcaacctctgcctcctgggttcaattgattctcctgcctcagcctcctgagtaactgggacgccaccacgcccggctaatttttgtatttttagtagacatggggtttcaccatgtcagccaggatggtctcgatctctcgacctcgtgatccgcctgccttggcctcccaaagtgctgggattacaggctgagccgccgcgcccggcccaacgtataattatacgactttaaatgagttgatatctgtaaggtgcatgaaccatgcatggcacatataaatgcttgttaaaatatggaaagtatacagataaccacagggtggtataggagtcaagggtgttatggggaaggagggataactgagtgaaataattgtttcatgattaattaggacaaagccaggaggaaaacaggtagccaagtccttgtgctttgtttctctttcctgaagatgtttgatactgtcagactcatgtgctgagttcttactctgatttgggcactgagtctctgtggagtggtaacaagctgtctggtgggtctgggcttgcttcgggctttgatttcttcaccaaatcttaaaattgagggggcagtcagattggaggatctcccaaatccttcaatttataaaagtgtttgatcctaggataagatgatcaatggaatattaggggctggatcttccaagcgagacaaggcttttcatggatctcagggaggaaattttaaatgttgggaaataattctgcctttttaaaatttggtacactcctgtttccctgcagttcttatttgttacatgcacaacaaaatccactccgccaagatgtctcctttatcgatagttacagccctggtggataagattggtaagtgatatcattttctatgcatacttagaattcttagtaatttcaagatattattgagattacaggacgtactctccttttatgggaattttttttttttttgagacggagttttgctcttgtcacccaggccggagtgtaatggcacgatcttggctcactgcaaccttcgcctcccaggttcaagcaattctcctgcctcagcctcccgagtagctgagattacaggcatgtgccaccacgcccggctaatttttgtatttttagtagagatgggattacaccatgtcggccaggctggtctcaaactcctgacctcaggtgatccacctgcctcggcctcccaaagtgctgggattacaggcatgagccaccgtgcctagccctttatggggaattttaatgtatatatgcatatgaaaatgtctagaatgctgtataccaagatatttattataattaggtgggttttgcatgattccagttttattttttatattctttgctttttctacatttttcaaaaacacatgtagatttcttctgcgtgtcaaaaaagttattttagttttgaagacaaaaaagaaatgtagtggaatttgccataatttctaattgttcatatttacagaacagaaaatttttggtatgacttggaccctgattgacttctgttttgcagatatgtgtaagaagagcttgagcccagaacaggacattaagttcagtggccatgttagctgggtcgggaagacatccatggaagtgaagatgcaaatgttccaggtaaatatgcgcctgaagattgtccactgtttaagtaaaaccagctagtctccatgcaagaaaagcttatttacctatgtatctgtagacaggtatgttgctcactgcttctagaaaaacagttgaaagctcatgtcatatggatggtgggttattaatatcctccttgtggacaaagcctgacgtactatttggtgtttatatttaatatttatttctaatcatatacaagtccatgttaaggtgtttgtttctggttctgcctaggagaatttcacagaagtctgtgttatggtaggagtgaatggaattgattactgtattcatttcccaggactgctgtacagttggccctctgtgtctgtagatttcacatccacagattcaaccaaccatggattgaaaatgtttggaaaaaaacagtgaaaaataatataaataaaacacaatacagtataacaaccatttttttaaaaaaatagagatggggctgggtgcagtggctcacgcctgtaatcccaccacgttgggaggctgaggtgggcagatcacttgaggccaggagtttgagaccagcctggccaatatggtgaaaccctgtctctatttaaaaaatacaaaaattagccaggcttggtggtgcacgcctgtaatctcagctacttaggaggctgagggttgggaaccgcttgaacccaggaggtggaggttgcagtgagctgagattgcgccactgcactccagcctgggcaacagagtgagactcgtctcaaaaaataaataaataaataaataaaaatagagaaatggatatggagtttcaccatgttgcccaggctggtcttgaacttctggcctcatgtggtcctcccaccttagcctccccaaatgctgggattacaggcatggctggccttaaaacaactatttatatggcatttatattgtattaggtattataagtaatccagagataatttaaagtacacaggaggaggtgcataggttttatgtaaatatgaccccattttatataggggagttgagcatctgtggattttggtattggcgggtggtggtagggagttctggaaccaatcctgcgtggattccaaggggcagcggtaccacaaagtaccataaactggtggcataaaaacagaaaatgtattgactcacagtttggaggctacgaatccaaaatcaaggtgtcagcagaggcatgttccctctaaaacctgtaagagagaagccttccttgtctgtttcttgcttctggtggtttgctggcaatccctagcgttccttggcttccagctgtagcacttcattcagtctctgcctccgtcatcacatggtgttctctcatgtgtctctgtctctctggtgtctcttgtcaggatgctgctaatcatactggattaagggcccacgctactccggcatgacctcatcttaactaattatgtctgcaacgactctatttccaaatacagtcacgttcacagttatgggggttaggatttccacatgtctttttgggggacacagttgggcccttaacagtcatttgagctattacagtagttaggaacagctaatctgatgagtaaaactcagaatagctattacaaacaattgaagaaatttgacaagaaaaagtacctcaaagaggataacaacacagaaataaaatgattcagtgtatgtccaagatttcattgtggaaaacttatttaagaatgactggctgggcgcggtggctcacgcctgtaatcccagcactttgggaggccaaggcgggcagatcaccaggtcaggagatcgagaccatcctggctaacacggtgaaaccctgtctctactaaaaataaaaaaattagccgggcgtggtggcgggtgcctgtaatcccagctatgggaggctgaggcaggagaatggcgtgaacccaggaggcggagcttgcagtgagccgagatcacaccactgctctccagcctgggcgacagagcgagactccgtctcaaaaaaaaaaaaatgacttattcatttatgccagggtattgagtagaccaggggtccccaacccccgggccatgggctacatagcaggaggtgagctgtgggcaagagagaattaccacctgagctccgcctcctgtcagatcagcagcggcattagattctcataggagcacgaaccctatcgtgagctgcgcatgtgagggatctaggttgcacactccttaggagaatctagtgcccgatgatctgaggcggagcagtttcatcccaaaaccatcccccccagcccaccccattccgtggaaaaattgtataccacaaaactggtccctggtgcaaaaaaggttgggggccactgcagtagacctattattcagatgcattttttcctgctatggaatgatgaagcatttcaccttttggtgaaataaactttcacactttcagaaaaagcctgaagctagctctgtagtagttatttgtcaaaataagtattttttttattcagtactatatgcaagtgattgaatctttcaattcccatgtttgatgtaactgacagtaatactgttttattttgtttgtttgagacagtgtcactctgtctcccaggctggagtgtagtggcgcgatctcagctttctgctacctctgcccctcgggttccagtgattctcatgcctcagcctcccaagtagctgggactacagatgtgtgtcaccatgcctggctaatttttgtatttttagtagagacggggttttaccatgttgcccaggctggtcttgaactcttggactcaagccatccacccgccctcgcctcccaaagtgctgggatttcaggcgtgagccaccgtgcccagccagtaatactgttttaaaaacaaaacattgctgggttgctgctatgatctgcctacagtctttttttttttttttttttttttgagacggagtcttgctctgtcacccaggctggagtgcagtggtgcgatctcggctcactgcaagctccgtctcctgggttcatgccattctcctgcctcagcctcccaagtagctgggactacaggtgcctaccaccatgcccggctaatttttttgtatttttagtgcagacggggtttcaccgtgttagccaggatgatctcgatctcctgacctcatgatccgcctgcctcggcctcccaaagtgctgggattacaggcgtgagccaccgtgcccggcctgttctgcctacagtcttttaaaaaatattcttggttaattcctagtctgctcagtgccatgcacagcagattcctggcacaggacctgccttttagggcatcttgacaatttgcctcttggacaaataggttgaaaaagagatacaggaattattgagagagaaccagtggaactcagtgtcagacaagtaaacacttttgttttaaatttgcattcttcactggctatttgactaataactcatgactcgagtgatcctttttattccagagaagtggtgtggggataagcactctgcctctggtttgcatagatttaggttctaatcccagcactgctgcttcctagtcatgtggctgtggataaaccacttgtctgagcctctgtgttctcaaatgtaacatgaaaatagtaacagagtaccatgttatatggttgtggtaagggaaatttgaaaaaaacccattcatgtgaagtactttggtacagtgcctatcacacagtaaccactgttggaaatttttttttttttttgagacagggtcttgttctgtcacccaggctggagtgcagtggcatgatctcggctcactgcagcctctgcctcctgggttcaagcaattctcctgtctcagcctccctagtagctgagattacaagtgcacaccaccatgcgtggctagtttttgtattttttatacagaccgggtttcaccatcttggccaggctggtctcgaactcctgacctcaagtgatccgcctgcctcggcctcccaaagtgctggaattataggcgtgggccgccgcccccagcctggcaataatattaatttattataaatactgttgaggtggcctcaaatttctattttgggcttgaccttcatacccactttcctgagtgctccttatatttctccacctagacgtgctgttgctacctcaagttccaataaacagtatgttccaaactgattggccccaattctcatcctcctccagtcttccctttgccagcctcctgcttcctttcccatgcagccttttgccaggtcttgcaaattcatcacccacagcaactcaccagaattctttctccccatatccttttggccctgtgttttattcaagtcctcactgcctcttgtgtgagtgccttaaccgtcttttaattaacctgactttctctagccggacctctctcttttaattttatgcatttttaccacataagtcttccaaagctgatcttgaatcaggtcacttcccttctcagaaaccttcagtgaccattcattatctctggattaaagtctaaactcctttgactagcccaggtgcagtggctcacggctccaatctcaggactttgggaggccgaggcaggtggatctcctgagctcaggagttcaagaccagcctgagcaacatggtgaaaccccgtctctacaaaaagtacaaaaaactggctgggcgtggtggccatgtctgtaatcccaacactttgggaggccgaggcaggcgaatcatgagttcaggagtttgagaccagcctggccaatatggtgaaatatcccatctctactaaaaatacaaaaattagctgggggtggtgccacgtgcccgtagtcccagctactgcggaggctgaggcagaagaatcgcttgaacctgggagatggagttttcagtgagccgagatagcgccactgcaccccagcctcggcgacagagtgagactcggtctcaaaaaaaaaagtacaaaaaattagctggtgtggtggcgtgcgcctgtgatcccagccactcgggaggctgaggtgggaggatcgcttgaggcaggggggtggaggttacagtgagccgagattgcgccactgtactccaacctgggtgacagagtgagaccccatctcaaacaaaaaacaaaactcctttgattaattagggcccaaggggcttcataaactagccccagcctacctttccaactatattccctttgacttgtcatttatataccttcttaatgctcaccactggccttcaagcatcgtaagaatagggagttattcatgtttgcgttctagtgcttggcactagtgggtattcatgatagtaaaccataacttacataggttgagcattgcaactctgaaatctgaaatgctccaaaatctgactttgagcactgacatgatgcccaaaggaaatgctcattgggtttggaatgttcaacctgtaagtattgaatgcaaacattccaaatccaaaaatcgaaaatccaaaatagtctggaatacagaacacttctggtcccaagcattttggataagggatattcaactgggagtgagtgaatgagtataattgctgatgctttttcttttgcctgaaattctcgtgctctggctctgtatccacattctttctccctgtgctccaggataacttcatgctcaatcctttccttattctcccagcatgtaacacctgttcctcaggcctcctccctcaataccgtctctttgacttgctctcctggcacctgctagtctcctacagagctgtgcatgaatatgtcttttctcttccactgcggactctactcctcaacgataggacctgggtttgagtcacctagctcacttcctgacatccattcatttaacattcatttagcaatcatttattgagtgcctgtcctgtgccaggcatacagcagtgagcaaaacagataaagttccattctcttggagttgacattctagtagtgcctagaacctgcctccttcattcattggcaaatattgatcaggtatctgctatttgctggtctttgtgctaaatactagggatataactgggggaaaatggtctttgtcctacaggagctcacggtgcagtagggagacagtcacataaacaaatggttatgatatagtatatcgttatgcagtatttttcaacagggacactgttggcatttctggtgggagcattcattgttctgcaggtctatcccctgcattgtgagggatttagctccttggttacccccctccatagtaatgccccccaagttatgtgacaacaaaaaccactctgtatttttcaaatgcccgcctattagagtgacatctacttctcttacattgagaaccactgtcaagagaggactgtttctattaagggggctgaatgaaggaggcaaagataaacttggtctggggaatagggatgggggaggggaggaatgtcgtgaagaatgaggctgctgaggaaggcatcaggtaaagatatagacaggaggcagtcaacagcctgttctatcccaggacctctcagttgttagttagctatggctagagaaaaaggtgcaggtatgagcacagtatttggtgaacaactggggagcaatcgtgggctctgttgtggagggctttatatgccacgctaacaggattagcccaggtgctggtggaagaaaggaggaactattgaaaggtttgaatagggcagaggcataatgagattggtgagactgttcctgcaattgagggggagggcagtagtgatgaggcttgtatcatttattgaggagggaacccaatatactctcaggttataaataacttctgtcattactttatggtatgactttcctggaagtacagacttctaggggataaagaaacatcttaaggcccaggcatggtggctcatgcctgtaatcccagcattttgggaggctgaggctggtagattccttgagctcaggaggtcaagaccagcctgggtaacatggaaaaccccatctctacaaaaattagctgggtgtggtggtgcatgcctatggtgtcagctagtcaggaggctgaggtgggaggattgcttgagcccatgaggtcgagactgcagtgagacatgatcatgccactgtactccaacctgggtgatagagtgagaccctcttcctggggagagaaaaaaagaaacatcttaaaacctcagaggcctatgcattgtaaatacaggttgagtattccttacctgaaatgcctgggaccagaagtgtttctgatttcagaatatttatatttactggttgagcattcctaatcccagagttcaaaatcttgaaatgctccaatgagcatttccttgagtgtcatgtcagtgcttgaaaagttttggattttggagtattttttatttttggattagagatgctcaacctgtatttaacttaacccacataatcatctttgattttacctcttcttgggagctcctgtgcccagctatgaaggcataaactgtgctagtggttggcacactacagttccctgaaacatactagtgtttgtgagcatgatgggaggtccgtctgggtaggtgtgccatcaggaggacaggcacgccctgcaagaagctcagattctgaggaaagcaggcaaattaaacgctgatgatactctctgtgacccttgcctttgggtcccagtcttgcacagttccaaactccatgccagcagcccatctcatgcagtatactatttgcgttttgtttgttttgttttggagatgggatgttttctgtcatccaggctacagtgcagggtcgtgatcatagctcagtgcatccttgaactcctgggctcaagggatcctcctgcctcagcttcccactagctggtactacaggcatgcaccaccatgcctggctaattttttaatttttatttgtagttagagaccaggtctcgctatgttgcctaggctgatctcgctttcctggtctcaggcaatcctctcatctaggcctctcaaaatgctgggattataggcatgaggtaccatgcccagcccccgattggactttgaggtatttttctcctctgctaggccacgggctcctttgtcatcctgccattctgagagcctagtgctgtgcctggctcagggtaggcccttagcagacggtggttaatgagagtgcttctcttctttttccagttgcaggctttctctctctctctctctcttttttttttttctttttttttttttagacaggggcctgcaatctcggctcactgcaaccttggcctcctgggttcaagcaattctcatgcctcagtctactgagtagctgaggttagaggcatgcgccaccacaccctgctaatttttgtattatttagtagagacagggttttgccatattggccaggctggtctcaaactcctggcctcaagtgatcctcccaccttggcctctcaaagtgctgggattataggcgtgagcgactgcacctggccagcatacataccgtctgttagaatcgtggtaggtcttcccgataaatccatttctcatatgtacattttctttcctttgttcttcagttacatggtgatgaattttgtcctgttttggatgcaacatttgtaatggtggctcgtgattctgaaaataaagggtaattgctattttttcataattctttattttgaagaatttcaaagatacataagactggagagaaaactataatgaatgtccatatacctatcacttggacgtaacagttttaattgcaatttcttggccatttttattttaaggcaaatcccagacatgacatttcactcttaaatacttcgggcatcttttaaaaaatgagaatattctcaggccgggagaggtggctcacgcctgtaatcccagcactttgggaggccaaggctggtggatcacttaaggtcaggagttgaagaccagcctggccggcatggtgaaaccccatctctactaaaaacacaaaaattagctgggcgtggtggcacgcgcctatggtcccagctactggggaggctgaggcacgagaattacttgactctgggaggtggaagttgcagtgtgccgagattgcgccattgcactccagcctgggcgacagagcgagactccatctcaaaacaacaacaacaaaaagagatgttgcacaattctgtgaatacactaaaagccgttaaattgtacactttcaatgggtgaattgtgtggtatgcgaattataccttaataaagctgttatcaaaaaaaaacagacttacagacataaaaatcaaatgtaattttttgttaggcatgacaatagtaatgtagttacttaagagaatattatcctttttttttttttttttttaagatggagttttgctcttgttgcccaggctggagtgcaatggtgggatctcggttcactgcaacctccgcctcctgggtttgagcgattctcctgcctcagcctcctgagtaactgggattacaggcatgtgccaccatgcctggctaatttttgtatttttagtagagatgggggggtgtttcactatgttgcccaggctggtctcgaactcctgacctcaagtgatccacccacctcagcctcccaaagtgttgagattacaggcgtgagccaccatgcccagctgagttgtgcaatctcttaaatctgttttaatccagaacagttgtgtcttcccctattgtttcttattcactcgttgagaggctggatcatttgttctaaatagtgtcccactttctggatttgttctattgctttctcatggtggtttgtttgtttgttttttgatcttgtttctctatccctagtaatttctctaaactgaagttagatctaaagccttgtattagatttaggttgagcatatttggtgagagtactacatagatgatgttgtatatctcgtatttcatattgcatcgtatcaggaggtacaggttgtcccactcacagtgatgctaagattagtgtgtgggttcaagcagttacagcctaatctctcctttgtgaagttcagtttttcctcttctgatcagcaacaatctacaggggtgtactttgtcatcctgcaaatagctgagtttcccatcagtctttttccagtgctttcaatgtccactgctgatcattgctttaattagtatcattaggcagtttagagtaattctcaaattttgtcattccttctatgtttgttagctggaattctgtaaagaagagcgttcccttaacaactagggcgattgggtttgaaatggagttaggatcaatgcttcattcttgtcttttatttacatgttttcagaataaggagttggttcactagctagtgatgacatgcttttcccagttttttagctttttagaaaagtatcatgtttttaaatttctttttttttttctgtgtgtgtgtgtttttgagatggagtctcgctcagtcacccacactggactgcagtggcgcaatctcggctcactgcagcctctgtctcctgggttgaagagattctcctgcctctgcctcccaagtagctgggactacaggcatgccccattatgcttggctaatttgttttgtatttatagtagagacggggtttcaccatgttggccaggctggcctcgatctcctgacctcaagtgatctgcccacctagggattccaaagtgctgagataacaggcgtgagtcatttcgcccagcccgttttttttttgtttttttattttttttgagatgaagttttgctcttctctccaggttggagtgcattgtcatgtgtcatgagcatggctcactgcagcctgggcctcctgtgctcaagcaatccttccgcctcagcctcctgagtagctgggaccacaggcacataccaccatgccgagctaattttttttctttctttctttttgagatggagttttactcttgttgccccggctggggtgcagtggcgcaatctcggctcactgcaacctccacctcctggttcaagtgattctctggcctcagcctcctgagtagctgcccagctaatttttaaattttttgtagagatggggttttgccatgttggccaaactgatctcaaaatcctgggctcaagtgatcctctcacctcggcctcccaaagtgctaggattacaggtgtgagccactgtcctgccagaaaagcatcattatgaattcatggttgtaatatattacatgtatttcaataaattgcagccattgtttctcttgatgctccaagtgtgccttctttgggcggtgggagttcctctaagctggctcctttccacctgtctgtttgatagcttcctgctgtctgacacaagatgtcttgggctcatcttacgtatttcctgccccaggcctggagtcagccatttctccaagtagtcctggggttccttttagtgggaactggtatttagacatcaaaatctgggcactagaactgtacattgttactagtttgttattgtttccaggcctttttagtggacagagctaggatatattttaaacaaacaaaaaacctcatgagagctgggtgtggtggctcacgcctgtaatcccagcactttgggaggccgaggtgggcagatcacttgagcccaggagtttgagaccagcctggccaacatggcgaatccccatctctactaaaagtacaaaaaaattagccaggtatggtagcatgtgtctgtagtcccagacgatgtgggaggctgaggtgggaggattgctttaacccgggaagcagaggttgcagtgagccaaggtcgcaccactgcacgccagcctgggcgacagggcaagaccctacctcaaaaaaagagcctcatgagtttatatggtcattttcaagtcatttaaccatatagacttcaacttactttacgtcatcttttttctctgaaattgaattcttggtttctaacaacagttacacccaaactgagaaaaactaattgtgggggtagagctggggtgggagggattgctctttgcacaggacagagtccagtggcctgtgggaaatctcatttgtattagaaacttgatttaggagtctgcagtgaaaaatctttgctgctgcgtggaaagctgacttggaaagccaaattaagatagaaaaatatgttggtcccttagtgatctgagggaagaataacacccatctactctggcccttcctgccagccccagctgacctgctgtggccagtgactggcctggggcttgtattcaagcactgaggccactgctgcaagtttcactcccagctgatgcatgtcactttcccaagctgttgtttcaattcttttgttttttgttttcaagacagaggttggctcttgtcacccaggctggagtgcagtggtgctatctcggctcactgcaacctctacctcctgggttcaagtgattctcctgcctcagcctcctgagtagctgggattacaggcacctaccaccacacccggctgacttttgtatttttagtagagacggggtttcaccatgttgaccaggctggtctcgaactcctgaccttaggtgatccacctgccttggcctcccgaagtgctgggattacgagcgtgaaccactgcccccggcctgttttaattcttttgtttccattgttgtttcatcaaatcttttgattctaccacagtgaaatattatcccttttcccttattttttatttcaaaaaatttgatgcttacagaaaagtagatagaataatgcaacaaacgtatgcctttcacgtaaattgtattacatttgcgtaattctcttaccctctctctacaaatacacacatttacatattttttcccatgaatcattggaaagtaagtttgagactgcttcacccattcaggagttcagcatgtatttcctaagaaccaggtatttctccataacctcaatgcctttattatatctgagaaattcaacagtgatacagttatttaatatgtgatccgtattcagatttcaccagttgtccctaaaatgtcctttatagctatcttcctgattcaggacccaatccatcaaggattgtatattgcatttggttatcctgtttctttagaatagtctctctgccatttgctgtctttcaaaaattgatatttttaaagagttcaagccagttttctttttcttttttttttttttttctttttttgagacagagtttcgctcttgttgcccaggctggagtgcactggcacgatctcggctcaccgcaacctccacctcctgggttcaagcaattctcctgcctcagcctcccgagtagctgggattacaggcatgtgccaccacgcccggctaattttgtatttttagtagaaacgaggtttctccttgttggtcaggctggtctcaaactcccaacttcaggtgatccccacccggcttggcctctcaaagtgctgggattacaggcgtgagccaccacgcccggcctaaagccagttttcttgtagagtgttctacaacctatatttgactgtttcctcatgattagaatcaggttaaacatttagcagatgccagtatcctttttataatgttaagtttctagtgtgcaattaaggctgtaactgtaaggcttccctaattgttccagcgttcacatgtaaggcaagcagtaagcactacccaaaatgaaaagcagattctttaaaagtagtaggtgattgttcatcttcaagttttattagataatggcatatcttaaattatattcttttttttcttctttttaggccggcatttgtaaatccactcatccctgaaagcccagaggaagaggagctctttagacaaggggaatgtacattaatttgtttataataaaataaatttgaaaagcacattaattacgctgcagaagagattatttaagattttatatgggctcttcataccagtcaaatgtcttttttttgtttgtttttttgtttgttttttttgaaatggagtctctctgtctcttgccaggctggagtgcagtggtgccatctcggctcactgcaacctctgcctcctgggttcaagtgattcttctgccccagcctcctgagtagctgggactacaggtgcgcgccaccacacccagctaatttttgtacttttagtagagatggggtttcaccattttggccaggatggtctcgatctcctgaactcgtgatccgcctgccttggcctcccaaagtgctgggattacaggcgtgagccattgtgcctggcccaaatgtcttattcataccaataatttattgaaattaaaaatatgctattcttttttctttggagtccatactttgaatgattttattgatcagacaatatttattaagtgaagtaatttgttatctccgttttttttttttagacagttcttgctctgttgcccaggctggagttgggcttgggtccaggagtttgaggctacaatgaacaatattgtagtctcgatctcctgggcccaagctatccacccacctcagcctcctgagtagctaggactataggcacgtgccaccatgcctggctaattaaaatttttctttgtagagacaggggtctcactatgttgcccaggctggtcttgaactcctggactcaagcaatcctcctgcctccgcctcccaaagtgttgggattacaggcatgagccactgcacctggcctgttttctccgttttaatgaagtgagaaatgcatctcaatgggataactgcaggtcagggctctggatcaggatgatatcaagtgatctcacactgaaccaatataatttccatgtggaaccaaagactcactgggagttttatgtggcctctgcagttttctcttggatacgtgtataattttcagtgagattttgaaaggcatcccaggtcagaataccgtgtgctgtagtgcgaccgtcctgatcattgctccttattctcccttgttccagtgaacaaggggagaagaattgccttcagctccacgtcgttactgaaaatggcccccagcgctgaggagaggaccaccatacatgagatgtttctcagcacactggatccaaagtaaggatggtgagattccacgttgggaaaacatttaaaccttggccttttttttttttttttttttttgagacggagtttcgctcttgttacccaggctggagtgcaatggcacgatcttggctcactgcaacctctgcctcccgggttcaagtgattctcctgcctcagcctccgagtagctgggattataggcatgcacctccacgcctggttaattttgtatttttagtagagacggggtttctccatgttggtcaggcttgtcttgaactcctgacctcaggtgatctgcctgtctccacctcccaaagtgctgggattacaggcgtgagccaccacacccgaccttttttgtttttgagatggagtcttaccctgttgcccaggctggaatgcagtggcgtgatcttggctcactacaacctctgcctcccgggttcaagcaattctcctgtctcagcctcccaagtagctgggattacaggcgcccgccaccacgcctgctaattattttgtatttttagtagagacggggtttcaccacgttggccaggctggtctcaagctcctgacctcatgtgatctgcctgcctcggcctcccaaagtgttgggattacaggcgtgagccaccgcgcctggcctaaaccttggccttctccagagccacagttgtctgagtgtattgggagtgacttgcaaatgtttttacttttcaacaagagaaccatggcattaacagggtttaataaatattcatttgtacaggactataagttttcggagtcgagttttaccctctaatgcagtgtggatggagaattcaaaactgaagagtttggaaatttgccaccctcaggtattataatttagtgagaaatccgaataggatagcttccgttcatgatatttgtccaagatttgacacacctttaaactggcctttgtcctgtggcattgttaattcctctgttctgtatacaaaggtggccataagttttgtatttattgatatttatttatgtcctgtaggagcggaacattttcaatcggatctttggtggtttccttatgaggaaggcatatgaacttgcgtgggctactgcttgtagctttgggtgagttacatgtaaggcagccttaacttctgagaagcaatttatatcaccccactgaaatgaaacatttcggaccagtctgggtgtgtgtgggaatatgttatgtttttgaatgaataccacactgataccagctgaatttgatcttcattttagaaggttgtttctctgactttgtaagttcatacattaaaaaaactactgagaaaatacagtgatgatatgtagaaaggaaaagatatagttattttggccctaatctgctcacgatggcgtctcttaccatttctcactggtaggatcttttcccccttctctaactttattcttcgttcatttttattttgcttcagctagttgttagaggaaacaattgagatcatctgaattttgcaatataccccaaattctgtcctttcccccaacagtggttctcgaccgtttgtggtagcagtagatgacatcatgtttcagaaacctgttgaggttggctcattgctctttctttcttcacaggtaggtgtgtgatgagagatgacatacaacttttttttttcatttgagcctagaagtttctatatcaaaaagccactgttttctcttatgactgcctttttccccttcctaatgcagttgactgattatagtgtctataatctgttaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggaggtaagtagtgattattgcttgtccctaacaaagggaagaacttctaaggacatttttctccttttgaattggaggaagtgtattgatgcctgtcagcacaagagcatgtcttcaggagattttgcttttgagatttggcagccctgaaggccaaagatgcctgtggcccccaggcgggcaagcaaccactggtagtcaaaaactgatccagccaggctgggcgtggtggctcatgcctgtaatcccagcactttgggaggccgagacgggcagatcacgagttcaggagatcgagaccatcctggctaacacggtgaaaccccgtctctactagaaaaaaaaaaaaaaaaaaaaaattagccgggcacggtggcgggcacctgtagtcccagctactcgggaggctgaggcaggagaatggcgtgaacctgggaggcggagcttgcagtgagctgagattgtgccactgcactccagtctgggcaacagagcgagactccgtctcaaaaaaaaaaaaaaaaaaaaaactgatccagccaaaggaaggggacaggagtcatggcctgctcctttgggaatgtggcacaccccggcccaacagtgtatcttgttctgtcccagtgttcccaagtagtcttgtgtttgtatgatgatatgatggttttctacggtattacaagtttctccaaggttctctttcttgtgtttcagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattgagaggctgggcgtggtggctcatgcctataatcccagcactttgggaggctgaggcgggcggatcatgaagtcaggagatcaagaccatcctggccaacatggtgaaaccctgtctctactaaaaatacagaaaattagccgtggtggcatgtgcctgtagtcccagctacttgggaggctgaggcaggagaattgcttgaacccaggaggtggaggttgcagtgagctgagattgcaccattgcactccagcctgggcgacagagagagactgtctcaaaaattaattaattaattaattaattgaggataccattggatgcattcttttcttacacatattgcaactgtcagtatacaaggtttcctgccagggtatttggatgacgttctttaaacctaaccacttgctctgtgctgtctaaatcccatcagccgtacatgattcctttgcttccctctatttcccagcttttgttgtcagagggtagatgaaaagttggggcgaagggatttaacaaaagttactgcatccgtaaagatttgtgggaagatttaggtctgaaaccataccattagaaggtgtttagagatgatctagataaggaaatacaggaccatttggtcattctttcattcaccagacagctatttagcacattctgctagtggctccgcaggatatatctgatttaaaaaataggaaccacaataataatagctgcttatgcttatggagcattgccatgtgctagataggcaccatcctcagcccttggcaggtctgagctcctttatttcttccaatcaacactatgaggcaggttctgtaaccccccttagggttaggccactcgggaaactgaagcacagagagtttaagtaacttcctggaggtccgacgcgtaacatgtggaggtgctgggattcaaaaccaggcaatgtgggtcccgggcactcttgaccagtgcctgtacttcttccaaggaatagagcaagggaggtcataccgaatatcacagtgtcacctaggaagcccaagggaggtattcccgttaatctgcagccaaggccgggcgcggtagctcatgcctgtaatcccagcactttgggaggccaaggcggatggatcatgaggtcaggagttcaagaccagcctggccgagatggtgaaaccccgtttctactaaaaatacaaaaattagccgggcgtggtggcggacgcctgtaatcccagctactcgggaggctgaggcagagaactgcttgaacctgggaggcagaggttgcagtgagctgtgatcatgccactgcactccagcctgggtgacagaacgagactccatctcaaaaaaaaaaaaaaaaaaaaatctgtagccaagaccgttccttttttgacaggaaggtaacttagaagaaaaaataatctctgaaaaaagtcctcccaagaaggaagcaatatttattgtgggttctacattagtgttcacaaacttggctctgcctcagaattaggtggaaagtatttttgtgtgtgtgtgtgtgtgtgagacagagtttcactctgtcgctccagctggagtgcagtggcatgatcttggctcactgcaacctctacctcccgggttcaagcgattctcctgcctcagcctcctgagtagctaggattacaggtgtcagcccccatgcctggctagtttttgtatttttagtagaaaggcggtttcaccatgttggccagctggtctcaaattcctgacctcaggtgatccacctaccttggcctcccaaagtgctgggattataggcatgagccactgcacccggccggtggaaagcatttttaacaaaaaatttttaggccaggcacagtggtggctcatgcctgtaatcccagcactttgggagactgagatgggaggatcgcttgagaccagcctgggaaacatagtgagaccctttctctacaaaaagttaaaaaattatctgagcatggtggtgtgcacctgtagtcccagttaggaggctgaggtgagtggattgcttgagtccaggagtttgagtctgcagtgagctatgatcatgccactgcactccagtctgggtgacagcaagac

SEQ ID NO: 38688 - DNA, 55959 bp, Homo sapiens; identical to SEQ ID NO: 37692

SEQ ID NO: 38689 - DNA, 158034 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgggtgagtgagcgcgggggccctgcctccgcgggatcctcgcgtgtgccggagtctgcgagtgcgcgggaggcgctccaggcgccagggtcctccgggtgtcctgggcgtgtcgccgtgggcgggcgggggccgtgtccgccgctgtgtccctgtgtctgggtgtgagagccccgagcccgcgtctcccctctgtgtgggtctctccttgtgtcactggagttctggtgttactagggcgagtggcctttgtgcttcagcttgtgtgtgtgtgtggcctccagccggctggagtcaggacagtttgggaacccccacccccaccctgtgcctcactttcccctgtggtccacttcttcctgcgctgaccttgggggtccctgggatcgggtgaagtcagggagtgcccctgtcgcctctgtggtgagtcagcctctcccaccctggacccccgcccagaggcggaacgggacggcctcctgcaggaggagactgtgggaggagaggatgccgggtcagccggaggccgtggctgcggagccgccagtcccggatcctccctggaacagggatatatgtcagggagggccctagatgaagaccagcccccctggagtcgctgggatggcctccgagagggagagcaggcctgactgtagggggcatggggacaattcttcctccctctgccaaagcggggccctggggcgggggtctcgaatcttcctttggccctgaaagccaggaggccctgcgttgcatcagtgccaagtagagaggtggtggctggtgggctgcactttcccactggctttggagctcagtttctgccccagagtccttggcctcccttaaggatgctactgggaagccacgccccacctgccgggagccccatctgctcctcctcgggttctggggagagagggcaggttgtgcgggctcattagaatgcatagctcttcccagcatccgcccagcactgtgccccccacggtgttcaggccctggacacacagactagaaagcaggtcagcctccggaaatctccaagctccctgtgactgtgggctggggactgcccttccccttcatcgggccctcaggctgaagctcagaaccctcctgtaaggaaggcttcctggggtgcccgaatctgatgctcgctctgtccccaggcgcttgccttcctgaggccccctgtcccttccccttccaccaaagagcctctgtgggctgttctctctatccaggaagtgggtcccatccttcacctctttcatttctcactcgggagctacttcctctccagtgagccagggtagccacagtgctctgagggttcctgccccagttgtgggggcggggggcttttttcagtcttccagtggaacaggggccatgtctgtccttgatcacagctcagaacagtgcctggtgcatagtgggtgctctacacatagttgctgaataaatgaatgtccaataactaatggttcccaaattctgtttcaagttttaactctggagtagtctggggaggggcgaaagctggtgtactgctctggggcccaggtaccaggttagtataagaggaggttgggtgtggtggctcacccttgtaatcccagcactttgggaggccaagttgggtggatcacttgaggtcaggagttcgggatcagcttggccaacatggtgaaaccctgtctttactaaaaatgcaaaaattatggccaggctcagtagctcatgtctgtaatcccagcactttgggaggctgaggtgggcggattacctgaggtcaggagttcaggactagcctggccaacatggtgaaaccccatctctactaaaaatataaaattagctgggcatagtggcacatgcctgtagtcccagctactcgggaggctgaagcaggagaatcgcttgaacccgggaagtgcaggttgcagtgagccaagatcgcaccattgcactccagcttgggtgacaagagtgaaactccatttcaaaacaaaaacgaaaacagaaattagctgggtgtggtggtgcacgtctgtaatcccagctatttgggaggctgaggtgggagggtcgcttgaacccgggaggcggaggttacagtgaaccaagattgtgccactgcactccagcctgggtaacagaatgagattctatctcaaaagaaaaaaagaaaagaaaagaagaagattgagcatggtggctcatgcttgtaatcccagcactttaggagcctcaggtgggaggatcacttgagcgcaggtgttcgggaccagcctgggcaacacaagagaacatgtctctacaaaaaattttaaaaattagttggatgtgctggtgcacgcctgtagtcccagctactcaggaggctgagatgggaggatcacttgagcctggaagttcgaggctgcagtgagctgtgattgtgccaccgtactacagcttaagtgacagagggagaccctgtcttaattatatatatgagaaaagtgtactgttacttggggaaatagtatattaattaacagacatttatagtatatgctgagtgccaggtgttgggctagatgctttaagcatgtacctcttacacactgagaaggaacagagtggaaagaatacatgtaatcttctatgattaattttgaaaagataaagtaaatgatatatatgccatgataagataataacgtggatttatattgtactttcatatctgctatctctttgttttgacaacaccctagtagttaggcagggagatgggttcatatccatcttacagatgaggaagctgagcatacagcatttaagtgactgtcgaaggtcactgctgaagcgagtcagcgaaggcgccagcactcagcctgggactccctggccactcagtccttgctttcttctgcacaactgtctccagtgccttttgtattcctgtcacccggctagacaagggtgaatgggccactgttcttgccctcaaggggtctaaagtccaggagagaatcaggctctttaacaactgagtgtgccagagttgttccgccccatggtgccaccttgggcccagctcagctccttccttgcagtgtcccagagagttcttcttctctctacctcagtggagggcatcagagccattttcattcaggaccctggtctgatgacattcccaggagtgactggtccttacagagcctctgccgggtcctgggcagtggtgagttgggagccagctcacacctacacataagagctgattgctaaattttaggaattttatgagccggttgttaaacacaaccattataaaaaattctgaggccaggagcgatggctcatgcgtgtaatcccagcactttgggaggccaaggcaggcagatcccctgaggtcgggagttcgagactagcctggccaacatggtgaaaccccatctctactaaaaatacaaaaattagctgggtgtggtggcccatgcctgtaatcccagctactcgggagtctgaggcaggagaattgctggaacccaggaggcggaggttgcagtgagccgaggttgtgccattgtactccagcctgggggacaagagtaaaactccgtctcaaaaaaaaaaattttttttgagtgtatacattcatcattaagtaaattatatatatatagtttgtttgtttgtttgttttttgagatggagtctcactcttttgcccaggctggagtgaaatggtacaatcttagctcactgcaaccaccgccccctggtttcaagtgattctcctgcctcagccccctcagtagctggaattacaggtgcctgccaccacgcccagctaatttttgtatttttagtagagacggggttttaccatgttggccaggctggtctcaaactcctgacctcaggtgatccacctgcctcagcctcccaaagtgctgggattacaggcatgagccaccgcgcctggctgctattatatatttttgagatggagtttcactcttgttgctcaggctggaatgcagtggcgtgatctctgctcactgcaacctccacctcctgggttcaagtgattctcctgcctcagcctctgggattacagtagctgggattacaggtgcctgccaccacacctggctaattttttgtattttagtagagatggggtttcactatgttggccaggctggtcttgaactgctgacctcaggtggtccacctgcctcagcctctcaaagtgctggaattacaattatgagccactgtgactggccataaattttatacatatatatgtgtgtatatatatatataataattttttttttgagatggagttttggctcttgttgctcaggctggagtgcaatggcatgatctcggctcactacaacctctgcctcccacgcacgttcaagcgattctcatgcctcagcctcccgagtagctgggactacaggcgtgcaccactactcccggctaatttttgtatttttagtagagacggggtttcaccatgtgggccaggctggtctcaaactcctgacctcaggtgatctgcccacctcagcctcccaaagtgctgggattacaggcgtgagccaccatgcccagcctgtaaattatattttataaagtaataaatactcaatttttttcctaattattttattctattattacctgtgcttttgtggttatttgctgctttgtgtgtgtgtgcgttggggagtgtattagttctttttcatactgctattttcatactgctatgaagaaatacctgagactaggtaatttgtaaagaaaaagagatttaatggactcacagttccacatggctggggaggtctcacaatcatggtagaaggcgaaggaggagcaaaggcacattttacatggtggcaggcgagagagcctgtgtaagggaactgtcctttataaaaccttcaggtcttgggagacttattcactatcatgagaacagcatggggaaaacctgcccctgtgattcaattacctcccaccacgtccctcccatgacatgcagggattatgggagctacaattcaagatgagatttgggtggggacgcagccaaaccatatcaaggggtgtgagtgtgggtgtgggtgtgtgtgtaatgtacgtagtggtgtgctactgcatatctcaactccattcagtgatgtcacattggcagcttgaaattggccagagtgagagtatttatatcacagaaattggcaaacactgcaaatcagaatcttttcccctgaagagcctgtttaccagcacaccactgggaatccagcaatgagcaactcagtccctccctttgaacttacattttggtgtgatggcgctccaggactgatcttagtgtcctcattgctgaggggcagctgctgggcagggcctgctttggtgatagaggttgtaaattgccctcaaatcacaggagctctccattccagcaagtgagttgttaccatgcaccaggaagagaggaaatgggacaaggaggaaattcagttaattgagagctgactttgccattgagtaaccctattcaggatgactcaggcatctgggaggaaaagcagcagtggtgtctgaggacagaccgtggacaaattaagtagcttggggcttgtggagttgtgatgtccaggacatgggtggctagagctgacataggcaacagtgggcatgacctgtccatatggattcaggacctgcatgagagagtagaggcagacggttgctcttgtacatcctgtgatctctggttggaagatggacatgtgcacatgttacatacagtggagggatgtgcggagtgtagcaggggaatggggtagggagaggggaacaattcatgcctctgaacctttgcacatgctgctccttctacccaggggagttaatgtgtgttttctccacccagaaggaatggcatgtgcaaaggctcagaggcatgaattattgagagttcagtctggctctggtgtcaggtgaatcaaaagtctgcagggcttgaaacagagtaggggaagcattgaaccttcctcaagtcaggaggcacagcatcatctgggtgccagcaaaggaaatctgacaaacctcacctgtcaggggccttgtgctgtgtggatcaccctgcttccctaaaaatctttgaggtttcttggtagtttcctgctgtccctgaagcttgctggtcttccagcccctgcatctgtggctggtggattctcaaaaaaaatccatgttaatatcaagcacaaaacttaattgggaagaggggtctcctgttctccccccattgctaattgataccagaaaagctgcttctgtccttcatttaggcagataattgagaacttgtttgcttaaaggcaactgattttgactttatgcctataggtgccagatatttttcatgcatcaattcatttaatttccatgccgatcctgcaagtacgtcctattttccgatcttatcgatgaggaaattgagtctcagagacttatccaagggcactgtgtttgtaagtggcaggatttgaacccggcaggccctgagatctttctgcagtcccgtgctcccctcctttatgcggttttccttttccctttgaggaggggagggagagattcatcacatgcctggaatctcagcacactttgcctttcttagttcggagttaatgtatgtttttttaattcagtgttggcaaggcccagtctggtcatagctgggtttgttaccttgtggctcaggggcaaggatgagaatagaattctggtacccacacgggctccctaggcctggtgtcaggaaagagctaatactaatggctcataattgcagagtggcaggcaccttggtagtgcatggctcgtgggagctttctcagttctcagctactccaagaggtggggtgcatcattatctctgttttgcctccattgaacttgcccagggttgagcaaccaagagttagaagcaccacattctgctcgccccggagtcctgcctctccactcttgtgtctttccttgagcagcgccaaccctcccagggcctggcccggctgtgcctttgacagcccctagcagcagtgcccatatgctatggaaaatggggaaggataattgaccacttggccacaggcccagggtctgcccacctcttggttagagccagcactgagctccctgccatggggttcatcttcccactggcctgttggttgagaggatggtctcagaccaggccccaacaccaccttcttgcagatacatccccagtccagggcagtgcaggtggtttgtgatggtgccagcccatgttggcatgttgggcccaagatgaggtggcatttctgagttttggaacccctctttctccttgagagcctggccccagagtgccctcctctctgtaaaagtcctggttctagtcgctggctgattggtatgcatcccagaatcccggccattagcatacaaggcgggagccagctctcattactcccctctcttcattgtttgaagtgggcagacttggagtgagctttggaaatgtgggctttttattcaatttccctagaaaaacaatggttaaattaagtaggaaaataacagtctcccgaaattgaagaaaaatattcctgaacctagacattacccacaacctttgaatttcttttaaaacaggcatttgttttactttaagttatacatgtatcgcatgaccactgaagaaaacacagagaaaatacagagagaagaaaatggaaatcattttgccacctgaagacagcctctctcaatattgtggtgcatatcattcatgtattcagtgattcatttactcatttggcaagtatctatttagggcccacaaagggagaggctgtgttgggttctgggagtagacgctgggagtagaggggtaccctgctccctgctggggctctttctatgttgggccttgggcaactcacttgacccttctcttatctgttttctcatctgtggaatagggataacactagtagctgtgtcataaggcatggagatttgacaagaaagggcaggtaggatgctcatgatattgcgtggcccaggtcaaagcttagtaatgttggcttttgtcatgtaggggaggaatatcttttcttctaccctgttaggttctgtgatagagcctatgaattaaactgacaaaagacagattaataggagaaaaggcatatagattttatttaatgttactatatatatgtatttttttactgtaaggggtctccatagaaaagaaatgaaaatccaaagaggcagttagacccaggagcttacgtaacattttaacaaagggcgataaattgtggagaagtgaggagacaaaagaaaagtattggactcttaggggtcagtaaatttcaggaaagtgactaggaaatgtatggtagataagggtggtttagtaaggtttgttatgcagataaagtaaggtagaggggtacacctttgcaaatggaaatttatgtcacctttacaaagggaaatgtgtgccctgcttttaggcagaaaaggggaggcaaagagctcttcctgtattggctgctgctcaagtaccttgagctcaaaataattctttttttttttttttttttttttttgagacagcatcttgctctgttgcccaggctggagtgcaatggtcttggctcactgcatcctctgcctcctgggttcaagcaattctccagcctcagcctcctgagtagatgggattacaggtgcgcaccaccacactcagctaatttttgtatttttagtagagacagggtttcaccatgttggccaggctggtcttgaactcctgacctcaaatgattctcctgcctcagcctcccaaagtgctgggactataggtgtgaaccaccacttctggccctgggatggcatattctgatccttttcagttacaacagtgagtaagctgacattaaccttgccctggtggttttgtttttgtttttgtttttgagatggagtgttgctctgtcaccccggctggagtgtgatggcatgatcttggctcactgcatcctctgcatcctgggttcgagcgattctccagcctcagcctcctgagtagatgggattacaggcgcctgccactatacctggctaagttttgtatttttagtagagatggggtttcactatgttggccaggctggtctcgaactcctgacctcaagtgattctcccacctcagcctcccaaagtgctgggattacaggtgtgagccacggtgcccagcctcgtgagtcttatatgatggtggaggagacaaaaatcaaacacatcaaatttataaagtaaccacatgttatgcattaagtcctgtgaaggaaacagactggtggatggtgataactggggatgaggggtagagagggtgtatgtgggggtgggggtacaggattcgttagctgcaggtggtcagggaggcctctctgaagagagacatttaagccagacctgaatgacaagcaggagctccccctgcaaggatctgagggaaaagtattccgggtaggagctacagcaaatgcaaaagccctgaggccagatgaacttggcctgtttaggagggtgtggaagaggccatgttagttaggactgttactctaggtgcaaaaggaaaccatcggaggtttgttttccacttcccataaatacctttactaatgaaatatagttccaagattccagctagtaaaaactctgttaagaaattcacctttttccaataatttattcaaaaataatttaccaagtgcctatgatgtggaagcacttgactcagtgctgtggggtgatggatgggtacaaagatatggtgaagttttacgctccaataacccatggtccagcaaacaagactacgaacatttgcagggtcaagggcagggagggactgatttacctttgcaaaagatcccatgtctgctgggaggagaactggctgtagagagccagggtggaggggtggagctgggaaccagaggaaaggcaaggaaaggttcccatttggcagtggaataggagaaaagtctggggtttgggttatatatcagctggaatcaactggaatttctggtggattgtacacaggggtgagggaaagagaagaactgagcatgacttctagattcttcttttgagtctctgagtgagtggtggtgtcatgaaaggagacggttaagagggagtgaggagcatggcttttggagaaaccaagggttaggtttggggcaggttcacattgaaaggctggttagaagtccaagggggtaggccgggcacagtggctcacgcctgtaatcccagcactttgggaggccaaggcgggaggatcacttgaggttgggagtttgagaccagcctgggcaacaaggtgaaaccccatctctactgaaaatacaaaaattagccaggtgtggtggcgggcgcctgtaatcccagctactcaggggctgaggcaggagaattgctcgaacccaggagggtggaggttgcagtgagctgagactgtgccattgcagtatagtgtgggcaacgagagtgaaactccatctcaaaaacgaaaaaaaaaaagccaaaaaaccccaaagaagtccaagggggtagtgagggcctctgggctggagatgcaaacttgggcatccttaacatataaaggggacaggtgtgaccacccagagagacaattcagaggagagatccctccacagggaggtgagctctgggagctcttatatttatagtctggtggaggaggaggagccagggcaggcagcctgggagctaggggaagatgggtgcaaggaacttacctttagtgccaggtgctgaactaaacacctggggaggatcggcccctggtcctcacgataagtctgtgaggtgcaggtgctattaagcgtctcaccttatcgaagcggaaagaggcccggaggtgacccagtgcacctgccagcaggtgcacgactgtgtagggagtgaggattcacaccaaggggggcagtccacctcgtttgcccacggcattcccgtgttgcagaggaggattccaaagcttgtggttttgttcatttgttttcatttgtctgtccttgcattcctctcctcccaacacatatttactaagcacctactgaatgctgtgcactgggcaaggaactggagattccaagatgagtaaggtgtggcgccccttaatctggtgagggaggtggatgggcaacagctgaagggtgggcggtgcctgatgcaggtggagggactccgaggaggcttcccaggggagtgtccaagccaagcagtggaaaaggcagagttaggtcaggaagcaggaggcatccaggcatgtgccaaggctcaggggagggaatagcagggccatgtcagggagggtgcaggagggtgctgctcaggagctctgtccattgtactaggggcttgtactttatcttgtgggccctgcgagccagtcaactgtttcaagctaggggatgacgggattagaactttttgtttggggtagagattgggctgcaagggacagaagagttaccagggagagctttcaaggctgttaaaaggctctcgattcctaggtcattctctgaaccctgctgcttccttactccttcccaaattctgctcatttttctcttccaaaaagatttccgagtcagagaggttaagcaacttgcctgaggtctcccagcgtgccaggtcatccaggctgggactggtcttctaactaaaacaaccacagtcccaggggtggaagcggatggtgagtaaccccagggagcggctcactggaggcttgagttgaaggtcaccgtccacagtccccgtgtggctttaaacattgcctttttgcagtctcagagaacagttggtgcttctgggcaggaggagctgggctgctgctgggagccagggctggggctttcccagagctgcacgggttatttaagcagtttcctgggcatctgcttcctccccaatgagtgatgggaaaactccatggggctggtgcaggatttgattaacaggtcacatgaggccagtgagggaggcagtccctgctgggaagggcagatgccaggcagagggcgaggggagggggagatggggagcacttcccagagccctgtgctatgagctctgtcactttgggcaggtgtctcacctctctgcagtcttggttccctcgcctgtagagataatatgaaatgtgaccaataggactgaagtaataaccagtgtccactgtaggcctgaagtgtgccaggtaccacgcatgatcttgtttcaatctatcttttttttttcttttgagatagaatctcactgtgtcacccggctgcagtgcagtggcatgttcttggctcactgcaacctctgcttcccgggttcaagtgattctcctgcctcagcctcccaagtagttgggactacaggtgcatgctaccacagctggctaattttcgttttttttttttttttttttttttttttttttagtagatacagggtttcaccatatcagccaggctggtctcaaactcctgacctccagtaatctgctcccctcagcctcccaaagtgctggggttacaggcgtgagccaccgtgtccagcctcttgtttcaatcccttgtcatcttgtgagctatggatggtcattatcttcattttatagatgacacagctaaggaacagaaagggtagatattttgtcccaggtcacacagctagtaaatggcagaatttgaacctgaccctctaactctggagccctcccctgaaatccctgtggtcccccttcaaactttgttcagctgagcatgagtcccttccttggcaaatcacttgataggatcctgtggggcactagcattctgcccacttgactttgggacaccccagtccctacaaccccttaagttttatcacgaagacttggagctccagtgggcctcagcccctggctcatcatctttcagccaagtggggcagacccgggaccagaaccccagcatcccagactcctggccttctgctcctttcactcctccagggcctcagagggggactggactgggagccagttgcctgggttctaatcccacttcttccttggaccagccagaagagcttgggcaacatttcactttgccccctgcctttaccctaagcctcagtttcctcttctgtgagatgggtagattgagaatctagaatctctaccaattctaataattcataagtgtaagatttcaggtttctatctaggaatctgtaagagtcaaacatttgccacctttttctacttcctgtcctctattgcctgtgggactcgaggagactgagatgaggaaacaattcagtgaaccctctatagtttgacacactgtagtttgagggtggtggctcatgcctgtaatcccagcactttgggaggctgaggtgggagtgtcgcttgagccctggagttcaagaccagcctgggcaacatagtgagaccccatctttaaaaaaaagccaaaaaacaaaaattagccaggcatgatggtgggcacctgtagtcccagctactcaggaggctgaggcggaaagatggcttgagcccaggaggttgaggctgcagtgagctatgatggcaccactgcactccagcctgggcagcagagtgagaccctgtctctaaaaaataaaaaatatatagcttaatagcagcgtatgatgacgactatcacttgagtaccactgggtgccaggcactgtgctggctgcatcatgaattatttttttgcctactcaacagggaggcgagtatgattagctccatgttaaatgtgagaactgagacacaaaacgtttagctaactttcccaagggtcaagtgattgcatgacctgtatatgaaagctggacttcaaagaccagaggaagtgcagaggatacgtttgctaggtgcttccttgtgggggtgggtacggcctctctacctcacgtcccatcacttggagctctctgcaaaacccgttctcccgggccctagatgcaaaaatccacccagttcatccgcccttgagaaatgatgttgagtcagatctggaaacactaaatgggtgagtcacagtgaggatggtgaggggctgggcagggaggaacagtgcttagcccaccattggccagagctcagccttgccaaggagcccagcccagggggcaggcctcagctatttacagagaaggggacttgggagcagagagaggatgcggctggcagggagggagacagaggagctgagggtcagacagcagagctagaagagttttcagggatcatctagtccacacataggacatctcagtcccagagaggggctgggacttaccctaggtcacacagcccatgatgccagacccagcaatagaaggggattttgggaggctgaatcctcagcctccctccctccctcctttccttccttccttttttttttttttttttttttgacagggtcttgctctgtcgcccaggctggaacacagtggcatgattacagctcactgcagccttgatttcctgggctcaggtgatccttcaacccacctcagcgtaccgagtaactggagctacaggcacatgccaacatgctaagctagtttttgcatttttttgtagagatggggttttgccacgttgcccaggctggtctcaaactcctgcgttcaagcggtctttctgccttggcctcccaaagtgcctggattagaggcatgagccactgtgcccgaccctggccactttcatgggcatgactttctgaccaggcactatgctgtttgccttctctttctccaatcaggagaacaagaacaaacagcaacaataataaaggaatcatcttgctaaatcctaagcatgtgtgttgccaatatgggtagactgtacccaagtcccacctcctcctcttcctaggtggatgactctgggcaaggcacgttactcctcttagcctccaagttcctttagctgcgtcatggtttaagcagattctgaaattgcagcacttctcagtgcctttaacatgtggagtattgttattctccagcagggagacttctgctgtggttttccattgttctttgagtattgaatgcttttttttttctcccaatgagcacctattgacatatttcagggcacagatgtttccccaaatatacagattgacaacactggtgtcagtggtttgtcaggactgtttaaactacttttttttttttttgagatagtcttgctctgtctcctaggttggagtgtaatggcatgatctcagctcattgcaacctctgcctcctggattaaatgctttcttagcctctcaagcagctgggattacaggtgcacaccaccatgcccagataactttgtatttttagtagagacggggtttctccatgttggtcaggctggtcttgaactcctgacctcaggtgatccacccaccttggcctcccaaagtgctgggattacaggtgtgaaccaccacgcctggcctgtttaagcttttaaactcagacactgtggactgattatggagttttgggggacacatctactgagctgtgacagtcaacccccctctggggtcaggagcaccataaccatgccccacctgcatctgttcttgcttctttctgtcgtgtcccttctaccctggagcacccattgctttacagcgggagccttcctgggaggaaggtcaggctcctgtaattggaaccaccctgcctttgtggggcaggaagactggctgagatgtcttgggcagcagcagctgccctacaaaggctcttcccagggacgctggctcacctgggagcatatttggaggcaaagaggatggcgagggagaagcagagactcccaattaggttagggcagcctgggagcacggggttgagcctgggagcacgggggtgggcctgggaacacagggatgagcctgggagcatggggggggcctggaaacacaggggggcctgggagcatatggggggcctgggagcattgggggaggctgggagcccggagaggggcctgggagcacagggggaggctgggagcacggaggtgagcctgggagcatagaggtgggcctgggagcatggcggcggggggggggcctgggagcacagggcgggcctgggagcacgggggtgggcctgggagcatgggggtaagcttggctctgtcattcacccttttatgaccttgggcaaggcacagtcctctctgggcctcagtttcctcatctgtgaaatgaaggcctgggcttagtgatttgttgattgccttcagggctgacgttctgtgaactgagtaatggaggaataggtacatttcgtaccttttggccacaccctggtttgctgggtttcttggggtccaccaaggcttgccccatcaggaacttttctctctcagaaggcgcagtgtgtgcgaaggtgctggagactggcaggtggcctaagcaccctgggaactgagagctagtaattctcatatgttaatgtgagccagggtcacccagacaagcctgctaagaaggcagattcttgggcctcatcccaagagactctagtattataggttggtatcaggagcttagcatctgcatttaaaagaagcctcccgttcactcaggtgactctgaagtcagtagttcaaggaccactttttgaaaaaggccgttagactctttgagccttaggaaaggctgggcacagcggcacttgcctatagtcccagctaatcaggaggctaacgcaggaggatcacttgagtccaggagtaagaggtgcaatatgctgtgattgtgcttgtgaatagctactgccctccagttcggacaacatagcaagactccatctcttaaaaaaaaaaaaaaaaaaagaaaatgtggccaagtgcagtggctcaggcctataatcccagcactttgggacactgaggtggatggatcacttgagatcaggagtttgagaccagcctgggcaacatggtgaaaccttgtctctactaaaaatacgaaaattagctgggtgtggtggcatgcacctgtaatcccagctactcaggaggctgaggcaggagaattgcttgaacccaggagggggaggttgcagtgaggcaagattgtgccattgcactccagcctgggtgacacagccagactccatctcaaaaaaaaaaaaacaaaaaaaaccaaaaaaaacaaaaagaaaatgcgtaggaacatgctaaccttttggggttggtgacgggctctgtgttggatgccctcacctgcagtatcagccttcaagagctagtgactcctcttcccacacactggtgtgtcccaaacctggctgattgtcagaattgccaggaagcttttgaacaaaataggaattcctgagcctcatccttagagattctgaagcagcagatctcggctgggaccgcggaatccccatgtttgaaaagcttctcaggtcttttgttaatttatcattcgttcgacaagtatgtctcgaggcctgtgatggaatggcctaggcccaggggaagatggcctaggtccggggaaggactcatgtaattgtaaggccagacacagtctcggacattatgtcacctgctctatggcttggtaaaggagacagacggtgattacatagggatgattggccaggctggggaaacacgtagcaaggaaatggttgggtcagactaaatacttggggtaaagctaggattcctgggttgctgagctccagtaaattccacactgaaatagagccctgggcacagtgtcctctgaccactacttacattctcctgtcatccatcgactcttcctccccaccatccacccactcgcccattcattcatctctccattcatttacccacccacccgtgcatccatctgtccatctgtccatctgtctacccgtttgtccattgtccatccatccatccattcactcatccattcatccatttatccatccatccatctatgcatccatccatccatccacccatccatccatccatccatccatccgcctgcccatccattcatccatttatctacccatccacctactcattcattcatctatccatccacccacccgcccatttattcacccactcatccacccatcatctcttgaatctcttcggcatgctaaggactgccctgggtattggagagacagaaatgaaaggcattattcttgccttcaaggaactcacagtctagtgggctgtcagaaaactaagcaaatgattccagtccagagtgttaggtgcccagagggacaagtggccagctgtctgtcccagtggtcatcatgggagactgctctgatgccagctgcatgtgctaagcaaagtgtatttgggagtggcccaggcagatgaggtggggaatggctttcaggccctggaagggtcttgcctttgggaaggcaggtcatcgtggctggggcaggtggggaccttttcctcttttgacactcaggttctctttggttttgcaagtggtcccacgaggtctgggcctcagtagatgcttagccaacatgagttgtcagtgaatggggagatgagtcagaaaggatgccctgtgaacctcactgaggagctgtggctctgtggggccacagatagggtccaggcaggggacaacactgtgccacaggctccctgggctgggcagggagaatggtggggagggctgaggggcccttccccagcttcctcggctttcagctcttttcttgtgtagattggagcctttgcattcatgaaagctgatgactcctttccaccagtgaatttcctgcaacccacagggcccggcctcagttggggtgtggggggagcagaatgatgtggggagagtggtggatgctgtggcagctaagagccttggcctccggaatcagactgcctgatgtgggagtcttacttctgccatttgtcagctgtgtgtcctggggcaagtgtctcaacctttctgtttcagttcagttattcagttggggataatatcagtccctatctcatatggctgttgggacgattaggagttatttctggtaaagcacttagtgcaatcctggtacatggtaagtatcgacacaaggcagcttcggtgtggagctttggaggcagccctgtcacaggggcgggacactagaaggggctgggtatttattagccttggagccagaagacctgcttggaatcccacccctacctctgactgattgtagagaccttggcaggctgattcaatgctctgagctcagatttgtcatctgtgaataggggaccgacaccccccagggccgctgggaggagtcactgggtctgatggctcattctctgcattgggcttatgattgaggtaggaaaactctaaacaggaggagtgaaatcttcatttgctagggtggcctggatggccatgcctgggggtcagtctgtggggtctgtagggccacctctcttggccctggccttttcccttagttgccctcactgttgcaggttcctaaggaaagggaccgtcatgtgactggggcccagggtcttcagaacaaggtgctacaggggcagagggtcaggctggtgccatttcatttgcaggagtgctggggagggtgactgtcctcctccagccacactgggtctgggtgcctgggagagactgaggtttctggtgcctgccctgggttcagcactcctgtccctccacacctcatgttcctgcttgatttgaattctcagggttgggtgactcaggcatgcctgatgccctgcaagatttggttcacaagcaggtaaatattaacccacacgcatagctccaaatgcaaacctgtttgggctggcttcttgggggacagctaggctccgagtgtccccctcttcccccagctgatggccaaggtaagcaggtgccctccaggggaacgaggtcacctgctttgtgccaggtgattgtactgaattcgcaccactgtccgggggcaggggctgctgtatctattttacagcagaggaggaaaccaagacatcaggaggaggccagctcggtttacacagttaatgagaaatgggcctatggctagaacccaggagtgcctccctgcaaagtccacactttccccacctggatctccagctgtctccttgctgttagggtcacaaggcaatgctatgtgtatcagaggcacctgaggtttgctttctggctccactttgcctgggcctcaaatgccccttttgtgaagtggggccaggctggtttggggtccctgataggcaggaaccagcccaggacacttgagtgcagtaatggggcctgggcttggatttgggagtaaccacctggccagccaaacaacgatcttttttttgagacggagtttcactcttgttgcccaggctggagtacaatggcgcaatctcggctcaccacaacctctgccttctgggttcaatagattttcctgcttcagcctcctgaatagctgggattacaggcatgcaccaccacacccagctaattttgtatttttagtagaggtggggtttctccatgttggtcaggctggtctcgaactcctgatctcaggtgatctgcccaccttggcctcccaaagtgctgggattacaggtgtgagccactgcgcctggccctcaagcatctcttgaagacctgccaggaggcactgtggggacacccagggaggagccacagtttctgtcctctgggagctgacacgtgagcaagagtgagaacacaggtttaggggctccaggactgggtttgaatcttgggtcttagtagctgtgtggtcttgggcaggtgcctttgccttgctcagcctttggggctccctccaaagatgggaataacaagccttacttcagagtgcattgtgaggctaaagtgagatggtgtctgcaaagctcccagcacgtagtaggtgctcagtaaggtggtttcccctgcccagaacctcagatgactgtcttctaagtctgagagcaaccagtgggcctcaaaggcgattgagggctgcttcccctgccctgcacctcccccccgccccgtcatgctggcagcccgggagcagtctctcacggttctgtgggcagctggagatggggcagaagcgggcgtcagctccacagtgggggcactgggaggtggggccaggcttgactgggaggagagggagatgctggcttttccttggtcctgccccccgcagccttgcagtcagaggcagccccaatgagccctctgcagttctgagtgccttcctctcctgtctcgcagagggggagcctcacaaaccctgacagcagaagtgacttgcccagcgtcgatgggcgctggtggcagagccaggctgacccccagcctgaggcccacccgatcccgatgctgcactcctagctccttggcgtaggtccctggggctgtcgggtgccctggcctccctggcctgccctggagccagctatgaaggaatattctggggcacatgactcacaaggctggcccttccactttttgttttcctttcttttacttttccctaatacggtctcctgtggcccttgcttctcctttcttggggctctgagatggcagtgccttttgccctggaaagcctgtcctggcagagctcctgttagctgtcgaccacagctgctcaatcgggaaggttccaagggaggccgagcaaaggcatcagagctgcacagacctgggccatagcttggctgacctactccctagctatgtgaccttggacaagtcgctttgcctctctcagcctcagttttcagattcagttcaatccaaccaacatttattgaagacttgttagtgcccagtatgatattagccattgcaggtggagcagctcccctgggaacctcaagattgagtcggggttgggtgtagtggctcacacctgtaatcccagcactttgggaggctgaagtgggtgcatcacttgatcctaggacttggagaccagcctgggcagcatgatgagaccccgtctctacgaaaaaatacaaaaaattggctgggcgtggtggcgtacacctgtagtcctagctactcaggaggctgaagtgggaggatcatttgagcctgggtagtagaggctgcagtgaaccataatagtgccactgcactccagcctgtgcaacagagtgagaccttgtctcaaacaaacaaacaaaaagagtggggagtcaagtggggccctggatatccacctcatagcgttgtgaggatcacgtgaaataacacataaagcactgcatatggttcctggttttagtagagtctcagaaatgacagtgagcattcatttattcctggctagtgagagcagtgctgagatttcaggtgaatcattgtcactttgatttcatacttgttagcaggaaagtgcggaggctgcttctgctggtactgtgttgattttttgtatacattggcgaggtgagctagtccctggttgtgagctgaggctgccatgttcccatgtgtgcccagacctttgaaggaggaagcgcagcccatgtggtgccctgtcctagggcagtccactcctggcccatgctgggcacccaagaggtgtttgttgaactaataggagaggcagtggcaagctggggcacatcctagcagtgtgattgacgtgggagccgggggtctgggagccacagcaggcggccatgggaccatctgaccagggcaagaggggccctgggataggagcggaagttgaggactggcctgtgcaggaggagaggcctcattctgagaaactcgaggatgaggggagggctggatgcggggaggaggcagatttagactcttctcctgggggacgatgaatcttctgccaaaggaagaatttcaatatgggggtatgatgtgggtcagtgattcgggcttagagtggggggcatttatggaatacccacactgggccaggcacagggctaggatcagtaagctttgtcagagagcccttttctttttttttttttttgagacagggtctcgttccattgcccagggtggagcgcagtggcgccatcttggctcactgcaccctcgacctcccaggctcaagtgatcctcccactttagcctcctgagtagctgggactacaggcgtgtaccaccatgcctggctaatttttgtattttttgtagacatggggtttccccatgttgcccgggatggtcttgaactcctgagctcaaggaatctgcctgtctcggcctcccaaagtgctggagttacaggcatgagccactgtgcccaggccctttttcttttctgtttgttcactgatgtgtcccaagtactcagaacaggacttggctcatggaggtgcttaataaatgtgggttgaatgaatgaatggttggatgaatgaatgaatattacctaattgggtctcaggagtgtcatgacacccagtttgcagatgaataaactgaggcttagggaggttaagttgcacatttgctaggttgtggagctgggatttggagtccccactgtctgactccagagccggtgcacagacccacccatctattaggatcctcaaggaggaattctttctgtggctgacaggttggatttcaacctctcaaagacccctccgtcgtctgagagcgtctgattgtgggaagaaacaaaatgacccagacaacagctgggtcagtgctgcaagtgacagcagatggctcctgccactaactcctgttctgatcagtgggtgccctttcaaggagccaggttgggagagagatggatgctgccagccccaaggaggcccttccaggcttggtctgacatcatcgttatcctcagccacagagcgggagggtgctggctctggcacagctggcacatagtgcttgctctggcctgcacagtggggcccgtgtctcaggtcacccctgcctgggtgcatctccagggtggtggctagatggcctgggtgaatcccaggtgttcacggggacatgtgcctgccctcagcccccaggtggttctggaccagaatgcccaggagcttagggctgggacccagagagacttggaggggggctgctttgagaggctctgttaggggcagtgccgctgcaacacttcaggggggccactggtcttgggcacttgatctgagtcccccaagttctcctcctgatgtgctgtcccactggggccctgtcctacttgctcccatgggtggaggcttcatggtcccacctgagtgtaccccagcagcacaggagcccagctgactggtggctggctcgtggctgaggttttaacctgtaaatactgtaggggctcaagacacaggctctgcagccacgtggcctgggttcaaaggccagcgctctcatttattgactatgtgacctcgagcaattttctgaacctctctatgcctctatttcctaacctgtaaaagggaatgagagtggcccctgtctcagagggtttttaggaggaaattataggagctgtaggagtaaagggcttggattagcactgggcccttagcacgcagttaacacgtgttcggtgtctgatgttgattttggcactgacattgggcaacccaaggagccactgcatttctgctgtgccctgtggctggcacctggattccacttcctcagtaatgcttgtcatgaatgggccaggtcagcagggacaagaagagcaaaggcagcacccgggcacttcactcccacccaaggccccattcgggcagctgtaacgaaatgccgtgactcttaccagcaacaggcagttatttctcaaagttctgaaggctggaagcccatgatcaaggcaacagcagattcggtgtctggtgagggcctgttccttatagatggtaccttctcactgtgtccctgcgtggtgggagggcctagccggggccttgtttacaaggatactaatcccattcacgagggctctaccctcatgacctgattacctccccaaagccccactgcctaatccatcaccttgggggtgaggtttccgcataggaattttagggggataaaaacatgcaaatactgtggggctcaaggcacaggccctggaagccctcatttctaccttcttcccttctccctcctgcttaacatttgctccttgctgctgcatcccaggcattgcagacgaactatccatgcttttggtcaccctttcaaggagcactaactggtggacggcccccctccaactcctcattgcctgaatctaggctcaagtctgctctcaggagtttctgcagcccccaggtctcccgaagggaagcccagctgctattgtcaacactgttcagttctccttccccttctggaccgccagtggctgtgtctttctcaccacagcaggggatacttgatgaatatgcatagagggttgagccatgcgctaggctccgggacacagggcaggagggtgcagctcctggcctcggagagctcggcagtctggttgtttatttactaactcgggtaccaggaccgtggctgggcactgaggacatggagaggcaaaagatgcagtcccaccttaaagaggcggctgtacatattccccctccctccctggctgcctcctctccccacctcctgtattgcggatgctgggccaggtggtgcagatacagacacaagtaggtcgtggtctctgcccccacagtctagcggggagaggcacaaaaacaagtactgtagcagaatgcagtttctttagatacttgtagcctggtgtttgtctgccatggaaaccagtggcaatggctttggtctttgtattcctgtgactagtaatggtgacacaaccctgcattaacaggccagcgtctgctatagatccccagaggacttcaccaatgccctctgatccgggtttcccaacctcgatccattgacatttgggctggatcattctttgtgttggggctgtcctgtgccctaaaggatgtttagcggcttccctggcttccacccaccagatgccagtagtgtcccccctccccacctagtgtggcaaccaaagtgtctactgccattgccaaatgtcccttgggggacacaacagcccctggttgagaaccatggcctcccatagatctgtaaagctgtaactataaatcaaggtgggatggaaattttgaaatccaatactgtctccctccccaacatcccatgtaccttgggagcatcagtgatctggtttggcataaaacacaaacatcttctgggatgtggaggggcccttggaggctgtgcaccttgcccaggccacagagaagcagggcccctggcggaatgaactggatcattgccaggtgttcatgtgccctgttctgtgtggatgcagtgttgggccggtcatcacatggccacatggagtatgcagggccagtatcagacctgggagagttgagtccagatgttcaactgtcctcttgaatctcagttcagccccggtattctccttcacctcacagcacctatgaccaggggaccaagtgctcatcagcaaaccccataacctcgagtgcttcctggggcacaataaagatttgctgaatgagcaagggggggttgttggatggcagagggatgccaagggatgcagactggcttttctgtcaccctctcgaatgccgttgaacttaaaagtccccagagtgagggagcggggtctggagaccttggctctgacaaagcacgtgtggaagatgtgactgccatcactctcttcctgctttgcaccctgatctggaagcagatggtgtccccgtgtccctgtcctctgacaaagaactgggccacaggacgaccttggatagacctggcaaaggctcagtgttggcaggcagtgtccaggtggccatccgtgcatccgcccctccagctagcatttttgggcacctgttatgcttgctggcagtctgcaagaagcgagcccttgatcccaccttcccaggccactggcctctttctgctggttacttgggatgctcctgtgtcaagtgacattggggacatgctggtggatcattgaaggtttgctgcctggaggggtttgctgtccctaaattgagcagaattttttttttgagatgtagtctcactctgtcgcccaggctggagtacaatggcgcgatctcggctcactgtaatcttcgcctcccaggttcaagcgatgctcctgcttcagcctcttgagtagctgggattacaggcatgtgccaccatgcccagctccttttttgtatttttagtagagacagggttttaccatgttggtcagactggtctcaaactcctgacctcaagtgatccacctgtcttggcctcccaaagtgctgggattacaggcgtgaaccactgtgaccagcctagcagaatattttttgagatccagtcaggaagtggaacctgagttcccggggctgattctccagccggcgtgctttgcttgaagggtccatgtctgcagatggctccaagctggccctgtgctgactatgcggatgcagggaattggaatgtctctttggcaccatgcacagagcttggtcattgctgcatttcgcaccaactaaggcaactctggccttgctgtctcatttttggatcctcccccttcctgtccttgaccctcttccctggaatcttgactttaaaagaggaaggggctgggtgcaggcttttgggtgctcagcactgggccaagctgatggcttcctgtagcacttcagtgagggcaggtactgcatggtcagatgctgctagaggggctgcctcctaagccttgccttcaccatccaggcaggcagtgccttcctggagggcagtgacggggagctctgggacccttcagctctagcctgggacaccaccccttcttgtaggccggtgctgctgttcatttagcaggaggcagtcatttattcattcaacaaacatttattgagcacttactgtgttccaggctctcagtgaagcactttctgagaattattatctcatttaatcattagaacagccctgtgcatggtgattcttatagttgtcattgtatggaagaggaaaccagggatcggagcagtggatggcatctgtgtcacagctggcctcagctgggatcgagcacagagctcagtctcctaaaaatccctacccagggcatgatggtgacatggcaaaaaggggaacctggggggcacactggcaggaccagagattgcttcagagcagaaatgacctggagtagagtggtcccatttttcactgggcaagcagtggtgtctctgcctgcaggatgtcggggggtgcttgaagctcattacacccagtgtggcttccatgccaaggcagaaggaatactagggggagtttaggaccaggctgtgggcggcatccgcattgtctggttcctcgtaagtcgcaccacagggttggtcagcagcagttcagctcttgttaaagctgatagggaaagaggacgggtgtttgggaacagttctcttgggggatcctggtcccggatttgacttcaactcaggacaacaggactcagggcaaatccttttaatgattgaagccatccctccctgctctccctcccccaacacctccagcccagtcttccctgtccccttcccacagccccagtccgcatcttctcagattgtgaagttaattgcaagggagtgggatggacccattggcctgatcctgatggatctttccagtcacagctgaaagaccttgggtctaatcatggatccacctttgatcagattcttggctttgaacaaatctctctccctctctgagcctcagtttcctcctctgtaaaacagggtcaggtacctgccattcgtgggttggctctgcccctggaggaactggtgggaggattaggggaggcaccaggcatcccctggcctggagcagtgctcagagccaactcccgccagaggtgccccagaacagctggaactgcactcacacccttatctggggaggacagcacatcactgaggggtgtggtttgaatcataagtgctggctgctctgaattcagccagagctatcctgggctgtgtggctgagggcccccgggggtcctggggctccatgctgggcttgcatttcaggagacctcagatgctgctggcctgcttgccctgccgttgttgggtgggttgagctgtttttagctctaagctttgcaaaggctgtttctttcctgcccagagctccctcgtgggacagagtgaacaggcccctccctgccagacagagattgggcctgaagaaagagcttggagccagatgggaccctgtgggctttgaaagggaggcctggtttgctctctgtggcctgccaacctgggacaccggtgcccagccttgctccttccctgggaaactgaatagacgccagggtctcacacctgccccgtgggaaaggctggggtatgtgcctgcctggtgacggtggcagccgcggaggctcgcggatcctgtcccctttgccggccacatgcttctgactcatcagaggaagaatgtggtctttttgggagagagtttttaaaaatagtccaagtcctcctctggccctgtcccactcctccccttctgaccatttcctggcatcagccccagacctctttccactctggttttggggaactgcccctttgcaacttggctgtgaatctgtttgtgaaccttactggggaggagctgtcctgggtgcaggctggtttcagaagggaggggcccagctgtggccgcctcctccccaggggcccgacttgggacgagggatttctgcattcctttggcaactgtgccttgggtcgcctgtgtgtcaggcctgtgccatgggtgcagataagagcggtgaacagtggtcacagtcctgccttcatggagtccacattctcataggaggaaactgataaataactaaaatttgtagttgccagaggtgttaaatcctgtgaggatggggacactgggtcagggcatgtgtgtgggctgtcaggagaaggcctctgatacagcgaccttggagcagagccctgaaggtgagggcagcagtgtgtgggtatctgggggaacagcatttcaggcagtgggaacagcaagtgcaaaggccctgaggcagaaacatgcttggggcattcagggagctggaaggtggtggtgactagagtgagctgtgtggagagaggtaggacatgaagtcgggggggttgtgggggctctgacacgtggggcctcagagatcaagatgagggcttgggtcttccttaaatgaggtgagaaaacattccaggctctgagcggaggatgaacttggccgctgtgctgagaacaacatgtcagggcaggggtagaggtgagagcagagggactggtcaggaggcgttttgaatagcccaggtgagagatgatggtggtttgggccatggtggtactgtggagggggtgagatgcgctcggattctgggcgtatgttgaaggtagagccagcaggtttgctgaagggtgggccctgggtgtgagacagaggtgtcaaggatgactccaaggttttggccttagcagctggtgggatggtgctagcaagcgggatgggaagactgggaggagcagggttctttgttctggcagcatggtgatcaggaggtgggtatgggcacgttaaggctgagatgcccgatcaatcactgagtgaagacacagagcaggcagaggggcagagcctggagttcaagggcaggacaggctggaggcatcactatggccatggcttaggacccacgaagtgagccaggtgacccaggtggcccagggaggagccgcggtgtagcctgaacctgggaactgccaacctggagggaggaaggaggagcggaggaaggggagctggagcgagacgtgaaagaagggagcagctggcaggtcaggcagaatggggaccgagatgctcctctctccccatcctggtccatcagaaccggtgtagtggaggccgcaggtgacctcgtgagctggctggcaaagcggtgggcacacacttggttgggaataggtagctcagcacagaataggagacagggacaggagacggagcatgggcactcctcggggaagtcttgtaaaggggagcagagaaatggggtagtgggtggagagggtatgggatcagatgagcagtaatgcagcgtatttattcatttatttattatgacttttttgagatggagtcttgttctgtcaccccagctggagtgcagtagtgcgatcttggctcactgcaacctctgcctcctgggttcaagtgattctcctgcctcagcctcccgagtaactgggattacaggtgcccgtcaccactcccggctaatttttgtatttttagtagagatagggtttcaccaccttgaccaggctggtcttggacctctgagctcaagtgatccaccagccttggcctcccaaagtgctgggattataggcatgaaccaccatgtctggccacatatttctatttgctgggaaggatccagtagagaggagctgcgtctcttggtggcctcggcttctaccctagaaagacgtccttgtaccatgcaaaagactcctcccttccctccttaccccatctcatttctggcatcagctcagaggccagtttgggggggctcctccagttgcccatctgcagacctgtggaccagtgatgggatgggcaggggacccctgcaggtaattccgctcagaaaggcaggggccatggatgggcagcaattctgagatccagctgtgcgcaaccatctccctgacccagcccgaattctttgcttgcgggggtcagtccacccgatgtgggagggtgcggcctgggagagaccaccagggcaccggcagaggagaacgccttgtactgggtccattttgggagcccgggacgccctcctcagccccctgctccatggggccttgtgggaatatcagggtagaaaactctgcaggcatggagagtttagctgtgggttagctcccacctgtgaccgatggagagcgtggtgcgggccccttcctgctgtccctctgttgtgctttaggtgagttcctgcccagggctgggccaagtttattaccttacttcttcctcatctgaactggagagagcctcacctccttgcacactccccccttttacttacaaagctaagtgagtctaagaagcctaagccagtggtggagccaggatcagaacacgcctgatcccctagcccctgccctggctctgatctggaagtggggcactgtgccctcccctgccttgggtatgtacccgctggcctcctgtggctgctgcctgaggacaggaacccggaactctcttttgtttctttgtccccagtgccaagctggggcctggcaggcagtaggtgcgcagtgagaagttggctgagtggggaaggatgagtggcttactttgtgaaaggtggaggaggtgagcctgacccctggaggtgaggagggtgaactggggtcacagattccccaaaggttgtacctcagcttggccccctggaggctttagttcagccctgaggtgtagcaggagcaacgctgcccctccctttggctccaccctgatgcctggggagtggtagacacccctgtgtgtgcccccaaatcctactgtttcccttggcagtgcccctccgtgagctccagctctttcctgccattcttccgtctgtacacctgctgggttgcagggacgcacatggacctccctttccctgcctgcctcatcctcctggggggctttgggtaggtcccttcccatctgagcctcagcttccctgtgtctaaaaaggaggtgaggaaacccacctctcaggctgcctgcagcctaaacacactctcatgctaagtggcgagggcccagcagcgaggacgcccagcagctgggaggcgggcatccctgttgtaggtggggaagctgaggctctgatgggcgagttgatggcacacagtatgtgtcatgccagctgctgtcccctctctggcttccaggtgggagccacggtgccccatcacagggacacccctgatgtggggctgagggtctggggttctctggagaagaggggggtcagttcagctgatggcaggtggcttcctccggcacttcagcttcttcactccttctgctgggctggatcgccggggacaaaggggttaatgtgtctgggggctgggagggaaggaggaagagcaggaggaggaggtagaggaggggggctggagatagagtctggggccgcccccctcccacgctgtccagccacttctccaggctggctctggtttcccaggcaacagcccccaggggtcccctctggcctggcctcagggtcggctccttcccacagagacctactcccagggccccctccccagtgctccccactcttcctgcctgcagatcctcaccaggggctccctaggaggtcagtgcgggagggtgggtgccaccgactctgggctcaggacagagtctccattgtctgaggctccagccattgaccaaacttggcccctgccccagtgaggcaggcccccttctcagagctcccctccccctccctggtgaagaggaaaggaagttggagccgcccccacctcgggaagccctttgagtgtccatcaggtcggtgagggaggagctggggtgtgtggtcccttgccagattctgcagctctggcacctgcagggttgaggagggtctgggaggacgctccctgacccacccactcccctactcccccttccaccctgggcctgggaccaggctgagggtcctgccctcttgctcccaggggctccgtagctgtgtggccttggggatgcccctcagtctctgtcagcctcattttcctcatctgctatgggaatcaaatgagatgcaaactaaaatgttcagtatggggcccggtgcagacagtgctcggaggtgtcagctattgtcatttcaaattttgtgatctcaggcctggtgttccggtggaatacgtttgtcttggacttagtttagcagtctgtaaaatgagaaaatgctgttggtcctcagggactggcaggaaccgtgggaaggaaactgacattcattacaaacctaccagtgttgtccaatgtcatcttatttacacctgcacctgacaggtaagcacaggaggcgcagagggctgcctgcttcggagtggggctgctggagagcagaggatgagtgttgtctgggctggcttcataccaaggccgggttcctgtccacacacctcatccttctcttctgcctgcgcccctcctgctatagctctgcctgtgttttcttgaaggcagctcctctctccccatcccggactctccaccaggtggccctttgcgctgagaagagctgtgggcatcttgctgccctgcgtgggggagccgtgggccctcttctctgtcaggagaccccgccccacttcctgttccagctccattgtgtggtttgcatccccttctcttccttccgggccccgggctttcaggacaggcagaggacaccaggagggcttgtacctcaccttccatctgttctcccctcctctgggccgaagccccacacaagcagctccccaggtccagggatgtcccagcctcatgggttcctggtctgtgccctttggttccatgctgggtgggtcccaagcaggggaaggtctcagctgttgtctagtgtgtaccccgggccagacccagtgctacccatgctgagatggaaagaagcccagtgcccccagagaggtcacaggctcttggggagggcaacagttataatggggctgtgtctgcaggcatgtacctgtcccagcaccacccatgctctttgaaaacagcctgttggccccctatcagctgcacctctgagccactgaatcagaatctctgggtgtgggcctgggacataaatatttttaaaaagcttcacaactggaaaccactgtgtgaaatgggtctaaggaagctttgcagaggagaaatggggtctggttttgatgactgaacaggaatttgcttgctggttgtgagagagaattccatgtggagggaacagacagcttaagcaaaggcctggagatgtcaaacaggtcaggtggcatggtcatggggctgaaagccattcgtgagagccagagcagagttccaggccaggcccggagccgatgagatccgagaggtcggtggagggggcgaatcttggagggccttgcttaggacccaggctccattctgacagtgatggggaagggtttgaagcaataaggtgatgtgacaggtgtgtttgcggagtgtctctgtggcagcggaggtggcaggtgggttggcctagcgtgtgtctaatgagagttgaaagccagagagacctctcagagaacacaggtacgtggaggagttctggtcctgaccagcccaagcacctggtctttccccccattccccaccttctttctgcttcaggaggtgggccctgcagagggcctctgaggccagagcttgacaagcgtgcttgggccagaaccgattccttgcttctctctgggcagggctgggtggccgctgcccagctcatcccagcagtccagctgctgcttcccccgcttctgcctggaccttgttagagaaagaggccggcctttcctgtcctcaaggcacgacttgcgcagccttccagactttcagggcccccaagtgttttcttcctccaggcctcattcaggtggaagagggatggggcagcttgatgtgtgaggggtgggagatggtcttggggggcccggggtgggacaggggcaggcaggaggagggtttcctagtggggcctctgggcagatggactttgaaccctagtgggaggggaactaataagcactgactaaattagccaagccaggaagacacctgctgtgatgagctgggcagctgagggcagagggaggtgccaatgccgggctgctctgggtggtcccgtcgctgagcctaacctgctccgggcctctggtgggcacaccccatagccgggagctggggcctcccctcttcctcccttgtctgagcactgcctcctcctcagccattccacgcagtagcaggaaggggaactgttcagtgtccgcctgttccttgggtttggtggtcattgttaaaaaggtgacctccaagagaaaacaatctcctataaccccaccacccaagcatagcctggatagggtccccatggtaacagaggcccctgtctacccagagcttactccgtgcagggcatggagcgtagaattcatcacacccactgctgggtcctcatttcatcagcacaggacgctcaggaagcaggtgctggtcttactcccaccgccccagtgagaaaggaattcactgctgctgtggcaagtggcagagctgggatttgaacctgaatcatcccggcaccaaatcctatcctctaaacgtggccttcggtgtcaccgcctggagagtcaccgtgctgtgggcagtgccctcctcctttggactcagtttccacatctgtaaagcaagagcaacactgccctcttggagctactttctggttctgacatgccatgcttttgtattagttctctttttaaagatgagaatggttattgtttatttatttatttatttttgagacagtcttgctctgtcgcctaggctggagtggcagtggtgtgatcttggctcactgcaacatccacctcccaggttcaagtgattctcctgcttcagcttctcgagtagctgggactacaggcatgtgccaccacggctggctaattttttgtatttttagtagagatggggtttcaccatgttggccaggctggtttcgaactcctgacctcaagtgatctgcctgccccggcctcccaaagtgctgggattacaggcatgagccaccatgactggcctgaagtgggtactttttaatccccattttgcagatgagtaaactgaggcccagagataggattaactcatccaaggtctcatagctgctgagtggaacccaggtggtattggggaacctgaactcttttctaaccccgtgaggatctgtggtggtggcagggggctgctgtgagccatccccactcccttgtccacatccttctgagactaacagcctgtgtgtgcaaaatggtggccacaggcctatgggtatgggcagggcttgctgggctgcgtcctcgtcccgacacttcagagccccgcattagcctgtagcaaacaccttccagattccagccccaaaggctagggaggcagtgcgatcagaggattgagattaggctttagggtcagtgctcactggctggaatcctagtgtggtcaccttgtcctcttgcttctgtgacctggggcaaatatttgcttctctgagcctctgtttcctcatccgtaagctggggtgttacgagaattagatagaataatgctaataaagtgtcaggctccatacatgttggtgtctctcttcctttctagggaaagccttgggctttggaggggagggcaggaatcagtcccaaagggtgaagaaaggggaggacattggactttctgccctggaagggaaggatcctgggttttggccccagggtagagtagcagcctctttctgtatcatcatcaaattgtatttaaggagcaatttggacaggaggctgggcaaagtgcctccctttttccttctgtaaaatgggtataggtctttctgctgcttccctcctggaactcttggggcagcagagccctcagagaaaggctgagcagacctcagaggttttgaatgagcccactgggagggggccctgtagcaggagtgccgtgcagctacaggtttgttttccaaaatcctttgctgaagtaaaagtttagtcctgagagttttcagcgtgggtctaaaaggcacagtcacacgcttagcagagagtaactggtatcatcagtcacagtgagaaatgcaggcaggtgtcagggttcacatctgtgatcccagcacttgttgaggtcaacaagggaggatggcttgagcccaggagtttgggaccagcctgggcaacagagtaagaccctatctctagaaaaaattttaaaaaattagccaggcatggtggtgtgtgcctgtagtcccagctactggggaggctgaggcgagaggatcacttgacccaggagttccaggctacagtgagccatgattgtgccactgcactccaacctgggaaatcgagaccaaagcagcctcagtacctatcgatgggggctatataaattatacccccacaaaaaacacctacctcaaaacaaaaccaaacctactatgcagctgttaaaaaaagtggggttgatttctatgtattagtactattctgaaatcatcactgagatttaggttaaaaaggcagttgcagcactgtgagtgctgtgtgctccttctgtatgaaacaaggcatatctgcagatatgcaagttggcccatgcatgggagagttctggaaggattcttgagaagtcagtaacagtcatctcttctgggggactgggggattagggcaaccagggtgggaggttgactaacttttttttttttaattttttgagacagagtcttgctctgtttcccagactggagtgcggtggcacggtcttggctcactgcaacctccgcctcccacgttcaagtgattctcctgcctcagcctactgagtagctgggattaaaggcatgtgccaccatgcccagctaatttttgtatttttagtagagatggagtttcaccacgttggccaggctggtctcgaactcctgacctgaagtgatccgcccacctcagcctcccaaagtgctgagatacaggcgtgagacactgtgcccggctcggagactaacttttcattgtctacctgttgtatcgtttgagtcttgaaaggtgctagagtgtagtagctgcttctaagcacagactccagagccccatggcctgggttcgaaccctggctcttcctagctgtgtgatcttgggcaagttacttaaccattcttggtctcattttctcatttataatttggaataatagacgttaatatttgtaaagtgcttaaaattatgtctgaggtatcgttggcaatgcaagaatgtctactgttactaatattgccattaacctgcatttcatttttgtttagtaagccagtttaataaaaataaagcctttaggaatggaaaggaaaacaggaacacagccggtttgtggcctgggcagattagaccagggggctgggtgctttccctccagggtgcattctctcctccacaagatgtctaggaggacagcccccagtgcacaattgaaggtgacagtagggagcgggggcagggttggctccagggcccaggaagcccaccggaggcatcagccttttgcttatgtgagctcccactgtgaggggagggcggtgccaccttgggccaggaggaactgtgcccccacgctgagcatttgggattctgtccctgtcttatgccattggcctctggagccattgctttcctcacacccatgtgccaaggccaggttacctcctgcctgctggtcaacccatggggcaggacaggaagaggcagagtcagagtggccttcagcagggctaccggaagggactgacaggagtgggcagacctaagggagcccatgcttcctgggcagccaggaggaggaagtatccagccccatttgtgacagtcaggtgtgatctgattcctggaaggttgggggctgagcatgatcctggactctggggccagatttcacctgtaagccagaggggatgaggacggacacccagcaggtccctgcaggtcccttggcactggcaacaggaaggtctgtggctgcagggttttctgggaagaaggatttgggctgcacagctgctgatgtttctatgggttaatgatttatgaaggctggaggctggggcctttctggggctgccctgtgctctgagagccactgggctgaagcacaggttgtgagccagtgacttgtctcagtagctgaaactgcagccctgactccagctaatgcgatttctggtcttctttccacaggtgtgtagctgggacggtgctggtctgagctggaccttgtctgatggcttcctccaaccctcctccacagcctgccataggtaccgtacccagggcttcctgtccctctcatcctttcttagaagggggccgctgggggccggcggagggccttgctctggagcagcatggcgccgggtgggaagtctgctctgctggctgctggccctgcctgggccgcatcctctatctcacgttccttgtctacaaaatagaagtaactttctgctcacggaggaggctctgagcaagggtcaatccttttcctgtctccctgagatccgccggagaggtgaacacacgggggtctcaggctgaagcttataaatcaggggtgaggaactgaggttggaggagagggttgcgccatagggtcaggccgttgaacagtggtagcattgccgcatttagtgaaaaaaagagaaagtaaaagaaaaatacagccaggcatggtgtctcatgcctgtaatcccagcactttgggaggccgaggcgggcagatcacttgaggtcacgagttcgggaccagcctggccaacatggtgaaatcccatctctacaaaaatacaaaaattagctgggtatggtgtggcacttgtaatctcagctacttgagaggctgaggcaggagaattgcttgaacctgggagatggaggttgcagtgagccaagatcacaccactgcactccagcctgggtgacagagcaagactgtctcaaaaaaaaaaaaaaaaaaaaaaagaaaagagaaaaagaaaaatacatacttatactaacaaaattattcgtcgtttatctgaaattcaagtctgtgtcctgtatgttatttggcaaccctggcactggggcctcagacactgcaggtggaatccaggccccgcctgggaggaaatgggcccagggctgtttcacccaggcagcagcttcctgtcctcttgtatcactatgagagaggcagaattgcagatggtaatgagtgagggctttgtcctcagccccatctgagtttgaatcctgaccctgccacttagactgtggggctggttaagtgacatgttgtctctgtggcttagtttcatcatcagtaaacatggggacaatgataccctctcctgggctgttgcaaggtttaaatatatgtcaggcgtgggcatggggtaatcaattgctcactgacgggagtgcttatcatcgtgggtgtcagcaggacagacagcgtgtgccatgccctgcacccctgggagagccaaatgatgcatctcctcctccctgagcctcggggttcttcttgggcggggggtggggagcagcacagcagacctgtcttccctgtggcaatgggtggcttcctagggtccctcgcctcctggactcgcttgtattttctcacaaggaccgggtctgtccaggaacatcagaggcatgagtgaccagctctggctgtgccacctttgcaggctattaggaagggcttccttcagctctcagctgtgctgggatgggcctcctgagttttccttctgataaggagcaatgcctgattgccggggggaggatagaaggcggccttggagacaagcacatctcacctcccaattcatgactgggatttgggtcccagcatgcctggccttgccccatcccgcccctgctgccatgggcacctgttccctttcctctccccaccaagaggcctgaacctgaacatggggagtgagaaaaaaaaatttatgactaagtcaattctgttctgttcagcaaacatttgacaaatatttgttgttccagctctttctaatattgctggctagtatcatctgggtgaacccagctctttgccattttctcattctctgagagcttcccattaccttcccaaattaaattcaaattcctgagtaggggattccccacgcaccttgtcaactgtctaatgaccttcattcctgcgcgtgtcttcagcacccccggggcacttggtgtttgttctctgtctttgctgtggcctctgcctggaatccacgctttagttggagcttgtcaggccttttctcatcctttaaggctcagtgcgagggcagcctcatcctcggagcccttcctgaagccccagagagccccagccccttcctcttggcaccgtctcagtctctgaggtttttggttttctcctgctggctctgtcctgtcagcctcacagtgagctccggaggggagctcacagtcacccaccccgaaccccaggactgtgtcttacctttccttccccctccctgcccactggatgctgggagctgctcactgcatgcatggataactgaagctatttgtactcttaaagggaggaggtgcaggccaggcacagtggctcatgcctataatcctagcactttgagaaaccttgcttgagctccagagtttgagaccagtctggacaacagagtggaaccctgtctctacaaaaaatgaaaaaaaaaaaaaatagctgggcatggtgatgctacctgggagtctgaagtaggaggatcacttgagcccaggaggttgaggctgcagtgagccatgatcgcaccactgccctccagcctgggtgacagagtgagcttcatttaaaaaaaaaaaaaaaaaaaaagaaggtgtagaaatgacctgagtccctggacatggctgggggcagggttgcctgaggccgggtcttgcctgtgagttggagaggactgcccttctcacccagcagcagggactgggctatgacaaggctgtaatcataataataacagtgataatggtggtaataatacgacagtgatgatgtaacgatggtgataataataagcagaatcatcatcgtcagaaaagctaacatttggtgagcacgcaccctgcaccaggtgctttatttatgttcattcattccctcctcccaacaaccctgtgaggtagttgctgttattgacctcattttagagatcaggaaactaggagggggtcaaataacccgacactcatccagctggtacctgggtgagctggagtctgagctgaacccaggtggcccgactctagaaccttagtcactgcagtgacaccatccacatataaagggagacccccacccccactccctgcccagcagattcacttaggcaaggaccagtgggcactgagaggctaagaaaaccctgtgtaagtcaggatgggcctgtagctggtacccccaaaatagtgggtagggactttgtggtcatttattccagtatttaaacaaatttttttttgagacaggattttgctctgttacccaggctggagtacaatggtgtgatcatggctcactgcagcctcaaattcctgggctcaagccattctcctgctacagcctcctgagtagctgagactgccggcacataccaccacacccagccgattttaaaattattaaaaaatttttacttttgtttatttttttttgagacagagtctcgctttgtcacccaggctggggtgcagtggcacaatcatggctcagtgcagccttgaactcctgggttcaagtgatccctccacctcagcctcccaagtagctgggactacaggtgtatgctactacacctggctaattttctcatttttagtagagacaaggtctcaccatgttacctgggctggtcacaagcttttgagctgaagccatcctcctgccccaggctcccaaagtgctgggattacaggcgtcagccacagcacccagcctatgttttaaactttgaaaattaccacccatagacatgacaacagggggacaaatgcttatcacgtgcctcctgtatgctggacgttacactagatgctgaggatgcaacagcaaacaaaacagacaaaaatacctgccctcgtgaagcttatattcgagtagaggagacagacagcaacacaaatagcatatggcatcatatgctgacaacagccatagagaaaggtaaagtaggcagggcaaaccgggagtctcagcaggtctctatggcagcgtgcagtagagatgccgcagcatgcagagagatgatgcgcagtaaagatctgaaagaggggagagcaggagaagatactcgaaggaagaacgtgctaggccctggggctgcgggtgcaaaggtcctgaggcaggagcatgcctggcacatttgtggtacaggaaggagatcagtgtggctggagtggagggagcaagggatgagcagaagattctacgcacatgtgcacgtgtgcgtgcacacacacacacacacacacacccctacccaatgtgtatatgtaactgaaacagaagtgtcaaaaccaatattgaaattataccaaggtgaattcattagtatcacaatacattattttttaaacatctgaaataattcaataccaaatgtattttatttggtattataatatcaaaaagataccccatatgattttattaatattagaatacaatgtttagaaacatctgaaacaaaacaagctatcaatccaaacaccaaatacaatgctgattgggaatcccctaattaaacttatgagctaccaggggttgggaactgcgtccgaaaaccacagatccagctcccacccaagccctttctgtcagcgcagggcagaatgtctgagggcttagtagaagagtatggagggtgaatggagctgggttccagtccatccccatcctcttagctgctgactgtgggcacattgctttgcttctgtctctggggtcttgggtaaatggaggtgatcctgaggctggatcaggaagctgcctggggcacagctcgggatctctcaggacttgcttcatgacacctggggaaggagtttgctctacaggccacatcgctgcccagagtccacccctgctgacctggcctgtgggatccccaaagccccaggaggagtggctgtgtctcctcctccgtggcctcagaggaagttgggtacttctcattctggggagggagggcgtactctgggcttccattgcagtcgagcagctgaagaaggggtttcttacatctgcccccaaaatattatgctctgggaacctccaggtcattgtaggggagtgactggatttttctagtccaagagactgttggaatcagatatgtccatctgtccatctgttcatctgctggaccatctgcccatctctctgttccagccacctcctcacccatcactcatccatccatctaatgtttattgagcatttgccagggctgggtccgcagacccatgggctagaaaatcctgtttgtcctcaaggatctgcggctgttgttgtcataatccttacatatacgggcactgtgccgagggctactcctacccagtggttctctgatagtggtgattttaccctccagggggacatatggcaatgtgtggagacatttttggttgtcacagctggagggtcccctgggcctgtagggtgtagaagccagggatgctgctaatcgtcctacagtgcacaggatagccccctctccacccacaaaaagaattatccagtcccaagtatcaattgtaccaaggctgagaaaacctaagctgcagctcagctgatgttcatgtcagccttatggggaaagtgctgtttttattctccagtttgcagaggaaaccaaaattcagagaggcaaagtgacttgctcagaaccacacagctagcagggagctcagacagggccatgtgagcgcagagctcatgcctaagctgtgtgtcatgtgcccacgagagggctgcttagggcggtcagcttggcagatgtttaaaaacagaaccaaactgcccgttggttttgcaatggtttgcataaggtaggggatggagttattgaactcctgaagttccattcagcccagagtttaggaaggaagtcttctaggaagaggactggggaacctccatgtggtgaaatggctggaaatggcttctcgtgctctctaggatagagaattcatcccttcactcatgtaacaaaagccgctgagctcctggtctgggccggtccaggaccagagagtagaggggacagacaggtgagatgtctgctctcagggatccgagcttggtggggagtacaaacaaggggcaggggcagagaaggagaggccacacctcctgtagtagggtaggcggggacagtctctctgcttgagttgagctttaatgggagaggaggacaggagttcatagtcacgaaaggggttccccaggagggtaaaagcagggaatgaggcctagcaagctgacctccatgctgagagcttggtgccttcccctgccccagccagtctgtgccctagtacctgcaagctggctgcctccaagtccaggcattcccaggcagctgtgtttcatgctgctgcacataccaaataaagtgtagtgggaaggatgcgctgtctgtgctcatttgcacacacaaagcacacagacacatcaacacacaaacatacaataagcttgtgctcacgcataaacacacatgtaaaaagaccccttgctcacaaaacagggaaacacgaaataagaagaggaaagatatacattgaagtactgaggtgcacaggctcgccctgggagcacactcccttccctccctcaactgccacttgcttagagacctaacccaaccccctccccccggccttaccagcactgtagggccatgtggcttgagtttgatggctctcattccctggctcagacctgaggtgctcacccagttccagccatgcccacctaccccagccatctctccattgaccaaacctcggagatcctgcagcctggccaactccttctctcttccaggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactggtaagatgtttctgggaacttccggtcctggggctacagggagcatggagaactgggcggaagctccaggctctcagggatgcctggtggcccctccgctgtccccagaaagcaggaagggaaaagccagtgggaagaagctgcagtctgtggcttccctggtgaattggaaattcctagcattcctgcaacatctggcgcactttggcacattgtaaatggaagtggttggcctgagttttgctttggagacagttgctgcccagagcttgtgtctctgaagtcctccctgcagcttctcctaaagaatccacaccagccagaagagcagcctcccagaggttccctctcctgtctgccttggggagctggcaaccctggggggcaggagggccctgataagctggtgttaaatggcagcttctgggctcttagagtctgttatctgagagagagaatctggggactggaccagctggaacttcctgcaggcttggggacagcgggctcctggagcagctgggggtggagggcaggcccagagcaggcagggtggctgccacgggttctggctggagttgggaagtgggccacggggtgggtgggggtggtgcaggccaggtaggggagctgatgactgagccagggctgggggagggaggcggggctcagcaggcacccagactggccaggccctgtctgcggcgcccctggggaggctgggaaaggggcggggaaggcctgagtgcctggggccagcctctggcctgacaggctctctgtctgctcttcttttgcagacccagacccagcagctgctccacccggcacagggtaagtgaaccttgctcctttgctttggcggttggaaacagggagacaccgggcagtgggtggggatggggtggagctgaggcccagaggacccgactggtctttggctaaggaggaaagcatttcactgaggccctgtgccctgggggaagaggtcagttccagaaactcatggtactttttcctttattttgcccacaaacctctgaaaccgcaggaggcaggcctggctccaaaccctacctctgtggccttggaggagtcacagaaactctccaagtgtcagtctgtttgcggctgaaggggaaacaatgagagcaccccctctgttgggtttgtcttggagaagcaaacagctggagggtccccagtgtgtgtgtgtgtgtgtgtgtgtgtgtgtgtgtgtgtgtgtgtgtgtgtagtgggggaggttgggggggtttgagggtggggggggtgcagcccattgtaattatttttgcagttgccatttgtcttgttaatatcattcccattcctatgacagttgctattagggaccctgccctctgtgcctgggagcctgtcagaggcagtgtagcctagtggttaggagcctggatgttggggtgagggcctgcgtcttggctgtggcccccacactggccacaggtcctcatgtcagtcaagtccccctttggttttctcatctgtaaaatgggctatcgggtaagatgcccagcctcgtggtaggtgcctaatcaaggcatttgctttttatcacagttcttctttgtcttctgcaagtcaggtctgggttggaagggtaattgggtaactggaggtggtgggagctgaggcctctcaggaccaggtgtttagagcctccttgcctaagcagtggaggggtctaggctccaaatgaatggcccaagcatctggaaccctgagtttaaatcctcactaccctggtgaggggaggcatgtctgagccctgctttgtcttcctggggtgccccaaactgagcaagaggggctaattctcagggtggtgtcacccaacgggaggtttcagagatgcaggttgcaggcccaggcccccagaggagaagtccttcatgtgctcatttgctgtccagagtgggtggacttggggagggtttctcctgagcttgctactatgtaattaaggtgagaattagaggccagcctctccttcctgattagggacctgaaatgaatcagcagccattcgtcctgcacctgggctgggaagggccgtgatggctgcagtcttccaagggtttatatctccagggtgggccaggggtgaagttgtggagaaactcagtctggtgggagatgcagatgcgtcagagtgggacagagacggacgcccagggagctgggacactgactggaggggagcaaggatggggtcgtcagggaagacttctgggccaggtcctggctcagcgagtgaatggaaattctccattcaggatggcagaggggcagggggagtgcctgctgaggaagcccctgagcagaggtacagggctggcacacagggtggtcagcacactcacttccttcaagctaccctcttggagaccccaggagttaggtgatgtgctcagggttccatgtagataagtagatgctcattcagaagagagaccaaggcccctctgacaccgaggccaggcgctgggccaccgtgcttctctgcctccaggagctcatgcgctggtccctgatgagagggtgtggctggcttcataggaatgatctgattgtgtgtacattttttgaggaaagatttttgcccactcagagatgatctctgagctcttgggagagtggcgtctaagcagtcggtggaatgttccataggtccctcccggggaggcttgtgcggcagtgcctggtgtgtgattcctggtgaggtcccttcccttgacatgagagcagagcaaaaagagccggctcttcgctcccccaacacagagatcttgtgagggcggaggggtgtgcaggtgtgtctctccaccagcagttgcctctatggggacagggactttttgattttttggagggggatgttttgtttgctgccaaacctcatggcttaagtggcaggcacggggtgagtgccaaagacgtccttggtgaacgaatgatggacagaaggacaaggagggtctgtgttccatggaagcaaggagaaagcaaacagcatgtcagacctggtgaagtggctcacgcctgtaatcccagcactttgggaagtcaaggtgggtggaccactgaggtcaggagttcaagacccagcctggccaacatggtgaaaccccgtctctacagaaaatacaaaaattagccggtcctggtgaacggtgcctgtaattccagctactggggaggctgaggcaggagaatcgcttgaacctgggaggtggaggttgtagtgaggcgagattgcgccatttcactccagcctgtgtgacaaagcgatactctgtctcaaaaacaaacaaacaaagaaacaaaaccaaccaaagaataccaccccacccctctacccccaaatgaatggcatgtcaatagggtttctattggattctgactctggcagctgtagaggccaagacagaggccagggaagggaagcgcagagtggttgtgtggcccaaggccacatggctagagccacctgacctcactggtgctgatggtgctgtgctgagccacaggctgtgctaagtgctctgtgtacattatctctttttgttgttgtttgaaacagggtctcactctgttgcccaggctggagtgcagtggtgtgatcatggctcactgcatccttgaccttccaggcttgagcgattctcctgccttagcctcccgagtagctgggactacaggcatgtgccatcatgcctggctattttttttttttttttttttctgagacagttttgctcttgttgcccaggctggagtgtggtggcgccatctcggctcactgcaacctttgcctcctgggttcaagtgattctcctgcccagcctcctgagtagctgggattacaggtgtgtgccaccacgccgaactaattttttgtatttttagtagagatggggtttcatcatgttggccaggctggtcttgagctcctgacctcaggtgatccacccacctcggcctcccaaagtgcagggattataggcgtgagccaccgcgcctggcctaactttcatattttttgtagagatggagatctcactctgttgcccaggctggtcttgaactcttggctcaagcaatcctcctgccttggtgtcccaaagtgctgggattacaggcatgaaccactgcatctggcctgtattatcttattacttgtacccctaggagccctagaagacaggtactattgaatatgcccattttgcagatgagcagctgaggcttagagaactgaagtaatttacccaaatctcatggagctagtaaatggcagggctgggactaggcctgtctgccctcaaagctgtctactgaggcccacagggtttgcttctcctggtggactctgaagcacgtgcactcatgtccaccctgagctctcgctgggggagtcgtggttgaaagagcagccctgagtacccagcagtgcctgggaaacgtgagcgccacagatcgctggcttcctgtgtttttcctggactcaggcctgcacccctcacctctgagtgcaatagccccatggactctggccccctctggagttgtttgcttttcctgtttagttttgcctttatccccctgtgacctcagcacttttctgtgggtcagggttttggctcctggccctggtcgcagggattctcatgggctccctgaaggtacctggcctaccccttcctgggcttttctggataagatggttgtactgcctgttggctagtgtctctcattggggcctggagccaggggaagtgatggggcagccgtattctgggagaggacagggagactcatcttccctggatgtatcaggggctgagaggatcagggcaagaggagaccaggctcagcaaagcagtattggcacaggatggaaacagggcgctggtggcctgtggcttctgagactgctaggtgtgggggacataggggctcatgggaagggcaggtcagcaaggccggagtgggtccgcagcgtctggaggaaatcttcaagatttcccagattgccgcagacctagtctggagttgtttggaatcctgggcttctccttacatgtgctgtttcccaaatccggaacatttgagcctcctgcgtcctgtcccgcagggtccatgcgggacgtgaggcatggcagataccggctctccgcccatggagtcccccatgggagggttatggggaccaggtctttctttccattaaaaatctttctttaaaggtcccttgccaaatccataaattggacaagctggtttttgtgttttctttccttcttttccttctccgagggtagaaacaagggctcccagtttccaatcagagccaggacctttggatcccaggccctttgaggacccccacagcctcttcattgaagaaggcacttgcagggtacctggttggcacatctcttcatggtataaatatgccttcaaggaatcctgtgacgttcctccctgcatccctgcagcggtgggactctgcctcactcgttttttatcccagtgcctggcagagatggtgcaacaatactaacagcctacacgtgcacggactttacagtttacatctcattttgattctcacaactgtgggaggcagaatcatggcccttccaccccttggagatttccgtgtcttcatccccagcacctgtgaatctgtgacgctgcgtggcaaagggacttggcagatgtgattaagtgaggggttttgagatggggagatgaccctgggttatctgtgggcccagtggcaccacaagggttgtgacaagagggagacaggagggccagagtcagaaagaggtgggaagatgccacgctcctggccttggaaatggaggacgggattgtgaccaaggaatgcaggtggcttctcgaggctggaaaaggtgggggatggcttctcccctggagctgcccctgctgaaacctcgcttttagtgagagcacagccctgccgaaacctcgcttttagccctgcgaaccccttgatggccttctgacctccacacctgtgagaacagatttgtgttgtaagtcactaagttcgtggtcatctgttacagcagccataggaaactaacacgacagccctggaaagaggaaattatcgtgggcaccattttgcagaccagacctgggagagagcgtcacttgtctgtggggctgggctggcaggcatggtgcttgggctcaaagcctcaggccaggggctctgtttgccctttctctatggccctctctgtgcatctaggatggtgctctgctgactggccggtattcccctgcccttcccttgcgtcttcctgtcctttcacccagcacctctttactgagtgactgcgatgggggctgacatgctctgccaggccatgttatttttatgtgcctgtgtgtgtgtttggctctagggccagatcataatggcctgaatgtacccagcacttcttacatgctgcgctctgagagctttccctccccagtgccattcatccttgcaacactctcacaggacaggcgctgatacaatctgcattctagagatgtgggaactggcacagagaggacatgacatcagcccaaggtcacagagaaagatgagcagagccagagttaaccccagctggcttccagaacctgtgttctaatccctctggtgcaaccgtctcccacacagagctggtttggatcccgcctgccctacatgttagctgcatgacccaggacatgctctttggcttctctgcctaaccctcagtttcttttcttttctttcttttgagatggagtctctgtcgcccaggctggagtgcagtggcgtgatcttggctcactccaacctctgctctgccccctgggttcaagtgattcttctgcctcggcctcccgagtagctgggattacaggcacccgccaccatgcccggctaatttttttctatttttagtagaaacggggtctcaccatgttggccaggctggtttcaaactcctgacctcaagtgatctgcctgccttggcttcccaaagtgctaggattataggtgtgagccaccatacccggccccctcagttgctaatctctgtaaagcagggtgatgagactcaccggatggcactgttggtggggatgaaatgagatgggagagattaggtgcttactcggtgagctgctcattgtcactgtctccaaagggtgtggagctgtctggggctgactccaggcacaagggacccctccctggcctgtgcattgcttagcattacctgagatgctcttcagtccatccctcctccctacctcctcctctctcttcctttttaaaaaaaatacagtttgttgtagaaaaattagaaagtacagaaaatgatagactaaaagcaacttttaatcctaccatgatgtgtttctgtccagcttctttgctaggcatgtatgcaagtatgcatgattgtttttatagaactgtggtttattgcacatgctgtttcgtggctcacctttttttttttttttttttttttttaaagctaattacatatcatgagcatttccccaggggaacttgtattgttttgcaacaacccacatggctctcgatacatttttgccaggggtgcagggcctctccatgtctgaccaagccctggggcccctgagatgtcagggagggaggtgcattgccacagagcaggaggccagaggctgggctttggcccagcatgtgtgtggggggccacctgtacagagatggctccccagaggcctcgacgctcactccctgctgaggtctgtgatatgatgccacctgagggccgctctgagacttcccctggggggcttctcactgctctctactcatccagtaaggggatctgtgaccatgtgtggggtggcacaggagagacacacggggtcctggaagccctctgtgcacaggatgggcggccacagagggaagagggaacacatgcaggtgaggcccccgtgcctggaggagaggcggagggaaggagggggcggggaagcagcacacacgaggccataccacgtgccagcccctgtgccagaggatttacatgccttctttatttactccgtaccagaaccctgcgagggaggtagtgttgcctcattttacagatatggaaactgaggcacggagaaatgctaagtgctttatctgcatcatctcactgaatcctcacagctggaagtaggactgatacttcaccctggtccacattcagtaacttgtcccggtgcacacagccaagtggctgagccacagtcatatcccaggtcgtggccccggggtgcttacttcttcccccctcacgcctgggagccctggttctcaaccctggctgcatgctgcagcctgcagggagcttacccctgaccaacagtcagagtctctggggcgggggccctggcgcccacatcttctaggggcgccctgctgactctagtgggccgccaagccagatgctctctaaggtcctcagctttgacatgctgtacaaccaggtcaagtggccagggccaaaaagagacccagcagcaggctgaacctgggctgcgtgttcttccctttccttcgtgtctcttgatcgggccatcatgctgggaggagtttccgaggcgggcggtgacactgtgtggggctgtcctacgcaaactctcctgtcctgtccctccctgtgctgcagcttgggttttccttgaggccttataaggcaaatgtcattccagtcctttctagtcccatccccaaaggtgaagttctttcctttctcatatttgttatgccttgtcctggcaagggccccagaatgcttgtgcgtgtggaccatgctggccaggaatccttagcttgttctggttttgggggtctcctccccgaccacccacatggtgcagcctctgggaagggacccttggaggttcactgagaaactggggcctgtagcagcccctgcaggggtggcgggtgccattctctggagtggggcttcttatctttaaaacaggctgggggcccggcgcggtggctcatgcctgtaatcccagtactttgggagtactaggcggatccgaggcaggtgggtcacctgaggtcaggagttcaagaccagcctggccaacatgatgaaaccctgtctcaactaaaaatacaaaaaaaagtagatgggcgtggtggcacacggggacctacccctccctgccctgctgctctttggagagagaagaggtggggcacaaaggtgcttggagctctgtggaccagaaacgcaccaggtggccttctggtgcacttgaactcctctgccggcaatgtaggttgctgcttgggggtgctgggaggggtcctttcctctcttccctgcttctgcatctgcttctgccttttcctccccatctcctgcccctcaccatggattcagcttctttcctttgcattcaggttgctggccttactctcatttgcaagctgagaggcattaggagagcaggaagctcagataagggtgagataattgcctcttactggtttttatggctcttttatgacccggaggcccctgaaggagtgtttgttcacagggagaattagacacggcagccctgcgtggcttccatggacagcggctgggagaggctgctccgggtgggtacagggtgggtccagggccttggcaggcatcagggagggtcacgggtacaggaggggcccccagcctcatttcttgccgtgccctctttgcatgcgtgtcttgagctggaacgttgctcgtgtccctgctcccccaactttattcctcttcccctgcctgggaagccctttccccatctcatcggcccgaggaacacctgctccagtctagggaggcagcggaggtggtcctgagagcaaggctttgcagatagatcaccggggttcaaactgccgctgtgccacttgctggtcaggtgacttgggtagtgggggtgggcaggaagtgacctctctatgctgtggggacccccattccccagcccagtacaccagagccagtacctgggctggtcgctcactgggttttgataaggtgcagcgaggaggagcctccccctgcctatgagtcggctcatcaggtgtttccaaatccctcctgaagttgcctgacctcacccagtgatgcctctgcccacctccacgtcacctttacagtttacatggggctttctctggtgttctcttggttaaactgcattctttcggttaaagcgtgctgcagcctttgagctgggtgttacgctttctcttggacagtgtctgagttcatttgggctgctgtaagacaatgccatagattgggtggcttataaacaagagaaactttttttttttttttttgagatgaagtattgccctgtccctcaggctggagtgcagtggcacgatctcagctcactgcaacctccgcttcccgggttcaagcgattctcccatctcagcctcctgagtagctgggattacaggcatgtaccaccatgcctggctaatttttgtatttttggtagagacagagtttcaccatattggccaggctggtctcaaactcctgacctccagtgatctacccaccttaaccttccgaagttcagggattagaggcgtgagccaccacactgtgcctaagagacttatttctcacagttcacaaggctgggaggtccaagatcagggtgccagcagattcagtgtctgatgagggctcatttcctgatcatagatgacaccttctcactgtgtccttacatggtagaaagggcagaggagctctctagggcctcttttatatgggcactaatcccaaccatgggggctctgctcttatgacctaatcacctctgcaaaggccccaccgcctaatactatcaccttgggggtgaggattttaacacatggactttttttgtcaggggaacacagacattcataccatagcagatggagacttgaacttgagcctctgagtgtgccgagggctactgctctctctctctctttttttttttttataaaatggtagctaaacaggcaagatctgaggtaaccatatgccacagcaaacctgtgatgtaggtgaatgtctacatgcaagttctcgacttccaggtggtctggttgaaacaatagaagctttgcaggtagacgtagtgtaagatcccagctcccactaattagctgagtgatttctgggtaattgaaactttgtgaggctcagtttccccacctgtagaataggggtaacaacacctgcctccggtgtgttcctgcaaaattaaatgtgcaggtcgggcttgtaggctcactcccagcactttgggaggccaaggtgggcagatcacctgaggtcaggagttcgagaccagcctggccaacgtggcgaaaccccatctctactaaaaatacaaaaattaggtgggcatagtggcgcgtgcctgtagtcccatctacttggaaggctaagatgggagaattgcttaaatccaggaggtagaggttgcagtgagctgagatcgtgctgctgcactccagcctgggtgaccaagtgagactgtcaaaaaaaaaaaaagaaaaagaaaaaaaaaacgtgcaattacatgtaaagcagagcaagcagtgcatggcggatgctttgtcacggtcactgtcatggccacatatcagagcaaagaggacctgtggccgggagactgtccagccaacctcttctaagctcacgtctgttccagccggaagagtttggttctgtctgagcaattccgagcaactgatgtggcgccttcaggatgtttctgtgttgaggaggtggcggctcagcgaagcagctgttagaaatcggggttcaggtggctcccatcagcccatcacccaccttcctggtccagagaagccctgtcctctcttggcctttacttcctgtcattggtggaaagtgtctccccaggaccaaatgtgctgccttccttgccctggggtgacactgttgacttctggcagtgaaatgtgagctgacacttgctcctctaatagggcaggtgacttagacctgcaccacccagtccagtggccactagtcatgtgtagctatttaaaattaaattacttgaaatcaaatagagttaaaaattaagttccttagtcccactagccacatgtcaagtgctcaatagccacgtggctggtggctgctgcaccggataggacaggcaggagcattctcgccaccaccaccgctctgcttattatctgagaggcagtggagggtggcactcagagcccagcttgggagctagacaagctggcctcatggtctggccctgccactccctggcagagtgatcttgggcaggttcttctacttccctgcagaatgcagaagatgccaggatcctgtgtggtgctgggaaggtgaggcagagggcctggctcacaggaggtgctcaacagcagagatccctcctcgcagcctcctcccctccctcttcccctgccctgtcctactcttcatctgctacaggctcgggtgccaggaagggaagttcaagttgattctttggcaacggtgctgttctcttgacagtctaaggcctctgccctctaggttggcataagtggtctttggtctttgttttgtttttttgaacctggacttcaaaaaaattcacgttagaatagctttagattttcagagatgttctgaagagggaacatagagctccacatacccctcatccagcttccctgctatgagcatctcacatggccttggcacagttgtcaaagctgagacctacgttggcacattaccattcactaaacagattttgtgtggatttcatcagttttcctacttatgtttattttttgacccaggatccaatctgggatcccacgttgcgcttaactgtcatgtctctgtagcctgctccagcccgtggcagtttctcagtctttccttgatttccaagaccttgagaatattgaggagtgatgtttaggtgcggtgactcactcctgtaatcccagcactttgggaggctgaggtgggtggatcacttgagttcaggagtttgagaccaacctggccaacatggtgaaaccccatctctaccaaaagtgcaaaaattagctgggtgtggtggcgcatgcctgtaattccagctacttgggagactgaggtgggaggattgcttgaacccgggaggcagaggttgcagtgagccgagatcgcaccaccgccctgaagcctgggcgacagagcgaggctctgtctcaaaaaaaaaaaaaaaaaaacaaaaaacaaaaaactctaaaaaaacaaaaagagtcttgaggagtaatgccaggtattcggtacaatgttccccactccgattttgtctggtgtcttctctgtgattagactggggttatgcgttttggataaaaacaccatggaggtgaagtacccatttcatgacgtcttatcaggacacatggcacctgcgtggcgtctctacagatgctcacctgggtctcttggttcgggacgtgtctgctgggctcctctgctgtttcccatttgcatgtctgctctgtggaagggactcactgggccagcccatcctcaagtgtgcatgagggactaagctctacctcccacttacagtcttttgaagctttgcaagtcttgtttctttttcctttttttgatggagtgttgttttgtcatccaggctggagtgtagtggcatgatcttgggtcactgcaaccttcctcttctgggttcaagtgattcttgtgcaccagcctcctgagtagctggggctacaggcatgcaccaccacgcctggctaatttttgtatttttagtagagacggagttccaccatgttggccaggctggtcttgaactcctgacctcaagtgatccacatgccttggcctcccaaagtgctgtgattacaggcatgagctaccgtgtccagccaagtccttgtttctttcaagaggcagggatcccccagcctgccccttctgttgtatgtgggagagtggagaggtggaggttccctttgagtctgcactagggagagacgagacagcccccttgcggagagtgcttggtgcttatcactgtgaacaaggttgatcttcatgctcttgtgaagtgccagcccaaccttatgcacgccttctaaagatgaggagcctgggggcttgtctgaggccaactccacctcaggtctccccagcagcctggccctcagcccacttttgcccatcatgtcccgctgaccaggtgaggggctgccagaggcttctgggagccacctctggacacctctgcagtgccatctcttgcccgcagggtgccagcctgggtgagcaatggggatgcagcggacgcagccttctccggggcccggcactccagctggaagcggaagagttcccgtcgcagtaagtctcccctccggcccaccgcccaccccaggtagcaagctccaggatattctagtctttctaacccaagagagctgatgtgggctcctgtgagcccagggttcatcctcaccgggggcttctgtggccctggaggaccaaccaccgcccccaagagccaaggtccaggatcagttgacacacccagtttttcatctgctcctcaaatacttacgaagttcccacaacaggccagggcggcccagtggtgggagtgccctggggaccagaatgaggtccctctgttaacagaaccagacaccttgccatgggaaggtgcctgcccagatgagccctccagaaagagagggaggcagcaggggtgggggaaagagggtcccagacagaggggccaacttgtacaagggcctgagggcaggaggacccctgactcccgggaagcagcaagggcctcatctgtggggtgtgggggagcgttatggggtgaggtgtggctgcgggccctgcagctcctcagggccccagaggcagtgcttaaggttctcaaggcaataggaagccacagaaggaaggccagtgatgtggctgcctttgcctttcagtcctgttgcactggggtgggggcagtgtaggagaccaggtggggaagggtggagcctgctgggaggctatcgtggtcttgtaggacaggaagtctgagggtgggaactaggggtctagagagaggtgggcaggcctgggagctggtgtggggaggaagagggggctctgacagggctctaggggcccaggacctagggaagcatcacaggccagtgggtctcgtgacttcttcctggaaggcctgtgggtcaaggaccggctcccatcaggggtgggggctggttttccaagtcctagcactgctcagtgacgagggtctagccccggggtcctgggtgactgaggatgctagggccagggcacaggtgctggactgcgtcatgctccctgcaggggccgggagcagctgtccattagccagatgggcaggcctgcgggcagcagggagccaggtggggtctgtgcagtcactgggagggcgccttggagggggtggggggcggggagaagcgagggagccggcatcccctgagggcagctggcggagctaagggctgggctgggctatcagaaaggagggtgctgcgtgccaccagctggtgcagtcctgatgtcatctgcagcacctctggccaggctgccacagcccacggtggtgctctctctccccacttccctcccagttgaccggttcactttccccgccctggaagaggatgtgatttatgacgacgtcccctgcgagagcccagatgcgcatcagcccggtatgatgtctgcagtgcttccctgtttctcttggggacaggggagggaggctgggactggggagggttgtctctttccgtttccttctgtccccacctggccaagtgcccctccttcttgtctttagaaacaactgtagtcatcggggagaatctggagatggctgagggcgtggccaccggggccgggcagggcttgggcatcatgggcagggccatgctccggctatgggtccccgggcaggtaatcacctttctaagccttggttcctccttcaggaaaatggggccataccccaggctttctggggctgttggggaagacgacagactgttacactcaaagggtgaagcagataaagctttgcaaagccctgcgccctgctctgggttgagggctgaggtgggcaggcaggcaggcgattgtggccgcagaagggagatggggcgggcctggggcgagtcttgctggaactcacctgatggaagagaggactgttcattggcaattaacaggaagagccgtctttgcttggacacgttaggccaagcatattttcaatcatgtaatggcttcaagactttgggatgttaccttctcattttacagacaagggaacggcagaggcagggctaggatttgaatgtgggtcattctgacccccagttcaatgctctgtcccctaccccaggaggatttctgtggcattttgtgacagatgaggcacatttgatcccactgatcccacgaccccttgaggtcagcagggccaggcttatttatggctcccatgatgaagaggttaaatcaccagccccagagtacacagccaggatttgaacagcgacttcttttcctactatgcgattcttcctgttttcaggggctctccgtccaatggggaagcacagcccctgcttttgaggagctccgagtctgatggggcagctctaaccatccttgagcagcacagagcgcaatgggagagacacacagacaacacggcaaggcccgagggccccagagccacactcctgactcctgtctcaggaacggggacacctgggccaaggatatgcttatccctttagcaagcctgggatgtgcttggagcacattttcctgtttgtagctcacttgagtccagggagcaatggattcccactgtattaggaggcaaaggagtctcagaaaagtcccagagctgggaggtctgagcggctgaggggcctcagttgttgtttaacccatttggcctatttcccacctgaattcaatcaagtcactaagtccctggctcctgtcttcactgtcctcagggtctgggaggatgtggcatgttcatggcctgggtgtcacacagcctgtgtttgcaccctagctctgagcctgcaaatggggaccacagtacccaccccaggatccccatatgctgggctgtgggaggatcatttgtgacaaggctgcacaaagctcagtgcagggtggagttttggagatgcttttcacacagggccactgttgctgttgttgttagtgttatgcctgccgagggtcccagcactggcctgcctggggctgatgtgggctcagcagaagcttggagaggagctcgggccagctctgccattgatttgggcacagggctttgtgcctttgtgccttggcttcttcacataaagcaggaaaatccccagctcacaggcctttggggagggtcacacggggtcctgaccaatctctctgggcctcagttgacccatctgtagaactggggcaataatagccagtcctagggtggtagcgtagattccatgaggtaattgatgaggacactgagcaggaagcatgaggggacccttatgtggtccctgaaagctgaggagttggccctcgggctgcacacaggcacaagagttctgtgactctgtctccactggagaggatatttctatatgtgtagatggcggggacttcaacggaaggtggtacagaaccctggccccgttcactgtcttactgtggccagccacatctctcccatctgtctaataggaggagtgatcattcacaccctgctgtctgcacagggccgctgggagccgtggcacaccgaggatggaggtggttgggtgcacggctcagccctgtggaggcgtggacctgccacatgctgccagggttcctcctcagggctaccctgagaactctgcctctttggccactagttcaggggcctccactgcaataacaggacaatcagcctggccttctgaaggtcgcagctgctccactctctaaagacattagttactattatcttttgcttaaaaatagcctcatgttccctcctggttctgggacccgtctcccactaagctttggcacatctgttttgttctttggctgacactcttgcccccaacctctcgcaccccacctttcctgtggggtgaagctggggggccctgggtctatggactgacacccaagctcccccagagccaccatgagtgacggcctactgctctcagccgagtgcgtgctatgtgtcaggcactttgccaagagctccgtgcctgttttatttactcaacttgtccacttattattagccacattttgcagagaggtctctgatgaccaaagctcgcagtttttcagcacagtcgtttctgagcagatttcttttcttcttcttcttcttctttttttttttgagatgttgtctctctctgtcacccaggctggagttcagtggcacggtctcggctcactgcagcttccgcctcccgggttcaagcaattctcctgcctcagcctcctgagtagctgggactacaggtgcgtgccaccacacccggctagtttttgtatttttagtagagatggggtttcatcatgttggccaggctggtcttgaactcctgacctcaggcgatccacccatctcagcctcccaaagtggtgggattacaggtgtgagccaccgcgaccagtcagattcctttttttttttttttaaaaaaacacaaaaacaaaaaaacccttcccaatgctatatttcttctgtgatgacaaaagcattttcatcttcatgtactttttggcgtctgaccccagtttcatgaggtctgcagttctccaggtaacagatgaagaaatgaaacccagtggggcaaagggccttgcccaagatcccccagtgacggagctggggctgggaccctgtgttccggcctcgggacagtggctttcccacctcaggcttcaagtggcatctcatagccgagttgaatgggccccacgagtgccctggcccttgtgggacctgtccctccagactcttagctttttgtccccaagttttcagtccaaggcatttcccgcaggcttaggaaggaaaggagctcctggactctgggccagctgcgccccctactggaagatcccaggctgcacgtgaagtcagatttggggtgaggagccctgaggccccaacaatctctgtttcattcctgaggatgctgagggcctgagccaggacttggctccgggtcttctcttttccagtaagaaacaggccacgtgtggtggctcggctgggtgtggtggctcacgcctgtaaccctggcactttgggaggccgtggcaggaggatcacttgagtccaggagctcaagaccagcctgggcaacataacaagactccgtctctacaaaaaattaaaaaattagctgggtgtgatggtgcacacctgtagtcccggctacctgggaagctgagataggaggatctcttgagcccaggagtttgaggccacagtgagctatgattgtaccactgcactccagcctgggcgagacaatgagaccctgtctctaaaacaaaattgccaaggaggctcacaatgagcgctgagaccatacaaaagcagtgctgggagcaaaaggaagtgagcgggcttgtgcacgtctgacccatttcttgggttttccccattttctcaggccctccttgccctacgagggggaaaatgtattatcatcttcgtttcatggttgaggaggtagagctggagccccagggcccccatgttctccctgaccccccctcgccccacctgggttcagaaattgggtctgaggctggaagtctggtaggcttggcctcagggcctgggctcaccggctgccgcttggccagcaggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaaggtgaggggaccgggggtgtcgctcacctcagtcagggcacggagaccccttcagggagggagggagggagggagctgggtagtgagggccaggcctaggactcacgtctgggtcccagggattcccgggtatgtgtggtgagaggggagccagaagcccaggtcatcccgaaacaggaggtgactcgtagacattgctgttggcagccctaagcccgggatgggcatggctggtacctggcacaggtgctccccccacccccttgctatggcagacctggtcaattgatcctgatgctcacgggctcagactgggcttcagagtcctctcaacgccgcactccaggtagcccagccacttgcttagaggtggagcctggatcagatccacttgctctccccgccttctgggactgatgctcagaccaggcctcagcccgcgcagtcctctctgctctggggcagtggagagtgggggctgctgtggctaagccagagcggcctggaagccttctctccagggcctcacacggtgccatccatgcattcagctttcctcgtgtttctgcctggagtagagaccattctgcttatttcctggaggggagcccctgaggctgtgagggggataggtcatctggttccttctttcccatggcacccatgctccttccctgttgttctgcggaagccaccaagaggcagtgtctgtccgtgctgagatttgcagtttcatggggacagcttcttacaggccctgactgagcagaggggatggcgtccctctcaggctacttttatgtttatttttattaattattcttttgaggcagagtctcactctttcgcccaggctggagtacagtggccctatctcggctcactgtaccctctgtttcctgggttcaagcaattttctgcttcagcctcccaggtagctgggattacaggcgtgcaccatcatgcctggctaatttttgtatttttgtagagatggggtttcgtcatgttgcccaggctggtctcaaactcctggcctcaagtgatccacctgcctcggcctcctaaagtgctgggattacaggtgtgagccaccatgcccagcctcaagctccttttaaaagatgtagcggggcgggagagctccacctggggccattcctgcatgggcagggtggggacaagagaggggactttcccagtgcctcccaccttttctgggcttgggggatccactctgggagaggcatgctggccggaggaacacccacacctgagtcctcaggcagccattcctcagaccaagatgggctccctgagtcctgagcaagcctgggactgagcaggtctctctcagcctgctgtttccagggatgggcctccaggggtgggctgtggaaaacagccttaatgtcttgctagccaaaaagcgaagcatttacaacacctactgtgtgcctagtccatatcttcagttgtgggacgggatacattggaacaggaagacctaatctgtgctcagtgaacctttacggtccataggagacactgaatgggaaacagtttgtcaaaaatgaacacaaaatgctggtcatcatgatcagtgtggtacaattttcaaagctaaactatcatgcccttcaaaacataatgaagacaaaaatgcctttacgtaaacatgagcctgtgtccagcctggctgtgtgcctgacaggggtagggactgatgagaccaatcagagacgcctctgagagcggtgagttggagctgggcttaggagctagaggagacaggacaggtgatccaggctggaggagcggcccaggcagaagcccaggaacagctcgttgctgcttcctgcagttcagaaggggcagcatgcactgctttagggaagggggctttggttatgaagcccccactccccccagtagcctctccatatggcaggacccgtgcgtcccagccctgctctgggcagtgtgaccagatggggctctcgagtcctggcccagccttttagcctcagcctctggcgttcctcctcctctcccatgttgtccccggccctcttgctgggactgggaggaaaccatgcgtgtctctcagagggaaggagggatgacaatgctgaattcaggctttccagcggtggtccccatgcttccacgggcatcagaaccacatgggtaactgattgaatcacagatgccagggcctcaccagggactctgattcaggggttgggtggggcccggtaatctgccttttaagcagctctctgcccccagggggtataaggggcccacagagcactccaagaaatgctgggctgtactcaccatggcctggccctgggacctctgggggctgcctgtgagctcgtgtccctcacactctcaggctgggggctttggacccttcctcagcagaaaaactatgtggcacagttgttgggatttctaaccacttggagtttttctctggccgtggccaaggcccacctgctcgctgatcagcaggctcctagggagacaggaggttgcggagggcttttcctctggtacccacttctgccagggactctactgagcctgcctgtggtgcttcaccctcctgagctgcttggggcgcacctgctcacccgctggcattgcagcagctgcatgttttagggccactgctgcttggctatgtgctgtgtgtgctgtgggcacaagctgacagcaggggtctggggatgtgttttgtcctgttcttggagactgaccatggccaggcaccctgcccagctgcaagagaactaatggaaccccttcttcagagatccgaagaggccgtccctaggcaggtggactcttgccaaaaaaagtgaccatggggtctgtagaggggcacggacccaagtggaagcagctgcctcatcctgttatgtgaacaagtggtcctgctggtgccaatccaggatctgtggttttttttttttccagttgtgggatggattgcattgaactctcccactctccagtggtgacctctttgaaatcaaggtctctgatccagctggacggggactgggcagaactcatggattcattacagaaacgccagccctggcccagcctggtctaccccctgctctgatctggccaactcagcaagtggcctctgatcctaacatttcctagttcttctgaccctgagagaagtgatggagcaccagaaggcccaggggctttatggttttattatgtgaaactattttatggatgaacaggactcaggtcaaaccccaaactcctcagttttttgggagtctgggtagctctcagagggacccctgtcctgcatgcatacttctttgcataacaatattgaacatttgcctagaatggtacactttacaaagcagtgtcatttaattttcccagtaccctaagtggtcagtattattgtccttaagattctcattttgttgatcagaaaacctgtgtgaagctcagagagacttaaatgatgtagaatgcaatatcacaggtgcctcatctgtctgtatatccatccatccatccatccatccatccatccatccatccatccactcatccattcacccatccaacaaatattgagcacttgcaatttaaaagataataatggcttccattttttgaatacttaataagctctgggctttgcatgtacatttaattttctcaacaaccctatgcagtagctactattatggccactttaccagtgaggaagctgcagctcaggtaaagagacttctctagctagtaagcagagatccatgatttgagcaggagcctacatgcctccagaactcacactcttgatccttctgtctacttctctagaagtagcacctgtcttggtcttttgtgtactttaccaaatatcactgttgctcatatggttcgtgcatttgaatatctatctgttcttctgtccatctacctgttctcccatcggtttgtccatccatccatccatccatccatccatcctccagatagtctgtaagctgagcatccattcttccatccagttgcccatccccctccctcccttttacccttcacccatcctccctccattcattctccagcagtgtgccagaggcagctagtgtcagctcacaagaactcaggagccagttatgagcatctctttacaaattcccattcagtgatgtcactttggtagcttggaattggtggaagtattcacaccatggaaatgcttcaaagcagggccctttttcctgcagaactggttgttaaatatttgccagcacagcactgcctgaatccattctcctaccgtccatccatcctcttattccttcatctgactgtctcttcatccatccatctgtccatttgcccagctatatagtcacctaaccaaatttatccatttgctcatccatctatttatctgtgcatctattcattcatccatttatttattcatccatccatccctctatgagcctgttcgtctacccatccacctgcctgtctgttgcccatccatctgccaaactcttcttctacccttccattcatctttctgtggatttacccacttatccatttatcccccaacctcattccatctatccatccacctgccatctgtctatctcacaaacttacagagaagctcctatgttacaagccctgtgctgggccacagggccggggagaagacacagttcttgccctcagagcattttcccttttccctaagacaggagacctggatttactcccctcccgcctctccgccccagcagcccagattccctgctgcagagacccggcccccagctgcctggcatggtggggttggacacagctggagcagattccgggcaggatctggctggactgctgcctgggacctggggtgccgcatcccgcctgcccgagctgtccgtccgcactttacctgagtctcctttctcccctgttgtctgtgttttgtctccttcctgtcccgcctgctcctctcacctgctttccttctgcctggccgcttggggctccagctttctccagacctgactaggctaaaggagagatacgccaggactaagagagacatcttggctttgagagttggggggagagacatgcaggagctgaagcacaagtacgattgtaaggtattgtctgtctgtcccctcaagccctggatgggggctgtttccagctgcagctacctccaagggttttcctgctgccctggtaccacgaagcctaccaggcccacccttgagtcccagggctgtcctgagacctggaccctggccacccttgcatctgtgctggaactggcagatgccttaagccacatgttcccttccatgttctcacccctatctttctccccacctgcaagtgaaaccctgatagtccacaagaattcccaggagggttttcaaactttaggacccttgcaatcacctggggtgctgtgttaaaaatgcaggttcctgagttccagccccaagggtgccacttacgtaggtctgggacgaggctcaggaatctgcacatttcataatctgcacagttggggttacacattgaaaaacgtgagtgttgctgacattggatgttcctatctctccacactattcagaggaatccaggataaggaagtctgtaggagaaatcacagtacttgcttaaacttttggatgatgatatcgacaacagtagcttccattaactgagcacctgctctgtgtcttggctaaaggcatggactttcgaggtctgtgggcctggtttgaatcccaatctcaccacttcctcatggtgtgatcctgagcaggccccttggcctctctgagcctcggtttccctgcctttgaaatgggggcattcacagtaccagcccccagggtggctttgaaggtcaacgatcaggcctcttgggtgtacggtgctgtgctgggtctagaagctcagtggacagtggctgttgttatctacatgcctgaccgccctgtccttgtggcactctgggcagtagctgcctttctgcatcttttagtgtcaagtacccggctagtggccacagcagtggttcacgacagagctgggattccaacttgggtctgcagtgtgccagagctcaaacgtcctccatcctgcagtgctgcccgctttattggaatgtgaagccttccaggaggaggagagcagaccctttacagttacgagacctttcacagatacccgcgagaggcctgcaacccagggtaggggcggggctaacctctcaggaagccaaggcttagagaggtgcccagagctagagaagggcagagtctaagactgggcctttcccccgcttcggccacacactgtgggaatgggtggattcggcaggtgtactcggggacaccttctagggtgttggcctgttcttttttgcccaggaaaatgccaagagaagggcctcagatgatcccttgaaagaccactttgggggctcgcaggacagcaccactgatggctttctgccaggacaggaactggattctggaacagaggtttcagatctctgagggtgtgaccccctcctcccaccccccaacaagaagaagatgagcgtctatgccatccctttcgttagattctcaaaggcctctatgattactccccttgcccaaccccagaaaaggccaagcacagcttctctaggattgtcccgtagaaatgcagggcaggcaggggacttccttctttttccctgctgctggttccttccagaaagtcagccttgttccttgaaagccaccacccctgcttccccatgcacagcacctggtggcttttcagcaacccttccttgcccagacccccaagaagtgcttggatacttaagtggggaccaaagggttattggaggtgatagagcagagaccagagacaaccccaccccgcagattagtgctccccaccttcagcagagagttttaggaaggagaaggttttcttaggactgcactgtccattatgatagccacgtggctctttaaatggaaattaactaaaagtaaatataattagaaatttgggtgcttcctcgcaccagcacatttcaagtgctcaatagtcgcatgtggcccgtggctcccattttggacagggcagatacagagtgtttctgtcattgcagagccttctctttgctggtgctgctgtatgctggagaagatgcgggtgctagggctggggcttgggaggacaaaggactggctgaggggacagcagctctgtcaggcctgggttcccccagcacctcggatgcccacttccctcttctgggcacgcggtctccttacgtctcatgttctgcttagcttgctacgctcgtgtccatggatcccctccccactgccagaggaagctgcctcttctttctggcaacttcagccttttctccttttcccggatggtggctcagtaagaaacctggctgtttcgggggaggcaagggacgggtccctcacctgggtttggcggatgggatgggggtgtgcacacacctcctttagttgctcctaaggtcatgttcaacattcgtggagtgcatttttctgctcagggagctttcccagacccggaatgtttggtgctcacagaccctggcaaggatcggtattgctgttcctcagttttgcctggggaaatggaggctcagtgacgttcagtgacgtgcccagagtcatgccattggcgggtggcccagggctccaggtctccagcacccctcggccccctcctcaccaggtcacatcatctcctggattagaaatctgctcacatagtctgtcctgaaaggaaaaaaatcggttacagcctcctgttgcccctaaagagggagatccccgggcatgaacgcaccttctcacccccactgtcgtccttggcctttgctcacggacctgggagggaagggtctgggtggttctgatctctgcaggccgaggcctggggaggcgggtggccctcggtagcaggcatcccaggccgtcccttccctgatgagcctctctacctttgctcagatgacccagctcatgaaggccgccaagagcgggaccaaggatgggctggagaagacacggatggccgtgatgcgcaaagtctccttcctgcacaggaaggacgtcctcggtgaggcgctgcccgagcgggagggtctggtgcccagctctgactgggggtcggggagggtgggattttgctttacaccccagaggtcatgctgggtgggtaccacttggcgtatggttcctctggtggtgggggttgggggctgagtcccaaatatcctggtaggtcccagtgtgcctccccctcctctggcaggcgtggcctgtcccttctgggagagctgggcctcttctttcagcgtccctgctcctgcttttgtcacggccgtcttggcctcctgccccctgcgctgtctggctcacctgtcctcatcttttttgttcctgttccctccttcctttatccatccacccatctctccaaccagctgacatttacggaatcctactaagcgccacagcctgtgctgcatgcagggacccacgatgcatgtatcagcagtgcctctggggccagctgttggcacagcgcgggagacaggcacaggcatgggaaatgacaggacaggttgacaagtggtccactggggtgccctggggggcatggaggaaatgaggatggacttgggggatgaaaggtcagggaaggaggaggcacaggtcaccaggcagagcggagtgggtgctctgggaagaggagcgagcgggtgtgcagagccccggatgtgggaaagtacgagatgttccagagatgctcttagtcagcactgactgagtatttattgtgtgccaggtgctgccctatgagcctacagttcctcacttcatccttatcctcaccacacaaggcgcacagaactctcacattcccacgcagcagatgagggaataggcacagagaggttgtgtcagggctgaggacacacaggcctggaagggatagaggaggcctcaggtggcggaagtgagggcgggcatgataggccagggtccggtcagtacaggctctgtcagccttgctgggcatttgcctttggtcttaaggatgctgcataaaccccattagagggttttacgcagaagcgtcccatggtcagatttgatcaattgatcattcatgtgacaagttttattaagcatctactatgtgctaggaactgtcctaaagccatgggacacagctgtgaatatgagtcctgcccctgatcccctgaagcccccttcaggtgcctacccttgctcctggtccccaccaggctccagtccattcctctggagaatgtctaggtcagggcccctgatgtattcccaggcattggtgggacagggtcaagtaagaccggcccctgctgcccatctcacatctttagaggtgacagacaaggagacaaggaatcccagtacagtgggctcacagctgatggaattctgggatgccagttctctttggaaggaaggaggctttgtctgctgcctgccctcggcacatggcctgatgcagcagaaggaacacaggcctcgagccaggcaggactttgagagcctgtgtcatcctagaaaattctgtaatctccctgtgcctcagtttcctcatccgtacagtggggtggctgtctgtcttgtagggctgtggtgaggatgtcctaggtagtatgaggagagagagagccccatgtagcagacgttattcttggtgggcggtcagtccctaagtggaggcgtttggtgccaggacggcctcgtgctggcctgttcagaccctggctctgcggctttctggctgtgtcgccttgcactttttcccctcttggggcggcagaccataaatgggttttcatctgtaacatgggttgagccccacccgtgcacttggtgcggtgctcagccagagtgggtgtgcacaggcctggcacaggctgggtgctcagtgaatgtccatgttccctctgcattttggggagcactgacccccgatgatggagggagcaggccaagtggccattctaaactcattgagatggtccgaagacaggataacgtggccaggccagctggctgggaactcttcctgggtcaccctcccaaccccaggctggctagggctctcctcagccctccccaccccgcccacaagcccagcgccttcctgaagtgaccctccctgcagaggcgatattaatagccgtggcagggctcgaatcacaggccaagaatgttacccagcagctcgtgggggaagaggaagctgcgaggcaggctggggtgggtgcggagtgatgcccggggcgtgatgtgggcccggcaggagggtctgcaccacccccacccccacgccgtcatccgctgtccctcctcctcctcctcctctgtctcctgctcaggtaagggcctattggggtgtctctaccccctcccacccttggggttgctgccgcttcttctttcctccccagcttcctcacagctcccatttcctgctgcccacagccaccgctggagtcagagccattcagcagctgggatcccctctcccggcacctgtaccttgctctgttgggggctggaaccctctccggagcctccctcactatctgacctcctcccactctcagaggcttgggcctctgtccatctcattccgtcctccgtctgaggtccagctccactcactcctgggattccatgtcaggctcctgttgaactttttccctttagctctgcatgttttatttcaaaaggaaagtgccaaaccacgctgccctgttcttctcggggcttattttcttcccccttttagacttccagaagaaaactatttttagttcctagtgatggggacatgggcagctagccttcgccaggccagagcgggcgggcctgagcagggacagtggcttctggcagcatggacgccgagaacccaggccccacaggacgcagctttgatttctgcctgttcaccctctcgctcacttgctcacaattattcactgatggaatgttccaggccctgggacgtagcagggaactcctgagaaggagctaccgggcggctctaaccccacggggccccaggagctgcttgcaccctaggacctgggtccaaggctggtctaggggggctctcagctcctgaggcctgagcagggtgtgctgtccctgccttagctgtgtcatcggcccatctgactttccaggtgactcggaggaggaggacatggggctcctggaggtcagcgtttcggacatcaagcccccagccccagagctgggccccatgccagagggcctgagccctcagcaggtctgtgggggagtggggcaggtgggggtctgcaggggaaggggtggcttgggggttccagcctgttctctggggccacgcttgtctggatctcacaggggatatgatgactgggggctcttggcagagcccagctggataggggcctcctaggttctctcctcagctattgaacaggctttccactttctaccccgtgtgctctgtgctgttggttttggggggtgggctcccggcatctagaacgcttgcgtcccccaactccatggcatgcagagcagtcccgttggctgtttctgactaaggtgtcatttgaagaatgagatgggatccagactcaggtgaggctgcaggtgtgtaggtgcccagtccctgccatctgtccacctgtcctcaccctgggcctcagagctgccacaagctcccaccaggaactgaggctctttaagaatggcttccttggctgggtgcggtggctcatgcctgtaaccccagcactttgggagggtgaagccggtgggtcagctgaggtcaggagttcgagaccatcctggccaacatggtgaaaccccatctctactaaaaatacaaaaaacaaacaaaaaaaattagatgtgcatggtggtacacgcttgtagtctcagctattcgggaggctgaggcaggagaatcacttgaacctgggaggcagaggttgcagtgagccgagatcgcgccactgcactccagcctggtgacacagcgagtgagactctgtctcaaaaaaaaaaaaaaaaaatggcttccttcttgtagagcatcgtgctgaggtcgggcagctttgctctgggatctcagcccagtcatgttgtcccttcgctatctgtgttttgccagccatgaaacagggtgcgagatccctgattcctctggctgtgaggccactgagcaggatgtgttgtaggatggtgggtagagaccagggaagctgctgaacatcctacgaggcacgggacagccccactatggggagttacttggccccagatgtccttgtgctctgctctgggtgccacttgagtacctggggattgttgacaatggatcaacaatgggacagtggtcttgccatctgctgggactgtgtggccaggccatggccaggcctggctgcaggcagggcagtgggaagatgggagaagagcctgctggaggcaggaggaggcagcagagggagtagggcagggagccggggttctggtggtggtgggctcctgatggacgctcaggacagctgtgggggtagagtagggggtcagtcacctcccaacccgagatcgagagggatgggctccccttcagacccctgtcacatgtgacacctcctgtgagcagcgtcctaactttgctgcacaatagagccacctgggaagatttcaaagtccctggtatccaggttccaccttgttcagaggacggtagaacttcagaaggtctggggtgggagccaggtgactgtgttggaaagatcctcagctgagggaggtgcaagccacaccatgctcgacggggtactgcaggctgcagctgaggggttgtgatccactccgtgggccaggcttctggagggttacggtgatggtggaagggaaaggagaagggactggggatgtttagccagaagcagagaccactcgtgtggggggacggtaccccaaggcctgtcttgtggaagagggatagctcaaggatttcattcgcaagtgaagggagctgagattcggttcatgctaatgctaagacagaattttcttttctttttttttgagatggagtcttgctctgttgcccaggctggagtgcagtggcgcgatcttggcccactgcaacctctgcctcccaggttccagcaattctcttgcttcagcctccaaagtagctgggactataggcgcgtgccaccacgcccagctgatttttgtatttttactagagacagggtttcaccatgttggccaggctggtttcgaactcctgacttcaggtgatttgcccatctctgcctcccaaagtgctgggattacaagcatgagccaccttgcctggcctaggattttctattagagttgtccaaagatggaggtggtcacccgccaccatggaggagcgtggtgattaccccatccccagatgtatgtgcacagaggggctttccctgggatgtgcccttcctcctccattctgtagccaggcagcagggcatttatttagggttggcaggggctctggaaggaagagtggccaccaggcccagtggtcccaggtgggacctgggagggatgggtttctctgtcctatagttgtcagctccccttcctgtcacttgggccctgtgcagcaggtgtcatgtgcgctgaccgtgctttttggcccgagcaggtggtccggaggcatatcctgggctccatcgtgcagagcgaaggcagctacgtggagtctctgaagcggatactccaggtgcgacttcagggagttctcaagggtctctggggagaagcagggagggccctggagggtaactttatacggagtgtttggggactgtgggcagttttaaggggacaggaccataagccagcactgctttatggggacagtagaacctccaaatgtaggcagcaagaattcctgatgccctggtgttcacgggagtgacttctttgtgaacaaaatgggattctttgaaatgactcctggagagctgagggcatatactcccatttatgactggaaggcactgtgtcctcctgccactctggaagcccctggggcttgggccatgtcttcccatcctcctgggatccttagttgggaagatgtgtaggatggagtcctccttcttgcatcgagaggagtaggatcgagtcctcttttttgcatcaggaggcccaggggttgctgagcagatgcttgcatgaagtgactagtatgtgccaacctgagaatccctgagacagtgtttgaatccctgagacagtgacttttccgggcggttgtgggctaccagagtaaggccaccagggtggggaattgttgctaatgataccctctcttcccctcttgagtttggatcctcagagagggatcctaggcatcaggcaggtagagatgaatatatcacctgtctctgacaaagctaattggagagtgacgcggggtgtgggagccaagggagcttgtagtgaccttaccgctcgtgggctcagtgacaggcagagcttcgccctcaggccggcctccaaggagctccttgcaggcagatggcgcataaaagaccctcttcctcccgaccaattaacacagaagcatgggggtgttgtgtgtggccagtgaggccaggggtgttatggtgatggagatccttccggaaggacgcatgaggagtgagggatgagtgcctcccctccgtgccacgggaaggcccattcatggctggccgagttctgcatgagggcaggtagggagagaggctgcggcctggcctgcggcctcaccccgccctccccggcaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcggtaagtgtccccaaactttttccccagcccaccaaggtaaaaccacaaccagtctgaccccggggccatgcagtccagcctcctgcctctgcctgcttgccttgttcaagtcagtgggattagagggtggcagggtcttctgggcctgatctaggggtgagtgtgacaccttgaagtggccaggatgtccttggatatacctggcaggccatggtgctgatgaagccaggtggctgtcctggctcctcccaggtggcagcaccccctggcctcccagtcactgtgggcagccacctggccggtcacaagctctcttaccgagcacttgaggggtttcaagccagtgtgaaatgctgtgaaagaccacaactttggcccggagaggatgtgccgcagtgctggggaaagggcactggctcacgatccgggggacctggttctggtcccagctcagttctgcaacctagggcaggtccagggcccactctgagcccaggcttgccatctgtggaatgaggggtgcactggatttctggcttttctagctgaagtctgcggaccccagatgttcatggggtgagggaaggtcaagttggtagcactctactttgatgtgttttaggtaactaggttttgctaaaagaaaaaaacttttttttgaaagccacagcgctcgatagagtcactgaataggtctgatgttctgggtgtatatcaaggggctctggagagagagttgattgactccaggccgaccatccctcccttggtaactcaactctgggcacgctgcccggtgagaggccaggagcactttccttaaaggtggagggcaaggggcattcgatttcctgaacgtgaatgcagtagaaggggtgttccccctgcccttctcctccctccacctgtgggcttgggctgctgcactggggatggagacctgggaggcgaaggtcccctgggctctcctgtggcaccaccccatcccacctgtgacctcaggccagcctctctacctctctgagctccatgtccacaccccagtgggggtgatggatttgcacagctcgaggtcccaagggagtgtggggtgagtgcaggcgcccttctgctccctgccttgaggcggcctccctggcccacacctgcctcgtttccttctgctccctgcattgaggcggtctccctggcccacacctgccttgtttcagttttccaagtccatggtgctagatgtgtacagtgactacgtgaacaacttcaccagtgccatgtccatcatcaagaaggcctgcctcaccaagcctgccttcctcgagttcctcaaggtgggcctccatggtggtaccgtgcctggtcagggtgggcagggagattgctcaggaggaagggagcattttggccccagctttgggtatgacatcatagctttggcctggacagctcccctctttcttttggggcagcccagtcccatgggaagaaaatcgttccctcctgcccctgggaggagcgtagccaagtgtctgtaagcaactgggatcctggagctttggcagggtggagggaagacctgtgtcatcttgctgaccctttgcctcctgtgccctggtgagtgggtgggtctgcctggctggccctgtggtgggctgtggctcccgggttgctaagctggttccttttcctcatttataaaagggtgaggaaattccttataggggtatcttgggcattgcttgggagagtaaaggttaaaggcttcgaaaagcttctgagttctcatgtgcccagcctctgctgatttctttgggagtgtagtctggtgagtcagagcccctgcctgtagggagcctgctggctggcagaggatgcaactgggctaggtgccaggacacgcacacatgtgccggcagcacaggttagatgccacggcctcagtggaggaacccactgtccccatcaaagagaacaggggatcaggaggagccaccatctgacatgggccctggcgggggatggtgggattgtgccaaataaagacagaggagagcctatatcaggtgtaaggatagtggagcaaaggttagaggcaggaggagagggatgggcaggtctgtttggattctgggagcactgatgcctgttggggagtcccaggagagaaggcctgagtgtgcacactaagaggcggctgagttcagttgggtggttctagacctccaggcccagggcctaggatgtaatatttcaggtaatggggagccattgaaggattttgagctagggtagatggaagtggaggcaggtggagaaactgtgggattgcagcatatgggggccaggaccaggtaacaggtgtgtggatggagtgggggatggatgcaagagacaggacagaaggtccccctgtgccccgccccttaccctagcccaaatctgtctgcatttagtttaagtggagggaatggttgccttggccacttctagaagtctgacatcttgaataaattgctgagtttcccagttatgcctttagttcagagaccttaagatgactgctttagtctcctgagggtgcgcggccatgcaggggcactggtgggagagggatccctggctgcagaaccacggacctctctcagctcttcttgcaagcccagggataggcagggtcttagggcctggggagaggagcccagaatggggacagtgtctggactctggggcactgggccctctctgcagggggtcagcgaatgacggaaccttgtctccaccagcgacggcaggtgtgcagcccagaccgtgtcaccctctacgggctgatggtcaagcccatccagaggttcccacagttcatactcctgcttcaggtactgctcaggattccagcagcttcaacccacagggtttgcctgtgggctgggaggtgcctcctggggtaggagggaggaggtctgggctcttgtccgtgatccataacccacccaacctgctgtgggactctggcctcatctttctccacttctagagtgaaattgattgtaactgacagctcagtttgcacgcccctctgtgggggacgctgagggactgctggtggcctgagtctgggttgcaggaagggagtgaaggcacagggaatcccgggacccgcagggctcctggcatggaggagatgctcagtaaacatgctgagcttggccatttcagattcgagcttcagaacaggggattcctaagggacattagccccacacagggtcctggagagcttgggacactgtcccaaccactgagggtccttgggcaggggctggccctcatcagggagctgagagggtggctaccaggctgaggggtccggtggcacattgctatccactctcagtgctgctggcctgtgggagtgggctcttatgtaaccataccatttatcaattgatcagtgattgatctataagtttatttatttaccatcataaccatttctaagtgcattcacattgttctgcaaccatcaccaccacccatcccagaactttctcatcatcctgaaccgaaactctgcccattcaacaactcccgattctccctccccacagcctccggcaaccaccattctaccctgtgtctctatgactctgactgctctaggaaaacacgtatacgtggaatcatacaatgtttttcttttcgtgactggcttgttttccttaacatgaggtcttcaagattcatcgtgtcctagcatgtgtctgaatttccttccttttcaaggctgaataatacgccattgtatggagagaccacattttgtttacgcgttagtctgtcgacggacatttttgcctccacattttggcgactgtggctaatgctgctatgaacatggctggacaaatatctgtttgagaccccgctttcagttcatgtgggtctattcctagaaagatccatgcttttgttttctttttcatgcattagctgtttcttgaggtcttgttctgcatctggtgccatctgtcctggcctcaggccgggccctttgcagacccagtgtgtgtagggggttgcgcagggtgaggctttgccccaggctggggtagagttggtcatgggtgggctgctcagtctctgctctgacctggcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaaggtgagctgggcctcccacctgcctgccctcacctgcctgccctcacctgtgctcctgcccgtgcccctgccccacgccacccacactaggtggcagtgttctctgagggaggggaggccttgctcttccaaggatgtgaccttggggattggatcctcagcgggacccccacgttcattcctgttcatgttattttaagataaaagttcattttgtgcatcagtgtgatttccagtaaagtctccagaaatcaaagcctagttaaatgaacaggctctggagagtcagaatctgggtttagatccagattttgccataggtgcttgctgtgtgccctcaagggaatcacccaccctctctgaacctcacttgctccctttgaaatgaggagcatttaatagcaccggagccctagggctgctgccgcaaaagagggagctggcaaagtggcttcgtgattgtccttaacacaagaagaaagatgaaaagtccatgccatgttttggggttgccgcttaggaacatgctattaaaaaaaaaaaaagaaaattgggctgggcgtggtagctcacgcctgtagtcccagcactttgggaggctgaggcaggcagatcacctgaggtcaggagttcgagaccagcctggccaacatggtgaaaccttgtctctactaaaaatataaaaattagccaggcatggtggcacacgcctgtaatcccggaaggctgaggaaggagaatcacttgaattcaggaggcagaggttgcagtgaaccgagattgtgccactgtactccagcctgggtgacagagggagactctgtctctaaaggaaaaaaaccaaacaaaaccaaaagacttgcaaatgagtctgtagaggagcctgtttttaaagcacaaggtcacctcacagagtcacctgttggtcactggagtccctcttcttccctctcagcacatgacatgaactgcctggctctgtgctggggtctctgggaggtcccacaccccagcccccctgttcacctactggagggtaggggagggctgggatagtttaggctggggtgcccaggccctgggcacattgcaggactgttctttggagaacggatactgtgtgaggtcatagggagaggttcaaattttctggggaataaactgggagcctcttggctctgtggggtcctagaagcagaactaaggcctatggctggctgttcccaggagggaggtttcagcagcacggggtagacctttctaagagtccaggaaggagtacccagagggagagtggccctttccatgtgtgctgcactttacagtatagaatgctgtctaacctgcatcagcatctttgctttccaccccatgcctgtgaagtggggcagggacaaggcctcctgtagggtcccctgcagtgccaagcttcaggcaacccacatcttaggactctgttgcttcaggccaaattcaggttgcaggttgtgttgtggcccacacagtattttattctatttaatttaattttattttgagacagggcctcatgctgttgcccaggctggagtacagtggtacaataacggctcactgcagccttgagctcctgggctcaagtgagcctcctgcctcagcctcttgagtagctgggactacaagcacgagctaccacacccagctaattaattttttttttttttttgtagagatggggtctcactatgatgcccaggctggtctcaaactcctgggatcaagtgatcctcctgcctcagcctcccaaagtgttgggatcacaggcatgagccacggtgcccggcccacacagtagttttaagaacatggcagtagttgccaacatttaaaaattgagagagatcctataaaattcagacttgtgggtctcctgggagggtaggaagagctggctcaccgacccaccttcccacgtggcaccagcccccgagtggcagctgcccacttccccttggttcctacccacctttcccactgatgttacctgcaagcccctaaggcatctgagtttattttacctgctccaggaggattgggctggggaagacgagatggggaggggacagcgccctctcctggggatgtccccatccacgtggctcaggttgggcatgaggggcagggtcactctccaccccctggttccaggcaggactaactcagccatcccccacacaagcctcgagtttggaatgtctcgggagaaaaagccttcagccccgccatgaccacccgtgctggcctttgcgctcaggaatcttctcctctccccaccttcggctccctcttcggtgaccaagaggctttctcttgctttgcctcatacacctgtgcagccacagtggggagaggcctcttgggaggaggaaataaattccgtagtggttgggaagagccgttctgccctctcctgctctgtgaggtgggccctggctggaggtaagggagacctctttgatgctgggcaaaggactagaggctctaagcttccatgtctccatttgctgggtgagggtaggttggaccatgtgagatgttaggaagagtgtggtggaggccgcaccctgggcttccccctccagggccctccctggacagtcctggccagttctgtgacctgtttagtgatgtccctatcaccatcacccagggagaagcagaaacgaaactgggtgtaacccgaaacggaaccatgccagctgtttcaaaatagcctaggcaggagcctccagagggccgtttgtgcaatatcctggttttctttttctttttgttggttttcatctgccaagggggcagcgctgactgccagagcccacgggactttcctcttccaagttttgggtcatggcacatttggcagcccttggggcggggggccctgctgtcttcaaggtccgagtagtggtctcttgagttggcgtttggtttccttgtggaaatagtgaggcggagcctggccttagcagctgtgggggaccccaagtcctcctgcatgttaggagcggtggggcctcccctggctcctgtcacactgtgcactagctgctcaatgcagggaatggtgaacgtggcctggctctgtcctgtgctgtcaatcaacagtgggtgggtctcagcgagtcactttacccctggaatctcagtttcctcacctgggcaatggggatggcctcaaggaccgctgagctgattcaatgagatgtggaatattaagagccatcctcagtgcctggcacaccctgggcatttggtcccactgggacttttggttgtgtgccgacttgagagagatgatgctttggagaacaacagcattctctcccgaggaggctcggggtgatctgtccttttctctcctggggatgcctgggggtgatctgtgtttttctctctggggaggctcagggtgttctgtccttttctctcctggggatgctcggggtgatctgtccttttctgtcctggggatgcccgggggtgatctatctttttctctctggggaggctcagagtgatctgtccttttctgtcctggggttgcctgggggtgatctgtctttttctctttggggaggctcagggtgatctgtccttttatgtcccggggaggctcggggtgatctgtccttttcccagacaggatggggaaggaaggggagagtaatggttgtcgtcagagtcacgggttttgggaatgaattttgctgaatatcctccctccctcccagaaaaaaatcccctttagaaaaaagacgttttcccagggtgtccctggatgggttggtggccctgacactagcagggggggtcttgacatccagcctgaggttggcaaatgcctgcttggatgcctggggtgtgaaagtctttgtcctcagagggtggtgttattgactggcaggtctgttccaactctgtcatgaggccacctaagaggcgagacaggccaaggctttcaacaggttggggtgcaggatggggtcccctgcacaaggccacgcctgctccactgtgaagaccatcacagacagtagttgtctatggagcacacatacagggccggcctctcaggccatgacctgtgtcatcacacgtgacccgtgtcatcacacgtgacctgtgccatcacacatgacctgtgccatcatacatggctggtgcccagaagggccccatgcttgctttcatgttctgccatggtcatcttgaaattcatagtcactttgaacaagagcctgtgttttcgttttgcactggaccgcaagagtcatgtagccagacccggtcacatgttcattaccttgtgtgatctgagcagtagaggtatctgcccccacttggtagctgagtaaactaaggcttggacatgtgaagtgacctgcccaagggcttcacagcaggagtggggatgggggcagagccacctctgtaactccagagctgtgtccttggcagtggcaatcaggcagaatccctacagagaggggctggcaatggctggctcacctgagaagggggcactggctgctgggcccacacgggtgctggtgaatgctcagtctccccatggcctccgagaggaggccccgatgtgtggtcctctggtcttcctccccagtgcatcttgtcacccagggatggagggagtggcttcatctcctccacctctcccagcctcagtctccctttctgcaccatgggaggattctgggtctccggcgcggtaaagccgccgggccgcgatgctgatgctgaccttccctgcccctcctccagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagtaagtgggcctgggttggagggggcaatcacccctccctggagaccccatcccgccctactccagtctcttggccggccgcactacagtgggaccccatgtgagcttggtttaggcttccaatattcctctcccatccctcttgccctgctctgccactggtccccaacgctgggaagtacctggagcagtcatcgggggcagccctcagcctcgggcacacagctgtccatggtacagagttgtttgttttggaactctgcagttggtgactaaacagtggttttgtccacattgaaattcaagagattcttccttgtgtctaccccagatccctgcggctttaactcaaatctgttttgctctggccagattgcagaatttctcagtgtgagcctttgcctttcccccacagaccggagcatcatcatcggcccagaggagcctggtttgctggttctgggccggggattgtggaaatgcccaaagcccggctgctgggctgtgcctgggagccggagccctggtgtggggtgagggtgaggctttaggccagagcctgaagatgtggcccatcagttgctttaggctcctgggtatcttatgttttactaacacagggagcccacaccatgggtgagacataggagagatctgacattctggggcctggctgcctgaggccacgtgggcctggcactggggcttgggccctgccattctccagcctttctgctttgcccagctcacctgctcgcatcccctgcttggtcctgcaggggaccctgtatcaaatactccctgagaacttcagctgtggtttttctagccaggctcttaggagaacctctgctctcaatatttgacaagactttattttattttattattttttgagatggaatcttgctctgtctcccaggctggagtgcaatggcatgatctcggttcactgcaacctctgcctcctgggtttaagtgattcttctgcctcagcctcccgagtagctgggattataggcatgtgccaccacacctagctaattttttttttaattgtatttttattagagaggggtttcaccatgttggccaggctggtctcaaactcctgacctcaggtgatcggcccgcctcagcctcccaaagtgctgggattacaggcgtaagccaccgtgccccacctcgacaccactttaaaaagcatcacagaagcaatagtatggctaccatcaccgaaatccaggagggaaacaatcacctcagtggaatgtgaatcccagcatagctctcccgcctcccagctgaatcagttctaggccctgtaccgagtcagcttgggccttcctgggtttggccacagagtaggtttggggattttccatggttaccgatcacgagtcctggaaggggacaagcagggctgtttcaggacctgtgcactcattcaccatccacccatttgtccacccgtctatgaatccattgaatgtagtccgagacctggctctgtgccagttcacacctagaatgagatccagcccctgcctccgggagctcagggcctggttggggactcaggcaaggaagcctctgtcacacatgggtctgggcagggcttatggctgacccattcattcatttactcactcactcaatcaaagaaggtaattcttcagtcccgtttatatcctgggcaccgtgtggtgccggcggtatgatgaataccctctctgccttcatgttgctctagcgcaaagtgcaaagtggggtgctagtggcccggttttggggaatcagtttgggtgatttgggctgagtcacttcacttgactgaggatcagtgtccttgtctgggatcatctaagcttcctagcggggctgttgtgagacccagagatgaaggaaggcccgcttctgtccacacctggcctctgatgccctcattccccgcaggaggctgtctctccttctattcccgatgcccagccccatggctggcccccagcggggtcacagcccccagattagccactccattgtaataacaatctccctttccttcttgtcttttttcccaggcctgccaaccacaggtacgtggttcagggggctccggggctctggggctctggggctctggggctctggtgccatgtgattctggatatggggctggggcctgggcgcctggtgcttctaccctggcgagggatccctgctctgcctggcttggttttggtctgaggtcttgcgctggggctgcgtgaagcctggctgagctggtgtggaggagcaatgccctgggccagccctggggcagggtggctgcagcctctccagggccttgtcctctctgttccaacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagagtgagtaccccctctctgtgccctgcgttcgtcaccctcgccctcaccagccacagcctgggctgctcctacccaggcttggccctgtcttggggacccctacataggctgatgggtggcttggccaggaagctcttgctggttttgcagccccaccctggaccttaatgcagagccatggcctcacctgggtgtgcgcaggtgcatctcccaatccacacactttgctccaccttcacattggctgccacacactctgtcctgctgtgccagctacctggctgctcttcctccctcctcctacctgggccccctccctgtccatcctctgcccatccccagggctgattcttccaaatgcaggtcagatcagtgcacgtcatcccgccccagtggcttcccattgccggtcctgagggtgtaccacctgcctcactcacctccctctgccccttctctctgctgcagccatgccagcccctctgggctcctggatgggccatgctccctcccaccacgccctctccagcctgtgccttttgccaagtactctcctgccatcctgtttttgtctcatctgctcttggctcaaatggcacttcctcagagaagccttttcttatgccctcatgctgggccaggtcgcccctcctgtgctctcgagacctctggtacattttcccctttatgggtgattgatcggttgatgtctctcctctcagcctggctgcagctctgtccaggagcctagggtacggtgggcattaataagtgttccttgaatgcatgcaggatgctaaattgcagcagaaaggaaccctggtgcccgaggcatcttctgtgggtgagaaaggcactggggtttcacttccccctctgtctgctgtctgacccaggaggctgcctcatgggccacccacaattctggaaattctgagggagtgattgcaccacctactcttgccgtctgggtgctggtccgtgacagctgtgcccacttccagatgctgtctctttcctcagctctgctgggtaggaagagtcctctgccccacgtgccttcctcggaggcaccttctgccctggctcaactgcactccctccccgccgcttggggcacagggttcctttctgctggtcatgcggtctagcatccttcatgcactccagggacgcttaggggatccctccttcggtgacaatgatgtgtctgtggccgcattcctcaaaccagagtcacgtactgccagaccccttcgaaaggggaaagaagttcttgtggaacccttcattatattgttattcaaatatatacaaacgcaaaactccctgtaatcaactccttctgcttatagcccttgaagaaccataaaaccaacaccaaatcacaaattgaataaaaataaagctacaaaaccataacattcaaattaacagcattaatgtaatgtgatggatgatgttgttttgctgaaaccaatttgttcacagtgtggatgtggctcaggccctggtagagcaggttcctctgcgctttcgtgcctgtgccacagggtgccctgtggggatctgcatttcccatgagctccccagtttgggtcactgcagagcccctctgatgtgagcacattgtccacatcccaagctcgccatgctctttgcttgttaccaggtgaccattcaggtgccatagtccatggaagccttgatatcaggcagcagagtgtggctttaaactcattccacacaggtgactcagataattatctaaatgaaaaccccaaataaggcttcccctccactcccctggggcttcataagacctcagtgtgcaaaaccacggcctagagaatacagtccaaattcctagcccaggggcctagcgttcaaggccttccccatctggtcctcctggaccctcctgctctatctctacctgccaccccctacccccatctcacccttactccatctgtatcatcactggtgatctgggccccctcaccccatcactgtcccaccacactgatatctttctccccaccacctcctaccacccaccattgttaactgactgcttcctccgccacttgtcctgccaaggtcataagctccggaagaatgaggaccctgtctgtcttgtgtactgctgtctccagtctctagcatggagtctggcacacgataggtcctcaggatgtctttgaacaacttgctgttcatgggctgcctcaagccacagtgcctttgcacacgctcttgtctttctctcctggcagtgcccaccacacttccagccctatgcaggcccctcctctctcccaggcacagcttgctcttggtcttgtggtctcatacagccctttgtacagactgactatggcctggatctcaggtgttagactttactcttgaaaggatctggcttcccagctagtctgggcgctctggtcagggtaggaactggatgttactttctggaactctttcttttttttttgggttggagtcttgctctgtcacccaggctggagtgcagtggcgtgatctcggctcactgcaagctccgcctcccaggttcacgtcattctcctgcctcagcctcctgagtagctggtactacaggtgcccgccaccatgcccggctaatttttttctttgtattttttagtacagacggggtttcaccgtattagccaggatggtctcgatctcctgacctcgtgatctgcctgcctcggcctcccaaagtgctgggattacaggcgtgagccaccgcgcccagcctctggatcttttttgttgtgagcagatgcttggcttcttgttagcgccttcacctgtgcctgagttggtctcttctctgcccagataaggtgtacctcggccccccacgcctcttccaggagctgcaggacctgcagaaggacctggccgtggtggagcagatcacgcttctcatcagcacgctgcacggcacctaccaggtacgtggcctggcctgacctttttggcctgagctccccagtgtgggcagtgcctggattcagaaagctgagtagggaggggctcctctcctggcccatgtccccgatgtgctcctagcttctgagctcctgttggcaactgtcgctgctgaagctccatgtccctgcctggaagtctcttttgcggccgctggttcgggcgcatcctctggtttgggttgagtggagcctggctgtggggcctttgtttgttctctgcacagtggccattccgttatgtggcccctcctgggcctctacccagtgtggaggggaagctggctgcgacggcatgtccctctcagaggagggctccaggtgggatctgagcccagggctgggaagcctggggcatggcgagttggcctcctgcgtggggctaaatgtgcagcctcagtgaggctccaggacttcttcagtttctcttcctctggggtgctgtgattcctataggatctggtgtggcttttggggagccagtgtgctgtgtggtgacctcattggcctcctgaaccctagaacctgaacatgactgtggctcaagactggtgcctggccctgcagaggctgatgcgggtgaaggaggaagagatccactcggccaacaagtgccgtctcaggctcctgcttcctgggaaacccgacaagtgagaggagggggtcttggagggagggctgctgcctctgctgggcttccagtggagcaggggatccggagagggtacctggagccctcttatttgtcgagatgccatggtgggagtggatatgtaggcatcgtgggccatgtctgggatagcatctggcacgcagtaggtgctcatgaaaagactgtggaatgaatgaatgaattaatgaacagcctggtcatgtcctggataagcctggcccactgttaggatactcagacactctgccattggtcagttccatttgcgctgtgtccttttcagtcacttcagcctatctaggcccccaggccaggccctgggtttcctctctctggacccagcctccccccagcaccaccttagccccagaatgcccaccacaggagctgtgcacagtagaccccaactgaggtttgtggaactgatgacagccatagctgctcggcctggcagagacagggaacgggatctttctggtcctcctgaggctttgtaagttgggtctttttatttccattttacagatgaggaaggtgaggctcagagtttcaggagaggctgaaggccacatcgtgagagacagagctgggtcctgatgaggtctgactctgaagcccaggccagtgcaatgagggggctcaatgcccaggttttggcctccagggtggggtgaaggtggggatagagtgtcacaagcacagtggctgcaaggaagagaaggttggagcactatcatttgaggtaggaccatgggctcagtcccccaggggaccatgtgtaggagtcagcagctttgaatctgccgcctccctgttgagtggcctgtccgtctcccttcctccatctcccttctctctgcctctcattctccacgtgcaccctagaggcttgtgacactgccctgcccacctcccaaagggctgggaaggcccccactgctctgaggtgagaggacagcgtggtgacaacagcaacctctggttgccccaagctggtgcttaacctgattcattcatttcttcattcattcctgtgtccactcagcaaacatttactgagcaactgtcccatgccaggtgctgggaacagacccaagtgagacccattcctccctctagaggcacgtggtcagacatgtaaggtgtctaagacctgtggacagctgaccgctgaccaggtggagtcacagcctgcagaggctctgccgggcacaaagccagaggctcctggagccaggctggggagcgtggctcagccaccctggccaggtacctccctctgggggtcattgtgggcggagggattcctcccccaggggaccgaggctttgccaagccactgacctctttggccacgttttggggatgctctgaccagacctccttgatctccagggcgcgtgggttggaggaagtactacgtgacagctgggggagcctggcccttgtgtgggtactcacacatccactctaacccttctcaccacaggtccggccgccccattagcttcatggtggttttcatcacccccaaccccctgagcaagatttcctgggtcaacaggttacatttggccaaaatcggactccgtgagtatagccccagggagagtgcctcagggggcaggggtgtggaacggggaggtttggggtgagtgagggtacaggatgggtgttcggggtcagcggggggcagggaggcttctgagtgggagggaggtggtgcggtggagaaacagctggggccagagccggaggctctgctttgtgaccctggacaagtcacttcccctctctgagcctcagcttccccatccaggaattgatggaacttgacagaaagtaaattagtggttgccagggacctgagaggagaggataatggagaatgactgctagactgctaggggttttggtggaggtgatgaaaatgttctaaaattagatggtggtgattgctcaactctgtgactacaccaaaaatcagtggcgtgtgcactttaaaaggatgcgttttatggtaactggattgtatctcaataaagctgttacccagaaaaatgatgcaggttggactatactgattctcaaagaccaaagacctcgttactatgtttttcttcctgtgcaccccatggtatgaatacagatacataaatggatatttacatgcacttttctgagtattttttgtgcatctttttcatttcacattcacagtagccttaagagttaggtctgttgagaatctctttttccattgaggattctgaggcccagagatgtgcggggacttgcctgaggtcacacagaaggaaggggcagatctgggccgcagaccctgtgtggcctgactccaaagcccagtctcgatccccatccattctgcttccttggcttggcaagagtctgtctgcagactgcattcattaagttataattactttacttgtccattttttgagttggtgagaggcttatgtcccctccagacagagctattattccctatgatgtactacagttcccatttgccgatgccagccaatagcaggaacgtttttttatttttgtttctggtatgatctttctatagagaagcttacattttcaataggttttaacacatttatggaaggccgggcgcagtggctcacgcctgtaatcccagcactttgggaggctgaggcgggtggatcacaaggtcaggagatcgagaccatcctggctaacatggtgaaaccctgtttctactaaaaatacaaaaaattagcctggcacacgcctgtagtcccagctactcgggaggccaaagcaggagaattgcttgaatccgggagttcgagtttgcggcgagccaagatcatgccactgcactccagcctgggcaacagagccagactccatctcaaaaacaaaacaaaacaaaacaaaacacaacaaaacaaacaaaaagacatttctggaaagaagtcaggacctttggctgggcgtggtggctcgcgcctgtaatcctagcactttgggaggccgaggcgggcagatcacctgaggtcaggagttcgagaccatcctggccaacatggtgaaaccccatctctactaaaaatacaaaaaaattagccagacatggtggcgcatgtctgtagtcccagctactcgagaggttgaggcaggagaatcacttgaacctaggaggcggaggttgcagtgagccaagatcgtgccactgtactccagcctgagtgatagagtgagactccgtcttaaaaaaaaagaaaaaaaaaagaaaaaaaaaagaagttaggacctatgtcactggttttcattaatggaaaaaactgttgagactctacatagttttgggcatgggggaagaataatgacaaaaacagagagatctctgctctcaaggaacttagatttatgaggggcaggcaggtggacattaaatggggagcaaatctgcaagcaggtgttatgctgtacagggcatagagctgggctggggctgccatctgggggacccctgaggcggggtcctcagaagctgcacaaatatctggtcagagtgatccaggtatggggatagcaagtacaaaggccctgaggtagggacagaaggaagcccagagtggccagcactggcagatgaaggggagggaggtaggtgggtgtgttgcgggcaggttttctgggaagccggggagagccgtatgggatttgttctgggcatgatgggaagctgtgcattatagcattgagagctggatagtgtcccgatctgattttcatttaagtgggtcattctggctgctgtggggagagggcatgggaggggcaggtgtggaggtgggagcaggaatggggaggggttgcctgtggaggaacctggaccagaggcttctactcagcccatcccttcttggatccagtgctgatattgctctgacctcagctggatgtttctgggtgaccagaaggcctttggagggtgcagaaagtgttttaagcagaagctgtcctgtccctggcagaagactttgggaatcctggccctcagaaaggctaatgtggcttccctgccccttgggccatgcgctcccctccccaccccatgcatcacttccatcctgagaagtgcccgagccccatgttacacctgctttaaaggcagatgaatgtcctgtttgaaccgcatgtgctttgctgcatggggcttggtgctggagggatgggagacggtgattcgggcagccccagctcttggcagcctgtgaagatgctgggctgccttatctccacacagcttcactgcagcaaaagttttaatggaagaagagtcatttgaaatcttatttgaatgcctgggttcccctggggcttgaataatttgtttcttttattttgccagtattttttttctttttatctgcagtggctggtttgggaggggatgataatatgagcctgttagaaatagaatatgttaaaaacatttattcacaaaggctgttattcctttattttattttctatatcttcctccctccctgactacagtgtgtcaggatcataatctgaagattgagaaaggagagggatgtggtgggggagcctgcgatctgggagaggggatcagctctgccccttggaagggcagggagccctggggaatctggggaccccgttcaaaccccagcatggccaccaccacgccttgtggtcctgggaaaggcagactccatcctgagacccagttttcctatttgtgagttggaatagatctccaagggccctgttgcattctttggcacacaggaaggtttgagaggcagtaaggggtggtcctcagcaccatgggaaatggagctagaccatgtgggttccgttcccagctctgccactgaccagctctgtgatcccagcaaactaactctgagatgccttggattttccaccagaaaacggggaaaatgccagtgccccctgcacagggctctcgtgaaaatgtggggagatggtgcatggaagatgcctagacagccagcccttggcacataggagctgtgagaggggctcctaggtcaaggagtgtctgcatttcagatggggaatggcctttctgaggtcacacgcgatttagtacagggccaggatatcttcctacctctttctaccggttaggctcttgttggtaaaagctccagaacagggctgcagatggaaggtcccagagaaggaagaggtgaggtagggggctccctcatttccctcctgtaccctcccccgccaccacctgctctgctcacaaagctgcattgctgcctcttaccctccccgggcccttggagctcctcccacccatggcccttctcattcccacctctcaaggggacatgggcctggcaggccatggctaatgccaaactcacagggacataaccaggtggcccaaggcagtgagcctgagcgcagggctgggccctcccttgctgcctctcatttggtttagttttccggcccatagtcgtcacactgacgccaatattccttccgggatgactccagctgttgggtcctgagcacagccctggcagagtgtgaagtgtgttctagacctcagcatgtccttgaaccctcactgctgtcccacaggctggtgctgggatctgcccacaccctgcagctggaagggatgggtctcctctccaggagtagggccgagggcgtggccttggagtccgaccctggttttaccccagctgggagactgtggctacttgcttggcctccctggacaccagtggccctctctgtaggggacaggtggttggatgagatgcctgctgaggtccagcccagcctgacatctgtggctgtggccagcagcatctccatggtgctggggaggtgtgagcggtatcttgaaggtggctttaagtttgggaagttcgggaagagcagtaaaggcacgatactgggactgagcccagtaggagtctgggaggcaggtcgggctggagaagcagggctgggcccgcggtgggctcagctgccctcagtaatagcgacagtcagaccatgagcagcgaggacagtgaccaccatggctgctatttccggagtgcctggtgtctgctggtcatgatatatatgatttccagtgctcacaactccagatggttggcgttccttcccccattttctacatgaggccacaggctcagagagggtaagcacttggctccgtgtcacatagtgagttggagactgaggtgggatctgcccgggcccttctagcagatcagaggggattgttctgagggtagcgggggatctgcaaccctggagctgctccctgtgtcccatggggagctctcatgcccagggggtgttggcaaacagagctgggtgctaaataagcccccacttagcgtcaactggaaattgcggttctgcagtcggtgccagttcttaatgtcacttatcccaagcgggctttcaattttcagcgacagcagtcttctaatttggtctccgccactctggttttgtgacgggaacaatggcagtggcagatggggagcaacgactccattttcttgtaacgtccccagtcgcaggcagggaaggcaccatctggaaggagaaggtcagatcattaaaaaaaatacgtatgaataaattgccaggacttgatgggctatgggtgttcggggaggaaagagaggagctgagctctgggcgccctggtgacaggggctagggtggggagatgctcgctcacccagctcctacaggttgtggggtgaggaattgggggtccagaccagagctcttggctggtagaggtgagggtctgcttgattgtaagttccttgagagcagggacaagctctcaaatctggcctatctttatttgctgcccaggggcttgtccaagaggcagcatggcgagcgctggcacactagcagaggctaggagagccgtgctgccccgggacaaggtgcgtcgcaggcaccgtgcaaggcgcccccgtgggttagttccttggcatctggatcttcccctgctttcccctttcctctgctggccagcgtggagtgcggatagaaggacgtatctcccgtgatggctgtgaggatgcagtgaggcagtgtggaaactgtgaggtgcagggcacgtagaagtgtctgttatggcaacgcgcgtgccctgtgtggtcgtgccctttccctgagggtctcttatgtaggcctttcctccctggtggcagggatcaggtcttacatgactctgtttccagggcccagcagggtagaggaccagacatggaggatgcctctgggcccatttcgggaatgagttcactgctcagtgactcaggccggagggtgtgagcccgccgggtgctggcgccttcacatcatcaagcctgacatttgggaatgtctttcacttctcaaatagcatcctcacctgccacctcattccagctcctcttgctgtgccagcattcaggtgccacctctctcgggcagtgacggcatgagggctgctctcagggtggtccttcctcactcatgtccagcccttctctctgacccggcaggatctctttgatgaaagcgagtcagattaacgttcatgtcgtgggtacatctgacaaacctggaaaatgaggctctgagaaaagagactttttgttcatatccctaaatgtagtgatggtctgtggtgggtccagccctgcgtgggtgggttgggtgaggtgtagaaggaaatagggtgggaggtttcggccttcatagaacactggcatggtgggggagcgcctacctccatgtgcacacacacgcacgcgtgcacacgtgcacatgtgcacacaacgaagaagagccacactggtggaggagcagggagtagctgtgagaggtgtgataccctccaatgggctgagacgacaggtggtggaggccagggcatggagacatgggtggtgcaggcctctctgagaaggagaggagccagccctggggaggtgaggggcagcgttccggacagcgggaacctctgggcccgtcccggcgaggttgctgagcacagtccagcacggtggagccagtggccgagggaggaggctggggagggaagggaccttcgcagctcttccaggagagtttggatcttattctgggctgactgggactccactgatgtttccaagcaggggaacggcgaggccaggtgtaagttttagcaggatgggcctggctgccgagcaaagatgactgtagtgtcagggggccccagtgtggctggcgggaactctccggctgacctggcgcctcctaggggaggggcaggctccggctgcctgcgacagagctactctagcatcaccgtgcccacaggcctctgcgatggagcatcagcgggcgcggttgctgaaggctgcctggtttagtccagagaattcagtcttgggtgtcagatctaggcctgaatctgggtgctgccccctagccatggctgtggcctggccacgttactaaatccctgagtgccagtgtcatcctctgtggagtgaaaataatgattctggctgtgctcagcgattgtgaagactaagccagggcatagacggcggcgctcagtgtggtgcctgatgtgtgggtgcatagtaggtggtgtcttcatcacgctcatccctgctgtgggcttgctggaagggagtcctcatagggagtgtaaagaaggaagggatcctccgcagggagaattcttcaggacagacggtggtttattcctccctccttccttttattcattctttccagccatgttttccgagcactcgctatgtgccttgcagtgtgctgggtgtcaggggacagtggtgaatgagacagtgcagacccccactgactacagctttgatattagagacttatggaaatggaccacggatgattttagatcattatgaaggctgcgaggaaagtaagacagggtctttagagtgattcctgagagaaggggccactgtagtcagggtggtcagggaggacttctcggaggaggggacatgtgagcagagccccgagccatgtaaaggagcctccacagagaacgaggtttagcagatgctctttagcatggtgacctcccgtggtgagtcctgggtctggggtcgggttaggcatctgtacttgtaacgggtccctgggagctttgaggcccagctagggtgggtgaactggaggcaggcggcttcctaatttcagggttgtcttgaaggaagcaggagtgtgattcttctgcatttccatcaccaccatggtcaagtgtgagtgccgcaatggcgacctcctgtcctctgatcgttcatggtctgtctcctactctgcaacagaaattcaaggcaacaggggtctggactctgttcagcatcttaacattttttaaaaacccttttacatctattatttcatttggtcctcacaacaaccacaggacgaaggcatttctagcattcctattttctaggcaaagaaattgaggctcagagagttggggtgactggcacagggttgttcagcggtagggtggtcaagctgggaccttgtttttcaactccctgcctgagaccctggccacggcatcactcctgaggctggatttcatctcagtccggcaggagtagggtggggagtgactggatggggccaggcttctggggcctgcagtggctccctggggcttggagggctcctcatggcccagttggtccttggactctgaccagctctacccacctccttcctcttgctgtaggggaggagaaccagccaggctggctatgcccggatgaggacaagaagagcaaagccccattctggtgcccgatcctggcctgctgcatccctgccttctcctcccgggcactcagcctgcaggtgagtggagcggatcttgctgagccgacctcgaaggtggctgcggctccccctcgcctgggagaaccagagtttccagggagcgcccacagcagggaaggctcaggttccagctgtggcttctaaattcttactgacagatttggtcaagcctttttgttgcttcgggaatcagctttcccaccacaaaaatggaggcgaacgaccactgtgggtcaagtgaatggaaaattccattattttgagataataaacagcaatgatctcatctgttgatggcatggctccagatcatgccgaagcggctgtgccagccactgtgggttgggtgctttgtggttcgccaggcgggagccggctttggcgcagggattgccctcatcatggaatgctccagcgccatcaggcctcccgtgtattgagcacctgctgtgccccctggttctttcctgctattctcttattttaatatctataagaaccttgcgagtagatgtttctctatccatttcacagataaggaaactaaggctaagacaggtgctatgattttccaaaaaggacatagctagtaagaatttgaaccttgccctgcctgatcacaacacccagggtcttaaccatgaggatgttcagccttcacgggttacctgcccttataccctgtcctagctcgccctccatctagagcaattactgcctcccctttcccagggagatgaggtcatctcagctccagggataggagcaccagttggggacccaggcccagattggtgagccccaagagatgcgccgattgggctgtagactggggatctaaacagctgaaagaacaaatccttgagatatgagttcatttgttcacttgtccattctgcatgcaattttctgagcacctgttgtgtgctagaccctgggaatacagtggtgactaagacatagaaggtcccaacccttatgtagctttgaatcctagcagggagagagagaggcaaaaccccagcaagccaaaggaaatagaaaagagtgaggtgtgtaataaagacatcggggccacagtagatacgtgggtgggctgaggttcagagatggcctcttggaggaggtggcatttaaactgagaactgaatggcgagaaggattcagcccagggatgggaacaatattcccagtagacaaacccacacagagggtgcagcagaaacagtgggggaagccaggcgaggcaggaggagagagggcgggccccgaggttcgctggtgggtgagctggaccacgccagccttgcaggctgggtcagctttggattttgttctcagagcagtaaaaagccttggaaacagatgtttcccaagctagggactagcacaatttgatatatagttcgcattttttggatccttctggctggtgtgtgagagtgaattgcagataagaatggataccgggactgagcgtggtggctcatgcctgtaatcccagcactttgggaggctgaggtgggagggtcacttgagtccaggagttcgagaccagcctgggcaacatagtaagatccccatctctacaaaataaaaataaaaaaaaattagccaggtgtgccatgagcctatagtcccagctacttgggaggctgaggtgggaggatcgcttgagcccaggaggttgaggctgcagtgagctgtgattgtaccactgcactccagcctaggggacagagtgagaccctgtctcaaataaataagtaaataatacaaaaggactggatgtcggctgggtgaggtagctcacgtctgtaatcccaggattttgggaggccaaggcaggtggatcacttgaggtcaggagtttgagaccagcctggccaacatggtgaaaccctgtctctaccaaaaatacaaaaattagctgagcttgatggtgcacacctgtagtcctagctactggagaggctgaggtggaaaaaacacttgaacccgggaagcggaggttgcagtgagccgaaatcatgccactgcattccagcctgggtgacagagtaagaccctgtctcaaaaaaaaaaaaaaaaaaaaaaatggacctggagggagcagctcagagctcagctcagggtcctgctgagacgtggcaagacttgatgtgggcggaggccagggctgtgactggagtaaggcgcctttgcctcaggcacaaaatttcagccgatgtcaaaaatctcaataattaagataaatactattttaatgcagtgcgtaaatataatcaaatcagcaaatttttccttgtggtttggccgctctttttgtctcttgatacataaagggccaggattagggtgaggcaagtgagccagggtcgtgcaagtgtagggtgaagttttgtctgtatttaaacttttaaataactattcagtgtggattttttgcattaatattgatttttttaaagttgccttactctctctctatatatatacatttttgtgactgagtttttggtgcccttttaaattttgtacccaagctaggtgccccagtctatcaccctagtcctggccctggtggaggccgtcggcaagggaggtggacacattggggatgtgttggggtgggacaggcttaactggtgatagatggcgtatgccagatggggggttacctgtgggccctggggccttgggctggaggcagcgaccatggagtagggagtatcagggcccactgtgcctgcggccagcttggccttagcgcatccctgcagaaggctggccctgggtgactttatggtgggcgttggattctcctgtctcccccagggccttgggtctcttgagagcacaggatgcaggctgagccctgacagatcagaccccagtggtggagtcacagaactggccactgcctccaaggcctccccaaaagaaacccccatccaggtggggagcctctgccacctcgaacctggggaaccagggcccacgaacctcctcagtgcgagctctcagggcccaggaatatgtaggccagaagcatcctcagtcctgctggccccggctcactgtctccttaggagcgccagggctagtggagggaggcgagtgactctctgtggtaaggggcctgtggagctcccagaagccagagcagagcctgcctggctgcactagctaggcctcaaatcgctgtccccctctgcccacaccctaccccaccccaccaccagtccagacaaatgtgccccatcagctgtgtgctggcagcctgatgaaatagggcctgggagtaccaaggccctgtccaattactgcagaagcagatgtgactgtgtgaacctctgcccaggcccccttccagctcaccacgtttccaggtggtcctggggcagggggtgactccagctctggctggcctcatggcgagcagtggcccagactatttgtctagggagggcttgggctgggcagagggagttgctggccacagtgtagacagggtcggcactctgtaccagtggatgaggatgtgttgggttctttccttcaagggatcaggggtgttggggcaggaggcaggagtaggtctcttgtctgtgctgacagtggcccctgcccacgctgggccacaccaaggccttctgactcaagggaatcagttgggagtgtgaaggagcatcagcaggggccacctgccttggattgagtcccaacagtgtgacatcaggaatgctgcctcagctcatggtatcttaaactagggtggtcacagcaccttcctgactgggtcaccttgaggattaaaggatatgatttgggtcaagtgcttagccagttgcatggggtgcgctcaggggtcaagaaacagaagcaaacacctgaggacaccctggtccccaggaaggtgaggacaccggagtctattctgtggcatttctgaacgcctgactactacggtgtcgaaggttcttcttggacccctggctccatccaagggggaatgctgtctctggaggggtggcaggagggcagggagggttcagcgcaaacccatttccctgatggtcagtctcagagcccacctggggacagggccttggggatggggctgggggtgctgcctgctctgagatgctttaaaactcgagcaccttgggagcctaaggggtgtagcccagacccacagggggtctgtggccaggcttgcttaggccaaagctcacaagctcattgggctgtgtcttgaccttcaccaacctcagccagaactgctgttggccgtgtaccctgtctcctgctcatccttgatggctctgccctcatagccttgctctgatgatgaaatgagctaaggtgtgtgaagtgctagaatatcccatgagaggcccttggtaagccttagtagctgcagggtactgggtacctggccctgggccgggtgctttacactttccctctccagtccccacggccatcctgagagatttcagggtctctgctctgtaggtgaggacctgatttgttcagtaccatccagatggtaaccactgagctggggctggagccgtgttggctgtacctaaagctgcttcccttcacagcttcgtgctcccctcctctcttctgcatagggtgccttgacttcccagtttcctggcacaggcaagacatttaggggctagggccttgcctgtgaaggagaggagccatttgagtattttccaccatcttcgacccggctctgttgactcagctgacatcagggcccactggagttgccatggaaatgcctcagcaggggctgccgtggcctcgtctccaccaagggagcagagagagcatcagcccagcagaaagggcatgcaccctcaactagatgctgccaccaggaagcagagaagacagggagcccagaggccgggcttagcgaagccccctgctctgaatgtgaggacacactttttcagcaggcagaactggggccccagagtgccaaggcctctggtgtgcagccaggcttctggggtaaaattcaaccagaatagaaagagccctgaaccagatgttgaaggtttgaattctagccctcactctgccactaacatgctgtgtgacattgagccaggcacgcctccctctgaccttcaagttggcatctgcgcaatgaggaggctggatgaggtgacctcttagggccctcgcccatggccattagaaattttgttagaatattctaacaatgggtccagggacggctggggcctttagcaccagcagagggcagcagctgcctggaaaagggcccagtggtcggctgcatcctccttccagccaagagcagtctctactctgtcttctccttcagtgtggcccatgagtgggccaggccatttcctagaattgctgtcctggccagagagagggactgaccaggtctagctcaggagacaggcctcagagagaggccacccaacatggggtctgtggcagctgattcaggggggagcaggcggaaggtggttactggtgacagcggtgacaggctgagccctggtttctgtgcgtggccctcacaagccgcccagccctgccactcacctcctctgtggtctagggtagtcacctgccctctgtgaccctcatttccctgtttgtaaaataaggaggggtgggtggctttcaagaaatcttatctgaaagctgctcactttcagagaccctgggctgatacagagcctcttgcaggcctcttctagccggaaggttctaggaaaggaagaacaaatgtgagcgtgtaggaactgcctggagaagcaggcactcgtgaagcatgttgctttcctggcccccacccacagggattctaatccagggagagttggatggggcccaggaatctgccaaatattggcatctgggcaccttgatgattaacctcacatgtaccgtctctgtctctgcagcttggggccctggtccacagtcctgtcaactgtcccctgctgggtttctcagcagtcagcacctcccttccacagggctacctctgggtgagtcacccccctgcccagctgggcattctggcctcaggacaggagtagggagagcggcacctgggagggggtgctggagacagcagctgcctgcctcatctcatgcagcttcatccaccaaggtcttcctgggcacctctggtgccaggcactgcatttggagttgggaggtgcaacctcatctggggcaacagaaaaccagggagctaaaaagagagtgtgccttttgcaaatggtgacagggctgagaaggaagtgaaagggggagctgtgcagaggacctgggtctcaggatcttcacccctggagtcaggaggcagggctggctagtgccctactcatgcagacattccagcccacctttctatccttgggcttcctggcaaagcctcccttgattcaagtgaggtaccctccactatgttccttgtgctgcaaattgtgccctgtcattgctgcttcccttctgagagtgatttgttcctcatcatttcccatgatctagcacatggtatatccatccatccatcatccatccatctatccacccacctatccatctatccatccacccacccacctacctatccatttatccatccaacaagaatatatatttaatccatccatttatttatctgtccatccatccacccacccacccatccattcattcaccgatacatccttccatctatctgtctatcatctgtccatccatccatccatccatccatccatccatccatccatctatccatccatccatccaacaagaatatattgagtatgtatctatcatatgctagacacagaggtaaaacaatggtcaacacagagaagggcattttaaagggatggagtagatgtttactttatattggttgaaatgcaccctgcagaggaggaaatagaaagctgactgagtatttagtccaccttagctccttacctgatttcctgtgggccctgaagcttatttgttgccatggcagctggggataaatgacctttgtgaaggcaggatgtgtgtgggcaggagaagggatgcttctctcaggggatggggtccttgggaaagcaggggctgaggtcctcctctgctccctcctgtggttcccacctgatggcctctctgggtctctgctcccaggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcaggtgaggggcccggaaggaggggtgagagcagcctctgcagggctgggcagtgggtgggggctgtccctgtagccttccggatctgcctgttgcccaccaacattctctgcccctggtctccaggaaggtgggcaccagagctgcccagtgtgggagccaaagtgtcgggagcggcctgcagtgcagttgcctggctcctcccaggcagaatggctggctcttttgcctccctgagtcctcttcgtgacagaggtgtcagggagggtaccgtcccagaaaaccatggaaaagtgagctcccgcatggtggagctatggcctggccacacagccgaaaggcgtggctgagaggggtcagctccctggggccctctccctaggagggcatgggggcagtgagtgggtgggagtgctcagtgtgtcatgaccgcttctccaacctctccccgcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggtgaggactggggggaatgggggaaggggggcagtcctggatgccagctgggtgccagattctctaccaagagaggatacaggaggctgggcaggaatgaattgggaaatctcagtgctgagggcatttggagatccgtgagccccgctggggttcaatgggtggtcccccatatgtgaatacctgctggaatagggtgctcactaccatgtgggcagtggaacctgttgacaggagactgtagtggataagagaggtactcgcaggttggagagacctggcttcccgttcaggctttgcccgatgacagctgtatcccttgttgcgtggcctcccttctttggtgcctgggactcttcatgagaataagggcagtgcccaccactcatgggtcctggagggttagacaactccatgagggcaaagcacagggccaggccaagggctcagtggagtcaagtatttccatctgggttgttttattgagccatccctagcacaggttacgatgtcaggagggcaggagggcagggctaaccgtgtttggactgctgtgctccagggcaggggtaaagtgcttaatgcgtgtgtgttatcttaattctcatgcaccccttgagaatttcctttgctttactgagatgatgctgactggagaccagacgcaccttctccccagccatgtggagtgctgtggtccccatcctctgggcttgttcagccccgatttgatgaagggggctgagtagagagtgtagccagcccccagtcccctggaaggggcagaggagcctgaagggcccgcagcgtctcttctcccctgccttttccgccagccaggctgtgattgccgcgtcatcacagcctgttacagggttataaacggatatttgtactgagctaatttttttttttttgccacttggcactgtgttggtatttttaattagcttttgataaggcatttatagtttttaattaaagggggaagagggagggaaaaaacccttctcaccgtcagacagagcgtgcatgtgaatgtaaatatgggctcagatctgcggagactcatggggagttctagagcgaccactcccaaccggctcccacggaacactgtgagcccggcctgtgccaccctggcgctctggtccccagcttgggttggctttggcccattccctcttactgctcgattcaccagtttgggcacctgggttggaaggaggtgaggctgccctgacaaggaccacaaatggcagacatgtagcgtcgcatatcctagaggctggaagcctggggtccgtgtttggatgggtcatgtgccctcagaaggcactagggaagggccttactcccagctgcttcaggtgtttccttgcctgtggcagcagaactccagcctctgcatggtgttttccctggctgtgtgtctgtgtgcaaatttcacttttttatgaggacacaagtcatattggattagggacctgtccctctccagtatgaactcatcttaactaattacatctgcaatgaccttacttcccaaggaggtcatattctgaggtactgggggctgggacctcaacatacagatgaggaggcacagtttaccccaaaacatggggtttggggtccacccattggcttctagtctggggttggagcctgttagtcaggaccaaaagagccactgggaccattgaaccccacgccctcattttctggatgggagcagactgtccagagccccctgactgagctgaacctgcacccagtaccctgcctcccaggctgagctctctgcagatgtgagggggctttggcttgtccaggtagagtggaggacatggggtctgaaggctgagatgttctaccagctttcctgccttgcaaacatgtgtgtaccaaacgcttactgagcacgtactatatgccatggacacagtggtgagcaaaatggacaggccgcctgctctcatggagcttacagtctatagagggagagggaatcggttagtaaacaagcagaagtataagactgtacatgatgccgagggctccgacggaaaggaaagagtgttgtgtgagagcctcactgcccaagtgtggggcaagctgtgctgcaaaggcctccctgaggagggggatcctggggctgagatcttaagaagccaggcaagtggagagttgggggaatggtgttcttggtagagggaacagtatacgcaaaggcccagaggcaggagaatgcttgatttggtgggggaacccggagaggaagccattttgctggacagctggaagaggaagtggcactgggcgtgacccgggggcagacagagctgtttgcgagggctccaacttgtctcagtgtgtcagggagtagagaggcatgttagaggtggccaagcactgggttccctctggctggtagacaggaggggaggcaggttggctggctgggaggctgaggcaccacctgggcaggtgaatttggtggtcacgctctcccagtgaacctactctctgggtgtccagtttggctgtggccaaggaggcccctgagaaggggcttgccttacctggtctccccacccgtacccagtggtatctttcagaggtggcccaagcaggcagctgtgttctcaggacctgctacatggtatgtggtgggcaggattcacccccatcaccttccacctggattacatgcggccaggtcttgaatcatccacctggtccgtgaccagctgtgggactggcatcagcttggccctcatccagattcactgaggccttagatacccctcagatacccccacccatcccagcagcagagccagggcttggaactgcacccgcatcaacctcgcaggctctgtatcaacctcagaacccaccatagtggccctggtggtgtggagggtccagggattgtgaaaatctagacccctcatcttcgtctagaagcaggtactccatgaaatatttgctggtgtttgaagtgacatgttcactgtcctgccgggttaggctgagaccaagactggcattcctgctaaaactggcattcctggccatgctttggcttattggagaaggacaggaccagacacatataggtctgtaggacagaacccacagaaccagcagctgagagtagactgtccaggctccagggtgaccaggccacgtggaggaatggactggcagagctggagtggcctcagagtcccacctgcagctgagagacagggaaactgaggccaagagcaatgtggccatggcagtcactctgctgtcctcaggagcatctgcttgttctcattcattcattcactccttcatttgctcaagaagccagtgcccctgaggtgtcaggcatgcagcagggtgctggggcccggagctgagacagccggccactgtccttgctggcgtgctacctgggttctcccctgcctctgagaaggcacaagggcattgccacgccttgggtggggatgcgggactatccctggttgggcgctggggctgtggttcggagtccccccttgaggaggcagatggcataatgggtaagggatgggttgggcatcaggctgccgggattgagtcctcactgtgagagcttgggcctttcctttgcccctctaatcctcagtttcctcacccgtgaaatgggggtgtggacagccccacttcatagaatggttgtgaagggtagacatggcaattcccacgagtgccgcgacacagcctggaggattggcacctcccacgtgtccctttatcacagtcatcatcatcacagtcgctatttactgtcaccaggcaggggctgccctttgggcccctctcagccgtgatgactttcactctgggacctgctctctggctccagcccaatctcgacccctgagggagacccaggggctttctccactgctggctgggggaggagggatgccagcctcctgaaggtgcctttgctgagacagggccttcatctccctggcgctggccacaagagctggtgccaggcccagaagaatgggctgtcatacaggggcaggcttgtgcgtgtgggtctgttttccagaatatgtgcgtgctttcccacagccactggagggtaaggtgaggagggggtggaaagggcggggctcccatcaggcaggggcggctctcaccagagctcacagcaattgggtttaggatctcagaatcacagtgtgtgagagctggaaataatctcagaggacagagttttgtcctcatggtgcagataggaaaactgagtcccagcaaggggaagtctcttgttcaggatcccaccatgggccctctactcagggactcctgtccagtgtcccttatgagcttttttctgagacagagtttcactctgtcacccaggctggagtgcagtggcactccactgcaaccttggcctcccgggttcaagtgattctcctgcctcagcctcccgagtagctgggattacaggcgcacaccaccacacccagctaatttttgtatttttaatagagaaggggtttcaccatgttggctaggctggtctcgaactcccaacctcaggtgatccggccgccccggcctcccaaagtgttgggattacaggcgtgagccaccgtacccggcctttatgagttttttgatctatcagtattagcattattaaatttgatcacagttcatcattctgccctggagtcgacttcttagaggatttctggagactcccagcaaatgcaggaatggcattcatgcagtccttagggttttagaccctagctcctaccctaggcttccacagcgaggctctgttccaggggagtggatgcaagggctccggtggctatcactgttggatagagccccactttccagttttgggggggtgttttctcagcatccctagctgctttttccctgggaggggtcccagcccccatctcagccatagcagcctaattagactccagcttccagccacgaacactactcacctctggccactggggggcgctcaaagccttgcattttcttggctccagcctcctgctgtggaccagcatccctggcggagccctggccgccttcgggtcactcgcccctcctggacaccaggcccagctgcagaggccttcagaaacctgagagggcagtggggttggagaagcaggccaggcccagagtcagacagagccgagttcaaaacccgtctggcctgtcaccccttgggtgtctttgtgcaaggccttagctccatgggtcgccgttgtcacgttggttaagtgaagtcaacacttgcttccacacactgttgtgttgtggcaaatggcatcaaacagtaagagccacggacacagactcctctgtagctgagtgaattggggtagttatttaaactcgctgtgtctcggttgtctccgttatgaacagggataataatagtatctaccacacatgcttgttgggagttaaggaaataattcaaggaaggagggcctggtgtgcggacacagaacgctgcgtaacaaccgctgtcaagaccctgactgtgtgcccagataaatattcttgcatattgtattgactccctgcaacatccggagaagggcaggcgtggttatcatgcccagtgtgcagataagggaaactgaggtccagagaggcgaagcccccgtccaagttcacacagaagttctgaggccgaggactgccctgctctgcctgcttcccttggtgctcacgctggctggccgggcagagcgctctgtgtgcctggaggtcgaggggagtccctgttcccctgcttctttgcggagcttggattctgcccattttaagtagggcataagggcagaaggggaacctgttttatagatgggaaagaggtggggagggagggaaaactgggcctggcagagcatggggtaggccagggtatggtagggaaggatggggagggggtgggagtctagtttggctcttgtgaccacaccccagcagtggcttccatcacgtaccctggggcccttccggctttggagacagctgtgccccatcgtgccaccaagcagctggctcagaggggaagggtctgcctgtgatgggctgctctgtactcttaccagggacccagtggagggcaggtggggtagcagggctctgacaagctcacagctagctgtgtcctgccttctagtcccccgccactgctgcctgtctctccagagcatgccatggcccaggctgctccaggctgggacccagcttcctcttcaacccccctttcccacctggcaccctgacaagacagggcagccaccggggttctgtgtggcatcaggtgtgacttctgagaagaaacaatcttggcgcgcgccgcttggatgccggagaaaatggttcttgggtgcgctgatcatcccaggggaggggaggaccttgcttgggccaggctcctaggtctgtttggttttcagggatggccgactggggattcattgcctctcagaacatcctctggatcaggcacggtggctcatgcctgtaatcccagaactttgggaggccgaggtgggtggatcacttgaggtcaggagttcaagaccagcctggccaacatggcaaaaccccgtgtctactaaaaatacaaaaaattaactgggtgtggtggcgggcgcctataatctcagctacttcggaggctgaggcaagagaatcgctggaacccggggaggcagaggttgcagtgagccaagactatgccactgcaatccagcctgggagacagagtgagattctgtctcaaagaaaaaaaaaaaaacaaaaaaaaaccaccctccacctcacctggcagcagtggtgtttctggaagagaaagagatcttggtaaatttgacagaagtgccttggagtcggccagaagattcatgagaaatcaagattcagtctagataagctacagcatcagaaaagtcctcagagacaatcttgtcagctccccaccccattttacagatggggaaactgaggcctcgtgaagggtagagatgtgctcaaggtccttagcaagttagtagtagcagaaccagggccagaccccaagtctcccgattccgggtccaggacactttccaccatatcatgctgcctcttctgagaagcctccctggatttcccctggtgcagagttagttccttccatctcagcagttctcaaggcccttgtgcacacctgctcatttgtgcttggcgtgtcatgtgataactgttgattaacctgttggttgctctgaccagtggggcttcctagagggcgagacctgtgtctgattcctttctgtcttcccagcacccagtgcatggcatgggtggagtaggtgcttactgcatgtgtgcggaatgaatgaatgggagagagggaaagagagagagaggcagggaagggaagggggaaagagaatggagggaggaaggaagggacgaatctgagagtaggggtggctgggtgtgggacatgaatggtgggagtcggaggcagatggggacagccaccacccagctgatggagagagaaaggccctggagagcggggagagggtgtggggggccctgctgagccccctgctgctggcctgcgttcccaggagacctgcttgccgctcctggcccctgacctgcctcccctctctccctgcaggaggtgtcctgtgggacctggagagccctcccgtgtgcctgactgtggggcccgggcctgtccgcaccctgttgagcctggaggatgccgtgtgggccagctgtgggccctgggtcactgtcctggaagccaccaccctgcagcctcaggtactgcactatcctttggcttgtggccctggaggcctgccttccttttgctgaccctttcttatgtccaccccggcaccgctttcagctcccagtggcattccaaggatcgattgggcagagtttgtccggaagcagagggggcccaaggtccctattgggcctgacctcttcctctgccacacatcgccaaggctaccaagaacagaaagtgcccagctgcactgcactgtggcctggatcctgagttgtgtcggttgctgcctgtggaagtgggattggggtccctgtccttggactggtacccaggacttgtacccacagagcccgggcaatgctgagggtgtggccagggtggatgcagccatccgctgggctcttcaaaccacatggagggagaggctgcctgggtcctgccttgccctggttccagcactgcccatgccttggcccccaggatgagggactggtctggggggctcatccctggctcagcctaggcccgtgcctgtctctgaccaatagcactgcccgctcaccttcacacctgcagtccatcctgggcgggagactcagcatggttccccaagaggtattttggtgatatttgatttgtttggattatcgattgcaatgagtcgccacctggcctggagtggagctctcccagggcgctccctcatgaggggcagtcttcattcgcctgcctagttctctctcatgcagctgtaaatcagctgctcaacagcctggcagagacactaagtggagtcctgggatcttaagagcacagatgatcagggctgggctccagatgacacaactctcatttgacaaagggggaaactgaggcacggggccttatggatgagctctgagactgggggctgagtctgggggatgtggtccgcccctttccctggcttgcttttctggtgttgtagcagcacagaggtgttgtcgttggagccggacctaccagaccgtctttcagttctgccacttacatctgggcgcctctgtgctggctcccgtgggagcacgaggcttccagtctgtaatgggaataagtgtcccgttcctggaatccttttccttactgtatcagtcagggttgtccagaggaacagaaccaatggaacgtatgtgagtgtgtgtttgcgcaagtatatgtatacacacgtatatagaaagagacttattataaagagtcggctcatggggtgatggaggctgtgaagccccagcatctgtggacagcaagctggagacccaggcgagctgccggcatagttcagtgtgaatacggaggcctgggaacctgtgagccggtggtgtgccttccagttcaaaagctgggagacctgagaccccaaaagagctgatgcttcagtgtgattctgaaggcaggaaagaaccagtggaaggtagtcaggcagggagcgaattctcccctcccagccttttccattcaggcttcagcagattgggtgaggcccacccacactgggaaggccatgtgcatgactaaacctaccattcagatgctaatctcatctggagacaccctcacagacacactcagagccacgtttaaccaaatatctgggctcctcgtggctcagtcaagttgacacataaaattaaccatctctcatggagtgagatgatgcttggaagccatggtacctggccagttgccagcccaggagataattgatcagcagctcttcctgggtgctgggaaggggaggtggagttacccagcccagctccttagacagaagggagaggcagtgccatgtgcaggaccagtgggtgagcttttgctcttttgaggagcaggggcctgggggctgatggtgactcttgggctgggcacccttcatgggcagcatgagctccaacctcatctcctggactcatgccaggacctggcagtgaggacctttaacctcactggtgctactgggctgggccaagggacagtgagacaccaacaggagggaaactcctgccttagcactcccggttcctcggtcccctttctcccccaagaacagctggagcaactgcagctgcagactcccttcccagcccctggttcatgctgggggcttccctgctatccccccagcccacctcacctcatcccttcccagcccctggttcatgctgggggcttcctgctctaccccaagcccaccccaccccctcccttcccagcccctggttcacgctgggggcttccctgctatcaccccagcccaccccaccccatctctttcctccaagggccttgcacttccttggccttctgagaggaaggtgagcgaggagcactagctttcccaggccctttcgggtcctctgacccatctgggtctcaagccaggaaggacatgtctgaccccttggcctgcctctcccagtagcccccaagtgtctgagcactgtcctcacagcaggtctgactgctctgcaagcggtctcctgcagaccccctagcacagcgtctgactcagcccaggagtatactggtggacaggtgctcggcctgtaggcctagtgtgctgggcgcccattcagggcagtggtgtgaggaggaaaggaggcccagcctgctctgggggtctccaatctgctgggggagacccagcccttggggcaaccttcagtctgatgtggaagacacagcctgtctttggaggtgggggcttcagtctgtggagagagacacagcctgcccttggagggcctccagtctaacggaggaggcacagcctgccctttgagggcctctagtctgatgagggagacccagtccctgttctcaatattggggggagtggggcccgagacaggaagaagccgagaacagagaaagaatgggatgggagggtgcaggccctcagccccctgttggtcagaggacattctctcagtgctgccagtaggagaattggggcacaccaggtaggaggcagctcaggaaacaggaggcagggtaaactgagaggggtttccaaggaagaatcttttaatgaaagggtctggagggaggggaagccagaaattacaggcaggggcctgcgagagcagagaagtggctgccggctgctggcaggggaggtgtgagtggcgcggccccagggcacagagctgcccctgtgagctgggcctgtggggctcctcccaggctcttcaggcagctcaggagcacttgagacttcaggagtgggtaggactggggaggcgtcattgaagacagcagcccttgcctgtgtcccggccacttccaactccgggcagctggcaccctacccccttggaggtgtgcagttggagagcaggctgcttcagacgggaccgtagctgtgcccctgccaagctatgcaaccttgcataagtcatggagccttcctgggcctcagttacttcatctgtaaaatggaatgaaaacagtaccagtggggagttagcaggaggacaaaccgagaacattcaagcgaaagggccgtttcacacggtcttggcacgtggcgagggcagggtgaacattatttgctgtcattgtaataatttacctatcttaaatccgcattgctgtatatgtcgtttatttggaaaatcaagctgctcccggggtcggtgttgtcagtgggtgtggggcatcgagcccacactgcaggtctgccatcctctcgcctcactggaagacagccttcctcctgccgacagctgtccaggagcatgggacggatggccaagggaaggacaggggcccgggtcaggccctgcctggctctcacctgttcttgccccttgccagccgtagtgcagtcaactcccagcccacagagctcagctctggcgtgaccatccctggggccccaatggccaccaggctacagcacgaggctgtgatgatttaagattagttctggaccagctgctgtaaagaaggggatcaatatggcctttcacctgctttgcacacctcgggggcatcaggagggctgttggctggagggaggcgagatggaggaaggggtggccagggagcctctgcagcaggggccagagggagcacacgcccccatgtgcagccagggaaatggaaaagtttctgttcgctgcgcggtgcgggcagcttgccttcagtacacacaaccattcggcacagtaacaaggtgatcgctatgcgtatttaataagccatgctcctgctgcttggaatacaggggaagccggctccaccttggcgctggagatctggaaatggctccgtctggttgctgctaacgactgcttgacctgctcctgggctgcccggctccacgctcaccacagtggccactgcatggccagccaggcctgggggagccgcctggagccggggctgctgctgctctctcactggctgtggtctcgtatgtgtgcctagggctcagcatctgtgggctgtgcctcgcgtgtgatgtctgcagcagaatgcctgccttcagaggaagggcattccttgctggcagccatgtggcagaatctgccccaggcttgagaaaaccccctatggggtttgagattcttagagccgttcaatgctccaagccaggagacccaggcatgtgctttggctgaggttgtggctagcatggcccaggaccaaatgtgaaaacacaggggcttaatctaggactgtgttacctctaaggggctttttctgactcctcccaccctcgggaagtaaaccaatgtatactgagcgattcctttggaccagaaatgagttttgcgctttacctataggatctcatttaatcctcaaatcacgctttgagatgaatacgattattcccactttacagatgaggaaacagaggcacagagaggttaagtaacttgcccaaggtcacacagctagaagaggcagggttgggatttgaacacaggcattctgagtcttaacccctgtgcttaacccacccaccttggtgggcagaagtctcagtttccttggggtgcctgggccccccaaagctttctgtctgcgtcagatgtaactcccaggagctcctcttgtttccatgagcacgccttccgggccgaggactgtgttgtgttcatctttgtttccacagtgcctggatcactggcatctagcaggggctcccaattccaggctctctgtatgaggtgctggaggcacagaaatgagcaaggtgggctcagcagtccaggagctcggagtccagtgtgcagagacagagctgggactgtcagcttccgcccagtgtcatgagaccagggacagggaaagcccaggggaggcgggatcccagaggaggcgagaggggtgccagacccagctggacgcaggacaggagcaggagacagttgtctggaggccaggatccccgagctcggctatgcgggtgagttggtgtgtgactatgaaggaagaggggaagtgatgttctggccagaagaaagcaccgcgagccacgcctaggccagaggcagcccgcaagtggccagaaggcctccaagggtggggcgcctgagctgaagactgcctccctgaggcccacatggcctggactctgcgccttgtccagctggtccctgctgggctgccttgacctgttttgtgccaccatcccctgcagagctggcacccgcggtctgtctctgggttttacgcttgcccaccaactgcttgttcagctccttgatcccagcagaggcagaagcgaggcctgttaaataataatgtcgctcaccggggcccgtgtcaacaccgcgtcctccgcgttcatgatctagatcgcaccgccttcaaagtctaatccagtcgtttggagttcattttaaccgattgctggagggggaagctggctgtgggatgattgttgcatcttaatttaaaaaaacttattgggaacaggctgatagcaggcctgcggcacatgaggtgtgctcggctgcatggagggccagtgccctgcaaggctgctccctgacaaggtgtgagctggcgtctctgccaccctggcttgtgggaggacaacagtagtgacagcgtggggcgttggggacccggctgggctatgaatacacattatgctattggatctccgcaacgctgaggagtgacccgctgggcccattttacagatggggatgtggactagaagccaggccctttggcttgcagtgtgcagccatgctggccccttcccaccaccaggccttcacctctgttgttccctctgcctggagcactgttcccctcctgtgtggctcttctttagcttgggtctcggcttaactgccgcctcctcagtgaagccaccctgactgctccagccgagtcatccctaccccttcatggtctcagcacatcacccggctttattgccttcagagtgttggtcactttctgcaattatctccttgagtgcagttgtccgtctgcaccggcgcctcactgccttgttaaccagtgagtcccagggccgggcacggcgcagcctctcagccagttaggggtgagtgtgccggcaccttcctccgccacggcggagccgcctgtgcagggcggtcgcagggccctcgcaggactctgcaggaaggtgagattcggggggttaggcattctttctgcgctggggcagttagggaagtgtcctgggaagaactgtgccttcaaggaagtagggcagggagtcccctcccaagagaagggagggaggaattcgcagaaggggcttgtccagagggtctgtggccagtggggatagtccctgcctggatggcagccggggacagatggacaacagtgtcactcaagggtgagaaccctgcctggacctgcacccgcaccagccttgtggtgtttctatggcaacccccttcccccaagcagattttcagcctccctggtgcagttgcaagaagcacaggcctgggtccttcctggaaagtgctggaactcagggcaagtggcgtcagcatttggaccccaggcctggttcctgccttgaggggctgtggtggggttaactggggcagcccctcccccattagacccgggcttcccatccttggagaagcctgtctggaccatttcacctcctacatacaccacagctacatgctgacatcctggggccggttatgggattaaccagactgaagctgagtagggtgggactgggcctggctggctcccattgttaccatcctatccccatggcccaaggccaggcctgacgcagagcaggtgctcagtaaagggtggttaaggccagaagcccctcagggagatgggctctgtctgtaatgtttccccaagtggggggtgggggcattgcagagcagctgaccgaggcttggttttaaccggcttcggagcatgaaggtgcttcctgaagcgcgtgcggtcagcaatctgctctgcatctgatgcctcctgccggtacctctgcactggcctctcataccggctctcatgctttttgtccctaagcaggacagagaagaaacttctctgggctcctgaacaccaacagccccttgatttcccctgcccaccccccgccccagccgccttccccacccttaattttcatgtttagtgcctaaacttagtttgcatgtattagctgttgtaaatctatcatacgagtgtgatgcggcatgaataatgcatcactgggctgtattagttttctgtctcctatcttatttatgacatgaaacgggtgggaatttgcaaaagagaaattcaggcgcagggcttcttgggtaatggtatgcaaattggcgtgagggtgaaaagatgcaccaggccctcccagcgcccaggagctgccgaggaggagcgcctggtgtctgggccactgccagagcatgcagggtctcgcgtcctatcactgcatggagtcggctctgctcggcagtttgtcttaattttttttgttaatgtgtgtgtcattgtggttgtcaccctgttatgttttttaaattaaaagttggcaagcaaaacttgagaaatggattttctaaagattgtggagacttcccaggaggctccgacaagaacaagttcacaaggaagatgagtgttttccagcatcaggaaggcttgaagttagatgttcagaaggactccctttcaggaagtttgtgaggcatgggaggtaggggtgggtttgggaccccatagggccttcttatgtggagggtcagaaataagttggctggttgcaaactcgggcctggagggggtgaagagcatctcaaggcatgtcttgtggggcagtagatggctgagggtcaggcctccaggcccctctctcctcacctggaggagctcagatctttcctgtgtctagcacttggattccccccaaccagaagatttaggtgatgaaaagatttcatgattttaaaaagaagttggtcgctgatggctcagggaacaggcttggtgaagcctgacctggagcaggagggaacctggaggaaaaagggaaccggtacagggaaggcggatgaacagacatcgtggagaggacatatgggacgggaggtgaggaaggggagctggcacggcaggggcagtcctgtccttgtgagccaccccccagtcttagctggtagcagccagcccccgatcctcgcctcccctccactctgtgtgtctcttccacatccccctcccctctgagcccggcagcagggagagggggagggcagatgcccaaggggcagctgcccagtccttttggaacttggcaaggaacaaatagagccatggacatggatccgctgaatgtcagctgctaggctgagggcttaatgcagtggaggtcaggccctgggtgtaattagggaggctccctccctgggtggttgggaagaatgaatgaggtcacatgtgcagagggtgtaggctagtgcctaatgcacactcaggcagagtggccgctacgcaatggtcctctgtgagcctggcagcggggtagcagggaaggtccacaggaggcaacctctgcaggaggcattcccggctgcccctgcatgccttgtctgagtgggcttggatggtggtcagtgtgggctcaggggctgggttggctggccttcccactgatggcctcagtttccttcctgtaaaatgggggataattatagaacctgccccaggactaagcagctccgtgtacatgcaggtcccagggctgtgcctggtgggaggaagcaccacgtgtcagttgttgtgtcattgtggtcacaggacttgctcagggtgactgggaccacacactcgttggtggagccaggatctcagggtgcctctgattctgaagcccccacctggtctgccgtcctctgccccatcagccccgtgttccattgggtcttgtgggtgcgtatgtccgcaccatcctccctccagatggcaaaatatctgtgagcagggccagtgtcttatcctctctgtattgtcctgcagtgcaagtacaggcattgacttggcttctctctctcctttgctttctttctccccaaaatctccccttttttcccacgccagctcttcccttctgcctgaccctgagccttccagggctccagttacccctgggacccttggtccatggtgtttacatgactagtgggccctgattggggctgctgaccacaggtgaagaccgggatcttggctcctcccaggtacctggggagagaagcgagcttcatagagtgggtggtgacaccagcccagtgacagcacaggtcctgcagagcaggtgccccaatgagggagtctcacccacaggagaggatgcgggtcagccgcatacacgtgcccagctgtgaggcagacacacctgccactgatccgaggagcccaggaaggaacccaggaggggagcgagagaggggagtgagagcggggtgggccaggctctctggagggcatttagcgggagggcccctgagaagcgtgagctgatgcctgtgcatgcctgtgagagggtgggaaactggtcagttatattaacatagtcacgtgctgcatagtgactttcagtcaacaacagaccacacatattatgatggtcctatacgattacaatacagtattttactgtaccttttctatgtttagatatgttcagattcacaaataccattgtgttacagtcgcctgcagtgttcagtaccgtctcatgctgtacgggtatgaggcctaggagcaacaggctgtacagcatgacttaggtgtgcagtcagctttaccgcctagatctgtgtaaggtcactctatgatcacatgacaaaattgcctaatgatgcctttctcagaacggcattattcctgtcgttaagcaacacgtggctgtatcatataagttcttgactgtggcttgagtcttttgggcaatgtccagttgggagctgggggtctgatcaagcctggaaaccccaactctcccactccccctccccagccctacctgttctgggttggtcccagctttgtgttggtcgcatcaattctgacctttcttgcccaacaccgcccagcagtcttggatgtggatttacatgtggaaacagaaccacccttccctgcagttctcacagcctatgtgggaagcagggcaaccgccttggctgagccatcccaccctgtggcctccccacctccccgcactgtcaccaaggggaacttagagtctcagcctcaagatgttggtgatgccccctctggctaagcacgggcaaatgggtgctgagcagatactgtgcacgtatgggtgcaggtgtgggtgtaggtgtgggtgcaggtgtgggtacaggtgtgtgtgcaggtgtgtgtgtataggtgtgtgggtacaggtttgtgtgcatgtgtgggtgcaggtatgggtgcaggtgtgcgtgcagatgtgtgtgcaggtgtggatgcagggatgtgtgcaggtgtgggtacaggtttgtgtgcaagtgtggggataggtttgtgtgcaggtgttggtgcaggcatgggtgcaggtgtgggtgcacatgtggtacaggtgtgttcaagtgtaggtgcaggcctgtgtgcaggtgtgggtgcaggtgtgttcaggtgtaggtacaggcatgagtgcaggtatgggtgcaggtgtgttcaggtgtaggtacaggcatgggtgcaggtgtgggtacaggtgtgtgttcaggtgtgggtgcaggtgtgggtacaggtgtgggtgcaggtgtaggtgcaggcatgggtaaaggtttgtgtgcaagtgtgggtacaggtttgtgtgcagtcatgggtacaggtgtgtgtacaggtgtgtgtgcaagtgtgggtgcaggtgtgtgcaggtgtgggtgcaggtgtggatgcaggtatgtgtgcaggtatggatgcaggtgtaggtgcaggcatgggtgcaggtgtaggtgcaggcatgggtgcgggtgtaggtgcaggtgtacgtgcaggcatgggtgcaggcgtgggtgcaggtgtaggtgcaggtgtaggtgcaggcgtgggtgcaggtgtgggtacaggtgtaggtgcaggcataggtgcaggtgtgggtacaggtgtatgttcatgtgtgggtgcaggcgtgggtgcaggtgtgggtgcaggtgtagttgcaggtgtgggtgaggtgtagatgcaggtgtgggtacaggtgtatgttcacgtgtgggtgcaggcgtgggtgcaggtgtgggtgcaggtgtgggtgaggtgtagatgcaggtgtgggtacaggtgtatgttcatgtgtaggtgcaggcatgggtgcaggtgtgggtgcaggtgtggggtggtggagggccaggtgagttgtctggattccaccattcaatatcatgcaggcgaggcctgcaggctccatgtggctcccctatgcagagctcagagcagagcagggcagccacagccagtgcctggggacgctttctgggcctcatgctgaggcttgactgctatgaggcagacgtgatagaacaaagctcctatcacatctgaccctgcatcagaactatccaggttgcctgtggcccaaagtcaaggccccccaggctgcacttggtcgatatcccctgggttccccttctccagccactggacaggtcccagtcccctaaaggctctgcctgagcactctgttcccccaggcctttgcacccactgctctccctgctgggactctcaggctgtcttctgattgggcagaatcttcgtggtcactctgacttcctgcccctttctccatggagcccaactgcctccactagttctcctctgggctcccttagtcctcactccctcctccatcgcactctctgcatcgggccgtaaacaggactctgggcatctccctggccgtgctgtgtcctcagggcccggcaggcatggacgctccatgaggtttgctgagtgagctagcaggaccaaggaaaggagatgggcagaggcagtcgcttgcctgcgatcagcagggcataggaaatccctttacgtcaggtgaggagccgataggagttttgactcctactgtgtgccgggggctcagccagggacctgattttgccttcagtgcttcactttctagatgttaaatgaatccagagaaacaaccctgactgcacctgctcacctgcaccctcgtgcacgcacaggcgttctttcttctgccttacctctgtctgtctgtctctctttcagcactcactcgtctcttcctccctggtggtctggtttgcacgctcactctctgctgatctcagcttctaactctgtatcggtgtctccttcgatcggtgccgccccggctcttccaggccttctggcccagggtgggcactggctggagctttagtccctgtgcttggcactgggttccagcagcagcccctgccctcatggacctgcctctctgatatgggcatggtaggggagggagatcagggggggagagaccaccaccatccacttaatctgtattaagactcatgggtcccagaggctgctttgagctctccattagcagcaacttgagtcatcttacggcagctctgtgcagtaggtactattaatattatcacacccactttaaaatggaagaaaccaaggcaggaagtggtggggtcaggagctgaaccctgtaggtctgcctccgggcctgtgggtttattgtttcttgcaaatagcgaacagataacaagacaatcccaggccacggtgaatgtcatgcagacccaggctgggcgccatcactgcctgcactggtcactcccctgctgggcctccctgtcctctctgactagaggctcggtggtccctccttcctcatgggggctgcgggtgagctgagctgagctgagctgagctgtgggcagcccagcacgtgcaggagccggaagatgcctggccccctctctatggctcagtcttcaccgggtccccagggtggtgggcaggcacaggcactagctcagccctggcacctgcttgtacagggcaaggttggagtagctgccaagggtaagactcgcagcaaaggtggttgctggccccaggtgacccaggtggctggctgcccaaccctccgtcctaaagtgtcgatgctggagaagaaacactaggctggctgtcataattgaagaaaacaaaaggaaattaaataggactaatgaggagaatatcaatagcccatacttcaagatgctttttctattccacttcctccagaatagccaggtgcactgatagatttcagggtttttttttttttttttttgagatggagttttgttcttgttgaacaggctagagtgcaatggcgtgatctcggctcactgcaacatctgcctcccaggttcaggcgactctccggtctcagcctcccaagtagctgggattacaggcatgcgccaccacccctggctaattttgtatttttagtagagatgaggtttcaccacgttggccaggctggttttgaacccctgacctcaggtgatctgcccacctcagcttcccaaagtgctgggattacaggcatgagccaccgcacccggctggatttcagattagttttgtttttaaaggcaaaattttggcacagccaggtcaggacagcgttctctgcagtggcactttctgtatgccttggtctgggtttttgggttgacaccaacatctgtgtccaccttcttgtgtgcttagtaacaagtaggccttactgtaggaattgttaactttttcggaggtaggcaagggtgatttatagacctcttggaaatgctagtaaaaatagttaacgatctttctagaaagacacaccaaaaataccaaattttgtacaatcaattccaaaatggattgttaaaggaaatttggggtctggccaccagtcttggagctggcaggacgtccatcgctccatcccttgcaggctcccatgatggccctgagctaggagagtccagcatccagtgaagtctctgctccaaaggatgacctcacacccaccttacagatgaatgaacagagtcccagagaccttaaccagtttgctgggaagaggtggactggtcgttgcacccggagcctccctgagaaatgcgtcaggcagggcagatctgctcctggtgcacaacctcttggcctcaaccaggtcagactctgagggcaggagtgttggggaatcagacagagctcacagagagggatccatccatggcttggaggctgagtattggcactggagtcccgttagggtgaccaagtgtcttggtttgcccaggattgaggaatttcctgggtttggggcttccagtgccgcagcctggacagtcctgagcaaaccgggtaggactggtcaccctaggtttgaatttggctttcctcccatgtcctaagcagcgcgactttgcacatcatttagcctgtcagtttgtttcctcagcggtaaagtgttgataagaatgagataaagacagggaagggagttgtgctaattgcctgtagaagatggcccttccacatgctcagtgcagccgtgcagagcggacgtgaccccgggtctgaattcgcagccctgccctttgctggcggggtggccctgcacaggtcatttcttgtgccctagctatgggatgaggatggaatggtggcacccacctgccaggtgtctgtggggattaaagggaggcagagtaggtgaggtgcttgcaggtgatcgtgggtgatctctgggcccacgactgtgtctcccagggccagctcggtggtgactgggccgggaatgggtggcacagccccttcatgctcacattcagctctggtgctcagcgttgagagtcccccatgagaccctcggaggacagcatgtgagcttggagcgaggtgcacgcttctgccccgccttgccccaccctgcccctgcccctgccctgccctgcccctgcccatctgggccacccggggttggttcgctctcttttcatagagtctccgtgaggtgggacgctgcgcgcacagtgcccagtcaggcattggaaagtcctgacacacggtgggtacctgtaaagtagaagccccaccagcatcctgctgtttcctcaggagctggcagcccctgagagcccctgtgcccagcgagccttccggccccttggcgacatctcagctctaatgactttgagtgctgagctgctcaccctgggaatttatggaaaccatgcacagaagcgtcacctggaggcacataaatattgtaggactggaggttgggctgtgtcagcactatttggagcagtatcacccacctgaaactgactgtgtgggcgcctgtagcgggtggatggggggctgcagggaggggctccgtgggcaggctcaggacacacaggtttgtctcagctcacctgggttcattccaggtcacagtgcgccaatgctctccctggaatcctcaccgtgccccagaggcgtgttctctttttgtccccgtgtacagatgacagaggagactgagtcactgggtagtggggatctgggagctggaggaggcgggcacaacccctcccctccaactgccagctttttttttttttttttaaattactttgccttttctcccataactttttttttttttggagacggagtttcactctgttgctcaggctgaattgcagtggcgtgatctcggctcactgcaatttctgcctcccgggttcaagcgattctcctgcttcagcctcccaagtagctgggattacaagtgcccaccaccatgcccagataagttttgtaattttagtagagacatgttggccaggctggtcttgaactgctgacctcaagtgatccacccatcttagcctcccaaagtgctgggattacaggcgtgagccactacgcctggtcccccataactttttactttgaaaaatttcaaactacaggaaaggtgagagaataatacaatacacagatattcttcacccaggtaactgttaacatgttgctacaatcttcccccatattatacatgcacagagacatacacccacttttaaaaaagtcagttgcaggcatcattaccctttacccctaaatacttcggcatgtctcttcaacgtaactgcatggcatatcacacccaggaatttaggtctatgcactgatgctatctaaatactgtccaggtacaggttttcccagttgtccccaaaatatctttcagagctactcccccaaatgccatccaggatccagcctgaaatcacaggcagcctttggttttcatgtctcttaagtctccttttaatctagaataatccctttgcttttttgttttcttcatgatattgactttgttgacaagtccaagccagcgtctcatagaagttccacagtctggaattgcctggttatttcctcccaatgagctgccagtgttcggccaggtgctgtggggctgggggtcaggggagccctacacctcccacagcagtcctcggggaggaagaagagcagctggccccgtcctgatcacttggttagggtagcgtcggctggatctctccttctaaaggtgctggtttccctttgtgattactcagtcacctttgggtgattcttggagactgtgtgaatatccagttcctccacaaactttccccctggggctttgtcatccatgggtgatccttggtgattgctaattcaccattgtctaattctgccttgccttctgcattgactagttgtcactagttacagagattcacctgaccccactccacaccctgcccttactatcactacaaattcctagatttaaaaaaaaaaaatccagcgtgctctaatcaggaccatcattattatttttgatgttcacattgtcttgaatttggccagcggggaccccttcgtgttggctcctgggtcctttggacacatccccattgttctttgagcccttccttgcttttcatctgtgagaagttctaggcatttctccagggcaccctggctagagtcactgccttcaggctctttcagtggacagggccagggaagaactctcgagttggggttcgttttgatacctctgatttagatttgagatcctggagtctaccctcgtctctcccattccacaccggactctcttctctctgtgcaaaccctggttcccaataacatcagtgtatctcagtcccaccacataggttcagaatcactgtgcctgccccaccacctccaagcctgccaaggaagttgaggtttcccttgcagatcattttgtccttcagcagggaccaggggtgtacagttggaatgccatgatcctgagctacttgaatgggttcttttctatgcggatgtgactgtgttccaataaagcttcatttaccaaaactggtgcaggctggttgtagcctgaggggcattgtttgcagacggctgctctagtgtataaacctaacagcacggtttctggtgcagggtgagcgctcacccagtaaatagctgtgtctggataatggaggctgagggggcaggaagcactgggcattcctggtggtgggtgggcaggtggcctttttcagggataagggggctagaggcctcttagagagtaggacagcccctgaccccaccaaccccacacttctgggcctcccagaccagccaaggatgagggcacaggtctggaggtgcttggcctgggattggggtgctgggtgagcagggtttcacccttttctggttgggaggagagcagagtttgatgagctgacagcctcccctggcaatgaattctgagctctctcagggtacgtggataccttgtgtttggaaaatgaaatgagctgcatggcctggcagcagcaagaccagtgagcagtgagggcttcccccctgctctcaccagggtgctcactgccccctgctctcaccggggtgctcactgccccctgctctcaccgcggtgctcactgccccctgctctcaccgtggtgctcactgccccctgctctcaccggggtgctcactgccccctgctctcacccgggtgctcactgccccctgctctcacccgggtgctcactgccccctgctctcaccggggtgctcactgccccctgctctcacccgggtgctcactgccccctgctctcaccggggtgctcactgccccctgctctcaccggggtgctcactgccccctgctctcaccggggtgctcactgcctcctgctctcacccgggtgctcactgccccctgctctcacttgggtgccaggctcagtccctcagccccctctgggacccgtgatcctggcatgtctctctggctccacctactccctgccctgtgggcccaggaggctcaggcaggactccaggctcgtggtgtgagaaggggacccaggagcccagaggtagctgagacatgccaggctggggctggggctagggctggggctggaggtgctgtgctgttctccctattcattcctgccctttcccccgccggcctccccgctttgggctcagcaggtttgcacaagccttctgctaagccctctgggcctggagacagacttgttatgccactggagaaatgagcctggatttccaccaccgacttctcttttaattagattctgacagcagcacacagggttggctggctgcagattcaggtgcagctttccttggtcccaggcctctgggtttcagtgcgcttggctttttcggaggctgaaaatacttctgacctttcttcgggagtcgagcggcaggctggctgcacgcgtgtgagcatgcagatacctctctcagtgtgtgcatgtttgtgcatccgtgagcaaggagctgcgtgctgtgttttggaaaagcctgcagacaaagcatgttgggtctcactgactgtcctgctaccccatccattcgccccactgctcgccgacagcaggtgctgaaggggtccccttggcctcactgtcctcatctgtgatttgggctgatgctgcctcagctggcttttcccagcaaggcctcatgggaggtttccttcctcctggattcctcctacaggctggtttggcaaaacaaaatcattctgcatgtttccttgaaggaacatacatcgcaggaagagagaactgaaagccaggacggcccgggctgtgggcagcagatatgggcggagggctagagagatgggggcatggtctctcccctacacagcatggactactaaacctgactttgcacaggctgtgaggaggcgtggcctcctcccaaaaatcagaggctctgagcctcttgcacctgggccttctctgagggccgggagtgggtggctaagaaaagaggaagagacccccgatacctctggagcccttagcctgagcccccaatctgagacaggagacagttcgcttcctctgagcatgcccagcttgatacaagattctgtccttgctcttggggggcccccacccaatggagacaccgcacccctgcctttggtgaactttcggtctgaggaaactacagcttctgctctgggggcatccccctggtcaggggtgggctgtgcagtagaacccctgttccaagagcagcctgaccctggggagaggaaccacactgctgtctcttctcccctcccctcccctcctctggggagcctggcctttcctgctacccctgcctcccttgctactcgcagctcagccatcagggactggctcagaaaaagcaatttccttggacagctcacagtcttgccctcctggtccccacactctgatcaggaatgagcccggagctcactggcttagctccgcatggagacccccgcccctcacaagcttccttaactcagtgggaaaccgcttagtgatttgagctgggaaggagctggggccatcctccagggcaaaagaagctgagtcctgttcctccctctccacttgctaagcccacgcgaggtcttcgggggctggacaaagaagccagccttccccacactgttgtcagactgagcttctttaaaagtaaaactgactctgtcacttaccagctcaaccccctccagtgggcaaataaaatctaaactgttccccatggattccaaggtggcctggtgcaatctggccctacctgctctggcctgtcccattgctgtgccccccaccacgggtccctctgcttctcattcctgcctccgggcctttgcactgctgtgccctttgcctagaatgctcttccccctcctcccaatcattgaggggctgtttcctccccattattcaggtctctcactaaatgtcacctcctagagacaccttccctgaccccagtcttaatggctttcagtattttttctgtgcagtgcttctcactatctgatgtaatctttctttgttttaattgcctcctgtcctgagaacgtttgccccacaagagtgggtcttgcagtcatcacgacatttccagcacttacacccacaccagacacatagtagggactcaagaacatctgctgaataaatgagaccctactaggcactgggcctgtgccaagctctcctcacccaggtacctgtaatcctcatagcagcgtgtacttacaattgaggaaactgaggcctgggcctgtgaagctgccaaggaagtcagatttaatagcaggttggatctcaaataaatgccccgtccaggatcctcctgcagtcttgggcttcctcccaggacaaattctttatggaaaaaggagaaaagccagaaaactggaaaagaggaaaatcatcccgtcctgctcctggagtaagcctcagggtgcagctcttcctcccctgtcccgcttcttcccccagcttttggtgtgtttgttttgttttgttttttttctttctttctttctttctttctttcttttttttttgcattttctgtagcattcacatttttctgtgtctgtcatgcagtgtctgtaagtgtgagtttaaatgcagggaggacagtacagagctggatacacagagttacctgactgtccccatggcttggggatttgggttgtttctagtctgctgtgcctgagttagtgacatctgagtgttgtagatagaattcaagtgtccatccattcatttttttgaccaaattttactgtgctgggccctgtgccaagcaggtgacaggcactaaagggcatgaggcccaggctctgtccttggagtccacagtcttatgtgggaagtggccaagtagaaccacagaatggtgtaggtattccaggctagacagcagagcacgccattcagaaggaagtggctggtccgtggcggggtggggcctgcctcctggactgaggacgccactctgaagtggagtcttcagatgttggaggaggacagttcgggggggcagtgcgtgctgtgtgcaagtcatggccagggcaggggtgcggctgtgtggtacatcttgagcattggctggcctgaaacgtagggagcccacaaggaagggcaggagtgggggcagcactggggccccgaatgctgagctaaggaacttggactttctcctgcagtggatgggaagcttgatcatttgtatcttcttttttaaaaaagtttttatttgttttaagatcaaaatggtacatatacttgcaagaaaaaaaaaaaaagcatggagtggtttatcctgaaaggctcgtccacactccacatctcagtcctgctttttggaagagaatgcttttcacctgttctttttttaatccacctggcactttcctcaggacccaaacttgttcactctgctgcttcttgatgtatcaattttgggacatcacctgttgtctccttgctgtgaatgatgaggatttggcccatattacccccgttccttccccggtcattctctcggttgcctttgtcactttaaatcatttacataaaccacaacttctttcatgattttcggctccatctttcccttccgtaaggtaaagctctgaggggccactgggaccatgcctggtcctgtctgctcgtgagtgagcgtgtgcatgtctttcctgctcctcactcggtgatatcatgctggtagtttgcaactggccacgttagaatgtttacaccatggaaattggcaaacgctgcaaaccaggattccctgccagttgttaaactttggccaacacagcacagctgggcttctaagattccagttgttaaactttggccaacctcatagctgggcttctaatgttccctgagtagcttgagcttttgaagaatgtgagaatggctggcccaggggtgggggcttgtagggaggctcagctggcaggcccagccagtatcgacactcctccctttgtgccacagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggtgaggctgcctcgggcacgggggagcggacagtcacagagcaccttccacggccaggtagtggtgtgacctgggcagcccatcccattttccctcatcagccctgaaaactggggctttaatttggggcactccccaggaagtggtggggttgggattcacacctaggactgtcatctcaaagcccctgcctgtcactgtgcccagccaccgcatcacagcagcctggggcgctcaggaaatggcccccagcccactggaccctccaaagtcaggcagctgctaaggaaaggccaagctgggcaggaacccaggcctttcattctgccccactgcccaggttgaccaaacacccaattctgcctcaaatgccctgcaggatgaggtgatgggaaagtgagaaagccaacgggtggtctctgtccttggagttttttctgagaaaggcaaattcccctcttgggccttctagtctgtgggtttggatggcatctgctgtggctggggcccctcctgcgtagctgtgtgtagatgaagtggacaggattggtggtggaggggaatggcggcgaaggattaaggctggagctcaccaaatgccccccaaggcctccatggaattggctctcagcctttcgttgccatctgctgctcaagatgcaggcaccatgcccatcctcaccccagctggcttcagagcagaccacggggccagcaggcatcagctaaccttgcttccctccttggcccagcttcccccagagagactgacctgcggccagtgtgggagggtgcagtggctctgtcttgtcccagtgccccaggcagggctgggttcagcagctgggagagccaaagggccctcgggccagggaaacacagcccgtgtggcaggtgggggcctggagctgattgtcacaggacctggcagatgggccatggcagaggctgggagtggccatatgcccagcagggttgagcatcctgtcttctggggccatactgagggcaggcatgttagccagcactgcaggagccttagggacctctgcctaccccaggggcccggtccctaactccctcccgaggccctggaaatcaccctggtttctgcttccctctagccagtcacgatggtccttgagtctgaactgatcacacggggatggtggttactaacaacacagtccacggcagtcacaatggtgtaataactgccaccctgcccgggcctgaggtgatgaggccccaagtgcttatgtgcaggatctcatttcaccctaaccctgcgagctggggattatccccacattacagatgcagacactgagattggttcagcaggccgggcgtcttgctcgtggtcatgcagtagaccagaggcaggaccacagtcacatcaggccggactcagtccagcatcctactgtatgtaatggagaaagagagttggcttgaggcctggcttggccaacacacagtatcagacaagtcccttaatctcccggagcccctcatccctctgtaagatgggatgtaggtcccagctcagggactgttatgaggataaatgctggtgggctgggaaggtggctgtcctgggccggcagggtggcaggtgcccgatgagactgaacccttcactcacgttctcctggggtgtgtgagaggcttgatgggacctgtgtttgggttgcctccttccccctctctccctccctccctgcctccttcccctacctccctctctccctccctgcctccctccctccctctcttcttccctccctccctccttccctccctctcttcttccctccctccctccttccctccctccctctcttcttccctccctccctccttcctccctccctccttcctccctttcttgtttcatagtatttagccattatacaggttcaatccattttaactacgataaaaatgtctctgtatcacaaaactatctccacatttcctctgatagctaaattatttcaagttagtggaacaatgaagaaatggataatctcatgggcttttaaaaatctttggaatctcgtcttgtctgcgcagaggagagtgagagagagtcaagctgatcaagtggtgggaggcaggatgtgtggacagacctggctgtagttagaacagccactcctgcctgtacaaccctgactttactgtgtttcacatgcaccttcacgcccgttgtcttacttactctttgcagttaccctttaaggaaggaagggcattcgttgttatgatgatgatttgagggccaggtaaactggggctcaggaggtgaaatgactggtctgctatcgcagtgctgatatggacagagccaggagcagccccacggactctcgttagagcttcctcacacttactgtgtagccttgggcggttgtgtccctgtcctgggcctcagtttccccattcatataacaaagggctgagatttgagtcagcttggccatgctgggtggggtacaccagagcctggagccagaattcctcctggaatccctcccctgtcttccagctctgactgggagcactcagagcaccagcttcccatcctcggtccctaccccgcagggcaggtgtaggtgttgtgtgagacagtgtgaggacagtgcccacagtccccgtctcaagccagcagcggtccatgatggtgacattttgccgtcatcgtctttacggcatacccgccctgcatctcctgcgagggctccttgcccctcctaagaccctccaggtcagtgtgccattcctgtcgcatcagctgcatcagtgcagacagaggtgaccgctcttttggcagacctccctgaggctgaaccctggagaaggctggatgtaggccgaggttccagagtgtggggtttcccgaaggttccctcttccctcaggcctgaactttcccaatcagtaacccagtggagcctggggccctgccagaccagttcctcctgacccctcatatctgagagtggctccctgagctccaagctgagccagagccagccccagccaccatgctggggaccagagcgtggggggcagctgcagatccaccccacgttgtgcctttgcagaagcgcaacacagcaggattcttaagttctttattagagatatttttaaaaggcttttaagtatttttttcttcccccacaccagcaaatgaaataattgcataattagtaataaatttgttcctacactaagtgtggatttttttagtgtgtgttaacaatttattgcacttccttcccctgacccctttcttccactcgcatactcgactggtattaatgcattttttaacctaaactccctcctccttttaaccagacaggtcattaataaaatgttctccaagagcctgagctttttaaagttgtatatctccagatagatggcttgggtgagttgaacactgccgcattaagtctctgtgataaaatatttattcaccattagaattttttttttctttcggactgtttgtgaagtgtcttgctcttttccttgaggtggagggggagggggaaggccccagaatgaggtctgcagatgaagccatttctcaattccggcatctctttcggtttcttgcttgccttcctcccatttgtcggttttgccgtccagtgggggctgggaggatgcaggggcagcaggaaatggtctcctgccggtctccatgccctgggggtcttggagagggaggcgatgaggcttgtggaatgaaaaattcaccactgtcccctctcttggcttaattgttcttgtgggtttatggctctgatggagctgatcttaagacattagcgtccagatccttttaataatcataaacattatcctaatagcctctatttattgattgtatactatgggctaagagctgtgctcaattgtgtatatatattatatgtatatatatatgtgtgtatatatttaatatttctaataattataaaattgagcaaggcaggtttgtagtactcattgatggatgagagaaatgatttgtccaagttttctcctttccttcatccatccatctgtccatccatccatccatttactcattcactcacagatacttcttgagagtctaccatgagccaaggtacttggccaggagttggggagttaaccatgagcacacagataagtcactgccctcacaaagcttgtcataagtaaacaaatagcaaaataaggtcatcacagaccttgaccagggctaagaagagaagtcagctgttgaaaggggctcatggcctgagcctcccatgttggccaactccaggagggctgggggcctgaccctggaccggaggctgccatcatagttctgagccttcacttttggaatggatttaggtgtgggaaatagtcccagctccacagacacccaggtactgtttgtgaaatagcccctgttggccaaggctgtaagtcactagtgggctttttttttcagcctagtttgcatttccacattgcagggacgctatgaatgtgattttttgagtttgcatcatgttgccagactcgaatcccaccgcctgcttgatagctccattcgggtgtgtctaatttgtgtctcagaccacacatccaaccaggagctctgggcttcaacccccaaaccggctcctttgccatcccaggccatggcactgctatgcacccagctgctccaggcagaggagcctcagtgctatcctgggttccttcctctgctccacctctgctcccctctcccagcagctctgtcgctctgctccaaacaggtctaaaacaggttgggctctcctcacctcactgccgccgcccttcccacctgggcagctgcgggagcccctgctgggctccttgctcctcccactcccaccctccacaactgtagctagaacgttccactcaaatcacgtcacgctactcccctgcctaggccttccggtagcttttcactgcagccagaattatgagccccagtcctggccctgacccatcccctcttctgaccatctggagtctgccttctgtgccccaggtgcactggcttcactctgctcggcggactggatgagctcattcctgtcacagggcctttgcatgccctgtctcctgggccttggctcaggtcttggtgtggccacctccgccttgtcacccagcagcctcacgcctgcctccctatccttccaggaagtagagggaggcctgaagacccgggaatcctccactggctctgccctgtcgccctgtttcaatcctctgcctggtgtttacatcccttgtttctgtttttgtttcctgtatctcctctctacacctctgtgtctaatacagtagccattattacaatgaaagaaaataacacattcagtccctcagtgccactagctatatttccagtgctcggaagccacatgtggctgatggctgtcaaattggacagcacggtagggaacatgtccatcatcaaagaaagttctagagtgtctgctccttaagacaggactctatgtacatggtcccagctgtgcccccagcacctagtgtggggtctgccatgcagtaggcatctgggaggtaaatggattggtgatgggatggcacactgtgttaggcaatgctgggtgtaccccgagtcggtaacctgccttttggggtgagagagccacaccatttctctctgtgcctgcactgcagaggaagcacatacacccacatgtatggagttgaagtgtcatgcccaaggagggagaggtgatggaagcactgggcagtggtgagcagcagacctcaactccaccccaccctgcactcaccaggtgggggacctctttgagccttaacatccgtgcctggaaaatggggccggcatttgtgtcttgcatacgtcttggctgttgcaagccttgtgtcagatgagagcaggtatacgagtgctttggaaactccaaagctgtgttttttcaaatgtgatccatggaccagaagcagcagaaagtggaaaccttctggaatgcagcctaagcctctcccagagggcagcaggatcagggcaagaaggagacagccctttagaaaggcagctgcccagtgaagcctaaggaagtgtggcagcgccgtccaccctgtgtgtgacatggtggagggtctgtccctgagccggcagcctgtaccccacgcctctcagccccctcagaaagcctcctgccccctgcactcccagcctctcccttgtgcccattcccattgctagaattgttggcaacagtgcagcagcagcgatgacagcaggtagcgcccattttgccatgtgcaggcacggggttgttttacgttcattcatttaacccaatggagagtatctgtgttccaaacatcaaaaagggacagtaaaaatacggtcctataggactgccattgtatacatggtctgttgttgactgaaaggtcattatgtgacatgtgactgtattatccttggccccttttacaagtgaggacaccatggcccagaggagtttaggatgggccccaggtcatgtagctggagagtggcagagccaaggtgtgaatcccgcacctggctctggagccctgttctcagccaccgtgctgggcagcccacacctggcatcctctctgttaggagcaggggcctgcccccacgccctctctgacattgctattcttgctaaaatgaagagacagagctgaggggagagctaaaaagaatgaatctggactggcatcagaaacatgctgcttcccaccagcgagttttgtgcttcactcttgggcccagggcctgcagggtgtgctgtgacctcatctgaagaagcacccacacgggcaggccctgaggggctgcagcagagccacctcgatgcctctcgagccccacccggccctacttatgccttccatctgcaccaacaccgatgagaagcttgcacctccccagtcttccctggttttgctcgtagctggctggctggatccctgcatggattgcccttggacaaccctttgtgccggatgacctggccgccgtgtattgagagcgcacacagaccaggcgctgtgcctgtggtgttcccccaatgcatccgtatggcagccccactttacacaggcggaaactgaggctggttaggggagtgctcagctgcaggacctcgtggccagaccccaggcaggtcagcctccaaagccccagctcttccccaccccaccgcccaacttcttgctggtttcaggggaggagcccgctgtgccaggccctcatctcgtggtggtacccagagcccatgctgtctccccaggagggcactgctcagccgccctctctttctgcaggccagaagcacttgtgtgtcaccagcctcctgatctgccagggtctgctctgggtgggcactgaccagggtgtcatcgtcctgctgcccgtgcctcggctggaaggcatccccaagatcacaggtgaggctttgggagctggtgttggcaggaccagggggtcagctgcaggtggccagtggggcttggcggggagggtgtattatgccctcattggtatagggatggggttccagtctccagcttcctctcatctcaggtggcatggtggccagtagaactgaatcgtcctggccccagtctcccacctttctgagtgtcagtttcctaatctggcagatggacacaagagtggcttggggcctggctgagacacctgcctaatggcaggggctccactggccctttctgctgcttcccatagcagtttcaagatgtccaggctccagagaaagaaataactgagtgcttctggggccaggcccggcctgctcgtggggtccatgtgcaaatgaatgtgttcacatagatcagaggaaggtctgctctgatctgcactactgggcccaggacaacaagggcaggatcagagaagacccccacacttggatgcctggagctccgggtccccctccaccaccctgagaatgatgactgtggtcttttccagcaagggagcagggccaataggaagccctgggggtgggctggctccctgcgcagacctcaagtccttctgataaagaagaattgctttggctgggcgcggtggctcacacctgtaatcctagcactttgggaggccgaggtgggtggattgcctgagctcaggagtttgagaccagcctgggcaacacagtgaaaccccatctctactaaaaaataaaaaaaaataaaaataaaaaattagctgggcatggcggtgtgcgcctgtaatcccagttacttgggaagctgaggcaagagaatttcttgaacccgggaggtggaggttgcagtgagccgagattgcgccattgcactccagcctgggggacagagtgagacaccatctcaaaaaaaaaaaaaaaagttgcttctaaattctgagattttctattttcaaggtttcatcaaatagggcattttgtccatccagggggcatttgtggagggtctatttccaggtagaatcctgggatgcagggatgaaatcgggcagagaccctgctctcaacaagctgatggtctcctgggggtcatcatagctcgggtgacaggtgctgggatgagggtgctccgggggctggggacacagagactggggcgagcagctccccatgcatgaattcaggagggattcacagtgaggagtgtgagctgggccttgctgaaagagttgcagaatcaagtagacaggaaaggatttctaggcagaggagctgcttggcaaaggctcaggaaattcttggaatttcacactgaggctcccccgtgtggtgtataaggtggtttctgttccactcccctgaggaagttgtgcaggagcacgggatagccagagcctgtggccttcgggggaggtgccaacatagacagaagtgacccccccaaatacccacccagaatgttctccaggagagagactcaggtgcttcccttaatgcgctgggcctttgggcccctttctctctcgccccattttctgcagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgg

SEQ ID NO: 38690 - DNA, 15956 bp, Homo sapiens
ccacagcccagctgttccctccgcggattctccggggctggttcatcacctccgaatattcctgtgacaggagacgcttgcaaaacccgcctccagcctccagcagcaaataaatagaaggcttgcagcccagaaggagccagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctggccaggcaccctaaggtcgggcatggtgccccggggccccactgccaccgccaggtttggggtgcctgccgagggcaggacccccccacccttccctggggagccctggaaagtgtgtgtgaatgtgcacagcttcaagccagaggagttgatggtgaagaccaaagatggatacgtggaggtgtctggtaagtcaggggcaggagggagagagaatggggaggccgggatgtagccctcagccctgggaatagccagagaaagtttcctgggagctgacgttgggacagtgtgacacaggtgacctcagggctcaggaatgcagcctgcaaagttatctttacggaaaacttctctcccggctcccagcagagatcttaacctgcctgactcagctattggggcctctgggtgctcatcaatcatggtacagacaggaaaatagaaaccatgttggatattttgacagagggcatttaatataaagaataggttaagcagatatcaaagaattaaaaaacaaagaagaaacgggattttgtgcactccagcatcataacagagtctagaagtgcacgttaaggctgaacaatgatagtgttaataaccgcaactggtttccggtgaaacacctctccttgtcccagacagggaaactgaggcttaccagtaattgtagtaacactaactggtaactctgagtgctaactattcgctcagcactttgctaactgctgttgcctataatatctcagctaataccacaaccagaggaggtgggtactgtttatcttcttttttcagatgaggaaactgaggcacggagagattaaagtaacttgttcaaggccaccaaggagtcagacccaggttgtctgggaattaggaggccagaaagaagaagtgatgatttactgagcacctactaggtgccaagggtgggctgacattcttatacttctccaaaatcatcctcagtccactccagggtagcagggtaggcccatcttgcagctgaggaggctgaggcctaggtgggactcgttcacagtcatgccatgagtcagcaataggagtggagtagggactgggcctatgcacagctttaggcccagggctctcactgccgcatcccaccctgggagaaataaacatactagggggaaaaatgagagaagacaggaagctcagcccctgtgaagctgggcagtagaaaaatctttcttttccttccctcctgattaacactccattaaaaagaatgtgttcccggcagaggcttgccttccagaaaatcagtcaaagccattgcaaacacaggctgggcaggaacaagccccagcagcattcagggggagtttcaagccagtcctggtagaattataaacatcagaggctccagcgggtgtggtgggctgggagacacgctggggccacgtgctgatgacagggtcagccagatttctgagttggctggggagcagggcatgagttccgaaactggctccaactttaaccagcaggatgtgcaaattacttcactttgtgcttctgttttgtttcctcatctggaaattagggttcaaatggttataccataaggattgttgttttaagtgaggtgatgctgtaaaatgtgtacatacctgtgaacccagaaaatctgagacagatctcagttcatttaggaagtttattttgccgaggttgaggacactcccatgacacagcctcaggaagtcctcctgtcacatgcccaaggtggtctgggcacagcttaattttatacattttagagagacatgagacatcaatcaatatatgtaagaagtacattggttcgatctagaaatgcaggacaacttgaagcagggaggggttttccaggtcacaggtaggtgagagacaaatggtcgcattcttttgagtttctgattagcctttccaaaggagacaaacagataatgcatctatgtcagtgagcagagggctgcctttgaatagaatggggggtaggttggccctaaacagttcccagcttgacttttccctttagcttagtgatttgggggccccaagatttattttcctttcacattctatgacctggaacacaaggaattagtattattattgtcgtcgttattgttatagtgtcaggcatccaggaaggccccaataaataatgaataatagatgctctttgaaacctgggttcagatcccagcactgctgttcactagcatggcggatgtggacgagaaagtcttcatccctctgagcctcatttctcctatttgcagaatggagaccataataatatctgtcctgtaagggtgtaggaaagattaaacatatgcagactatctatgataatatatgcggagtgtctataaaatggagctaataatagtgcttgcctggcactctgtaaacagaccgattatcaccattccttctgtccttgttttaattagggtcttagatgcttctagcccaagtccaagggtcgactccaccctgtggtccctctaggagaccctctgtccagcctggagggtttttcaccatcctcttttgtaggtgcttcataacaggtggggtctggcagctccatgttgagatctcagctaagtatcttactaatccagaggctttgggtgagtcatgcagtctcaatttccacgtctgtaaaatggggtcattgggagcttaaataagacaaagacaaagcttttcagacatgcaattagtgacatcggctagacaaaatccaaattccctgagagtccatacaagggctttcataaaaggggtttaaaaataaaattgatatcaggagctctatttaagaagcaactttcgggccgggtgcggtggctcatgcctgtaatcccagcattttgggaggccaaggcgggaggatcgcttaaggtcaggagtctgagaccagtctggtcaacatggcgaaaccccgttctactaaaaatacaaaaattagccgggtgtggtggtgagcgcctgtaatcccagctactcaggagtctgaggcaggagaatcgcttgaacctgggaggtggaggttgcagtgagctgagaccgtgccactgcattccagcctgggcaacaagaaagaaattctgtctcaaaaaaaataaaaaataaaaataaataaaaagcaattttcaagggaagttggaagtcagatccagtttcccaccctataccacaaaatgacaaatccgttcctccacaagcacgtgctaaaggcctacatgtggtggctcagtggttcctcacaaggacctcctaggaagtgtgggtaggtttgttaaccccattatacagataaggaagccgaggcccagagaaagtaactcacctgagattacccacttctccctggcagtgtctgacattcaatgtcaggcctctctggctggttctgagtcaggatggctggatctacttctggcggtgtggccctgagcaaatcccacagcctctggagcctcagttttactgttggtcttatgaagaggtagacaagatcagaatttaccaatgtacttcaagctgttactaggcatctagaaacaggagcaggagagttcaaggtcttgtatggtgccagtaaaaacaaaattataaacaggtcttctcactgcaggacttatcagagcctttaagtcactaatgtagtttatgaatctctaagaggcagccctatcttatctgaccacgtatgagtgtctcattcaaggaagtgtttggaaaatgctggactagacaatttccagcaagcctcagattcccctacccccatcctgcaaccaccagccaagaaatgttcccttcatgggccactgggccagaccctggctaagatagagactggaaagccccaaggccttatttccaccccttctccttagtcccagggactctgccttccctggaaacagcactttctttctttagctgggccaatagtgttccacctacatttctctgaggcatgttgaaaaaagcatgtctgcaaggggtttctgacttctcctagcctctggatgtatttctaaaaatcataataattacttttttcagtttacaaaaataaaatgtcttcatgataaaatatgtagttaggaaagcaaaataagaaattaaaaatcactcataatccttaagctgccccaatctaagtaggcaaatgataagcaaattgagtttcaagatgatcctcctagcaacactctctttaaatgaggttaaccccacctccaggcccctcttttggaaatcttggagctttccctgctcagagatcctcccttccctcaccccaataccctattttcagagcagacagaggcacctagtttctgaggagcagtcttttccccaaacatcaaaataaaccacaagtgtttaccttcacatggtacttttacaacttccaaagccattctgtgactcgctttcatttgcttcctacggtaacccggtaagataggtgtcgtcattcccatttcagagaagaataaactgaggctcagagaaacttagagatgtgccaggaaatgtcagagtagagacttaagtccaacacccaatattccagaacctgtctgcctgcttttgaatctttgcaccagtcacttccaagctgtgtgaccttggatacagcacttaacctctctgaacttcgggtttcctatctacaaaatgacaataatgaaaatgcctgcttatattattattttactattattatttaaggttgttgcaaaaattaaaggagttgatacagataaggtgcttagaacagtggctgacaccaaggaagcgctatattacttgctattattatttatattatcagtttttattcccaggacaccagcatgcaggaggattctaggatgcaaaagggctgagtcagaggcactggcctgtccccaggggaagcaggtctcccggcgccctggctgtggggagggtaccaaagaacagacagtgctcttctgggcacaggcctgtgctagagccaggcagttggtggtcatggagttggcagcacaaggtagactctttaagcggccacacattcacaggatagcatgttctggttagccagacactccagtttaaaatgaatttcttttgctgagagcaatttaggaacatagattaagccttagaaattctggaagttgcattagtcctcagttaatcctaaagaagtcatagggcggcctggtgtgaggttctagctacaagaatgttcagggccacgaagttctcgccaacgttggaaactcttcagcaccccaaagtaggggattggttaaattagctcttatgtattcctcaatagaacactgcagccattaaaaattatgttgtcaaagaatatttggtaatatggaaaagtaattataatgtgttagcaagagagaaaaataagttccaaacataatgcagagaactatcccatttgatagaatactgatatacatggatactatgtaacatttacacatttctgagaaacatagaaaagtcggaacatataaaagatattattaatagcttccgtggggtgacaggattataagtagttttgatggcttttttttttaattttttcttttgttattgttgttttttttaaatttagagaccagatctcactctgttgcccaggctggagtgcagtggtgcattatagcttactgtaacctcaaactcctgggctcaagcaatcttcccacctcagcctcccaaatagctaggactacaggcacacaccatcacacctggataataataataatagtaattattattattattttgagacagagtctcacccttttgctgggctggagcgcagtggcgcgatctcgcctcactgcaacctctgcctcccgggttcaagcaattctcctgcctcagcctcccaagtagctgggactataggcacgtgccaccatgtccagctaatttttgtatttttagtagagacggagtttcaccgtgttggccaggaaggtctcgatctcttgacctcgtgatccacctgcctcggcctcccaaagtgctgggattacaggcataagtcaccacgccctgcctattattattattattattatttttagaaacagtgcctctctatgttgtccaggctggtctcaaactcctggcctcgagtcatcctcctgtctcagtctcccaaagtgcagacattataagagtgagccactatgcccggcctattttctgcattttctaacatacacatgcactatcttaaagcacaaaaaaagctattaacaaagaaataattaaaagtaattagctataagttgtcagtttaaaaaaatctggactgctatattcaacaaagttgtttacattctagatttcaaggcccctcagaagcacctccctgtgtaaatgagggttcttgcctccagaaggtggccccacaaatgaggagtgaaaagtaacagccgaatggccccactgttgtactaatcttgtttgtttaaagagaaactacagacactctctctattaaagaaaaaaagaatgaggagagaccgagagaattagaatgtgctatatacattacaagatcaaaaccagtttaggcccaagtcttcttgtaatttcatctttttcctccctgagggggttgggaagccctctcttaccacaggttaagaggcgagaggtctggtggaatttcacatccacagtgcccttaggaaaagctgggtgtttttggcagattgaagcattctttttccaggctgtgctttcactactgggtacagataatgtggcttaaagagctaatcgggagctggaacagacagaaattcaagagcagagaggcatcaggacctagaacttggcctagactcagagagagctgattcaaagctcagagccaccagggacctgctgggcgaccctggatccatcaccaagcctcagtttccatgttggaaacaaagggagaacgacgtctgggctcagagttaggaaagcactctgttagctataaagcaagctacatggcagagtcgccctcagcatgtgaccccgcttcaagcctgccatccagtctgggatgtcagacccagggttctactggcaggttagagaagaggagtcaggtgggagacttggaagatttggtacaacacatggaagatttggtacaacacagaagtttctgcgatttcctcagactaacccttaattaactacaaaccacggtctacgcctcctttccatcaattatcttatttcaccttcatagccagccttggaagtggacttaggtgggtctgtatggcagacaaggtccttgaggcttagataactagagtctctagggtaggcctaagtcacacagcaaggcaggtccagggccaggatttgaacccaagcctcagtcctgaaggatgcccaaggaacatagatgctgacacgccacacttttcttccttccaggcaaacatgaagagaaacagcaagaaggtggcattgtttctaagaacttcacaaagaaaatccagtaagtaacctggagtcatggagctcagggtgggagtggaggagggggcacacctgggacccatgatctggggtctctccctcttgggcatctctcttttaagacacctccttggggcagggaattgaaccctcacacctaacgaggagaaaatatcccagcagacctgtaatagggtcccagaagggggagcacatagattgcatcatctcatctgctcggtgccctgtgaggtgggtattaaaaaccccattttatttatttattatttatttatttatcttgagaccgagtctcactctgtcacccagtctggagtgcagcggtgtgatcccagctcactgcaacctccacctcctgggttcaagcggtccgtgtgcctcagcctcctgagtagttgggattacaggcatgtgccaccatgtccggctaattttttgtatttgtttagtagagatggggtttcgccatgttgcccacactggtcttgaactcctgggctcaagcgatccacccacctcagcctctcaaagtgctgggattagaggcttgagccactgcacccggggaacaactcccttttatagactaagcatctgagggtaagcaagacaatgacttgtccacaatcacacagcccctacccatggggcatagctgagggaggacccctgtcaccatccagaaagaccatcccctgattccccaaatgccccagcagaatatcttccaggctgcttgctcagcctctgccctgccaggaaaatgagcaccttctctagggcatccacaaaaatgaagttggaaagtgtcctgagaacactgcatactacccagagaggtttggaggctgagacactgggacacaggaagagctattttgctgaggggagtagaagggattcatgtttaacagggaaagggagcctgggggaaccgtgagagcagccaaggacaatcaggctgaggccatgaaccaaagccaccacgagcccctagctggcagtacctatagggagcagagttgcacagtgtggtcacgatggctgcacttaaacaactgccaggtgcttcatacataccttctccctaatcagcaatcagcgtcactccactatgtgcgtttctggcccctaaactctctctctctctctctctctttttttttttttttttgagatggagtctcactctgttgcccaggctggagtgcagtggcacgatgtcagctcactgcaacctctgcctcctgggttcaagcaattctccggcctcaatctcccaagtagctgggattacaggtgcatgccaccatgcctggctaatttttgtatttttagtagagacggggtttcaccatgtttggccagcctggtcttgatctcctgacttcaagtgatctgcccgcctctgcctcccaaagtgctgggattacaggtgtgagccactgcgcctggcccctaaactcttttccaagccatcgttgcatttagcctttgcagcaaaagtgtgcatcggagaggagacatgaccctccttgcaatacagggaaactaagtctcccacaggtgaaaggacatacccaaggtctttacagctagaatttagaagggcccagaatagatccctgacctctgagttccatgctcagtccttgggcaaggaatgctgtttcctcatctgtgaaagggatgctgattccagccttgcagagttcctggctgaaagtgacataaggtcatggcccagcgtaggtcctcataagtgggagttcattattactattgttattgttgactcttaacttttccatcagcctttgcaaagaaattctgtgtgtggagagatcacactagctgaattctgaggcttcttccagcttgggattctacattcctgtctcttcccccacatgtccgtccctggccctcccacagcctctgcagttcttggaagcctgtggacacttcctgataaggcaaacgccaaaccatttgttcttcgtgtttgctggcttgcctggcatctccgtgccccacacctctccctggtttagcaagcagattaaacattgctgagggagaggaaggaaggcagggggtggggggaagctgatgtcaaggctcaaatgaggtctcagggtggagtcacaagcagggcatagctgtaaaagggactgtgtaagaaagaagtgaattaatcatcttaaaaggggtgtgtgtgtgtgtgtgtgtgtgtgtgtgtgtgtgtgtgtatttcacatgctccaaggccttaggggagatagcttgctggaagtaacctgatgagaaatgcctgaaattgctccaggctggtgctcagctgctgagctgggctagttgttaaaatattcagtggtccccaacctttttggcaccagggaccagtttcgtagaaggcaatttttccatggactggggaatgaaactgttccacctcagatcatcgggcattagattctcataagaagcatgcaacctagatccctcgcatgcacagttcacaacagggttcaagctcctatgagaatctaatgccactgctgatctgacaggaggcggagctcaggcagtaatgctggctgaactgctgctcacctcctgatgtgaagcctggttcctaacaggccacagatgggtgccggtccatgatccgggggatggggacccctgaatattggctagctattgccctgagccctccctagccaaccccagtcactctgatcttgtccccaggaccctctaaacctctccaccttccaacaactaaagggtcccaggaccctcctccatcactatgacatgcacccatcccttctgaatggtcagtgcccagctgcactagttgttaaatattttgaatctcagctccgggtgcagggagtcctggctccatgagaaagtgagtgggtaacttggggcaacttgcttaactgctctgaccttccattcccacatccctgcatggaggggttgtgatgggagtgagaggatgtgtataacgcattaagcatggaatacagactcagggcttggtccatgggaattaatattatgaaaaggcttcacaaggctggactcacactccagcagctgggactcctgggagctcctggctctgcccagactctagacacctaggagtcgaactggggtctgggacacctctggaccaatctcaggagtcctcgttgcctcctctcccagggaaaactccagtcattagaggacagggagattccttcagccaggctgagatccttggagatttccacccaggcaggatgctgcagctgtttgccttaaccatggcaaggaaattcatctcaacacatccatctctgtgtgaaaagccccatttggactgaataaggaggagagggagaggtcttgggtctcagctttcaaagtccatgatcttcctatttggttaggggaaaccaaattacagtcatttgcaataccgtcattcacatcccatcttcactattttttgccttatatgcttacattgctgtaccatgatttactaaaggtttttttttcttttagatcatctcatttttgataaagttaaattcttatcactgaaatgttcactgaggaaagcgatcatgaaataaatccaatgaaagcaaactgtggttaaattctaactagataatattgcctgcctaagggcctcagctctctcattgttaaaaagggaaggtagcaagtgatagaggctaaaggcgttaaaggcatgttagtacttagcagagacattccttcagatgtaagtagaagcactgaaagagaactgaagaggaattactttcccaccaaatgggtttaaatacaagtcacttggttagagaccttggacttgtctatctctctgagtttcagtttccccataagtaatataagagcattgtcatggacaatcaggaagatcctttggggccctgatactctgtggttcaatgatcctgcaatttgtatgatactccatcttgctgtcaagatgccaacatgtaaggtcaaagactgcaacgtaattctcactccaccctaagaggtgggtactattattgccccctttttttctgcaaagaaacaggttcaaagagtcaagatcaccagccccatgttgtgtggtcaggaagagtcagaatttgaatgcacgtcagcctgcctgcaaaacccatgctctaggccatagccaccctgtcacactgtacctggtgtgcactgggttggtgtgcacatggttaaacagtcagcccatccccagcattgggagggaggtctaaacttttgactttgtctccgcttcaaaagcttgacttggcagctttctagttccctctttttcttccaaatgggcttcccagaagcagccttgttcatctccatggttccaatctggcaaggaatctcctgggtagatacggctcatgtggctacaggttgttgtacccacaaaaaaagaaagaaagaaagaaaaaaaaaaaactccccagcccctccagaaggagtcctgcctatgatcaggaatgggcttacctcatgccttggttctttcatcaagaccctcgtatttacaataggcagagccagcagggatcagtggaaagattttgattgaactgccggtccttcctgccatagtccttctttcaaatgtctggtgctgggggaggcaggagagcatcatggtcagatactctgagtttggagaccaggattccaattccatttcctatctgccatttgccagctgagcaaccttgggcaaagcagttcacttctctgagtctcaatttcctcatctgtaagatggggatagcaatggaatctgcctggtgggattattgttaacaccaaaatgatatgattcagctaaagtacctggcacatagaaagtactcagaaggtcatggatttcatggttaaaaaaaataatggcaccccaatgagatcactaatatgtcctcacagttttaatagtttgttgaagaaaccaaattctcaatagtctcattcacccaaagcaatccaaaaatcataaaaataccttattagaagttggaccagatttaggtttagaaattccatcttcgatgctttctcacttgttgagcttgtcatttgatttcccccaagtctctgtttagtgatctgtagaatgggcatattaattcttacctcttaatcatcctcttacaatactccaaccaagtattgtctataactgagttttaagaacaagataattggctgggctcggtggctcacgcctgttatctcagcactttgggaggctgaggtgggtggatcacaaggtcaggagttcgagaccagcctggccaacatggtgaaaccccatctctactaaaaatacaaaaattagccaggcatggtggtgggtgtctgtaatccacactactcaggaggctgaggcaggagaattgcttgaaccttgggaggcggaacttgcagtgaaccaagatcgcgccactgaactccagcctaggtgacagagtgagactctgtcccaaaaaaataaaaggaagaacaagataataatgatctgctaagtgattgtattagtctgttttcacactgctgataaagacatacctgagactacataattgatatatatatgaaaaaaagagttttaatggactcacagttccacatggctggggaggcctcacaatcatggcaaaaggtgaaaggcacgtcttacatggcagcagacaagagagaaaatgagaaccaagcaaaaaatcttataaaaccgtcagatctcgtgagacttattccctaccatgagaacagtatggaggaaactgccccctacccatgattcaattatctcccatcaggcctctcccacaacgtatgggaattatgggagctacaattcaatatgagatttaggtggacacagccaaaccacatcagagatacttagggtatgaacaaaatcaaggcttattttgaataccatcgagtatgttgccatctgaaatctacatgtggccagcttggccccttttatccaccaaggtacctagtgcttgcatcaccattaatgcattttgtagtgaagcactctccagcaagcacatgtcagatgaaaatgtgttgcctgttatgataacaccttacttgcgctctataaagggatggtagtggtgccatttctgctagtaattgtggtcagtagtgggtattaaggtgatgacttcaacctgggaccaaatatgtgggccacagctctcttttaagttaagaactactgttcaaacagcattttaccatttgcaaagcatactcagactctgaagttcaaatactctacaagttcagtattattatcctcattttgcagatgagaaaacaagctcagagcaactgaataatcttcccaagaccacacagctagaaaggggtagagccaggattcaaacccaacattgtatgtccccaaagcctaagctcttatcaaaaatatttcctctcaagtgaataaaagaatgtttaagcaatattaacaacaataaatgaataaaatcgtgtgtttctcctaggcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataaaggagctgacgttctt

SEQ ID NO: 38691 - DNA, 86407 bp, Homo sapiens
cagtgccaggctggaggcggcagcggttggaggcttcgcccggctttgcagcggggacttcggcggcggcgcctcaggcacctcggcccgggtgagcggctcgcgcccggcgggggcagcctgagagcgagtcgggcgggcggacctgtcctctgagcatgtgcctgcgccgcctgacaggagccggcggggcgaggggcagggctaggtggaggggacagtgctgggtgggcgcgcggggcgcgggttcacgggctgggttgcaaggggttagggccgggggctgctgtcgggggctcggggaaagggagttggggaccgaaccaggtggcgtggggagcgtgaagcagggtccctgtggggaggaggctttcgaggtccggaacgctcctggccgggtgcggagccgcgggccgaggtgggacgaggctgcccagggaaggcttttaggggtcagggatcgcctgcttgggcgaggtgctgggagggaagggctgcttcgggcgaggcgtagagcccgggggctccaggcctggggactgggtttgggccgccccagggaacgagtgggtgggggcgggtaggggccgggctcacgtggggccggggcgagctgggccctgcgtcgggaggggcgagggcggccgcctggcctgcgggtttcctggctttgggtgcgagaccagctctgggccctgcagatctcggttgggggtcaggcggggcggggcagagctggagctggagtaatgtgggtgggggcggcttgggaagaggctgagcccggccaagggagcagagggctgggactggctgggggttgggaggggaggaacgaagcaggaaggctgtcggatcgggggcccagggtgtccgagtgaactgggtgattcagaggtgtgtttccctaatagcggggcagctggcgagggacgcagtaaaaaggagcgaggtgcaggtggggccccgctgcgccgaaatgactgaggatgaggtcagacgtggagggtgggaatgcagaaaccgagctctcccgcctgtccccaccggcgcacgctccccagctctccgtctctcaaatgatttgaatgtgttgggggaagtggcaggctgcggtgagagctgagaagaaaggggcttcctcttggagggaggcgctggccctggcatccttttttgggagtgttcaaaggattttgaacgctggaaaaggaatcgtaggctttactgcatcacgatttagaaacacatcctatatttggccgtaatgtaggctgcccttgttttgtggtgtctaaagtgcttgctctacatgttgcaaacgtgggattcagagtgcgaagcaaattgcaagttgttcatttcccccggcatggtaagatacaaaggcttttccctcctataagacatttgaaaagaattgaatgtagtgcgcgtttaataaactggtcctgggtggcgaatatatttacttttggaaatagttaccacaaaatattaggccctcttaccgcagcctttctgcctgggattacattctaaaacagtacttgtagggctcttagtcactctatataataatgcatctcattgtccttatctggcagaacgttctcctgacaccagggcctgctggaatagacagaaacatgattaagtataagcagttgctttgtaccgtctgttcagttgtgaaggcaaatagatacctgtttaatattaattcactttctgcattccctgtaaaactgaagaaatgtgcaaaatctattttggacttggttctatacatttcagatgatttaaggaaactagtatttttggtttggaggtatgtttcacagtcataatgtttggctatgaagcataatagtaaacattggatctgagaaatcgcataaataagtagggaaaaaagtgaaataaaactgagaattgtgttgtaccttaggtcttgaagtgcagtgtttcgtggtggaggttagtcgtgtgtactgaggattggacaaagatttggtataaacgtcaggagcacacatttttgacaaatatagaacctatcttgtccatatttattttgattacttgtggaaggtacattaaagcctgatgaattttaatagatacataccgatgaaacataactgcacacaatattgactttttcatgatcctttgttactttgcctgcagattgtgctaatcagcatttatacttatttatatatagtttaggattagattcggtgtcagtgaatagcatttttttaaacaccgttggattttttgataaaagttttatgtttaacttatctgtcacttctgggatccactccaaccatgaggaagagagtcactctaacgactatgagatggaatgttcaaaaggatgaatatcaattcttagttatataagtgggtatgtcgacgagtctcttctttatgatggcaaaattttaatttctcatattttgatttgtcacaaactggtactttagaaacatattattaattggtctgttttacctttgacctcttttccaggggtggggcaataataaatttgagagctacttgcattttcaaggtacaaatccatgtgataaaacctcttaagcttgttttccatttatgacttctctgtgttactgtctccttgaattatgaaaactcttttctgacacttgtatgtctttttaaacttaagataccttttctgtattaaaacagaattcttcatgaatatttcagtatgacctagtacctagaatgttaagtaatagaatctctctgggttttctttgccctagttcagatcctttaaagtgagtgaacaagattctgtactcctttctgagtactttgtatttctagagtgcagaatggaactttttttgttttataacagcttcattgagacatactgtacagttcacccgtttaaagtgtacagttctgtggtttttggtatattcacagagttgtgcagctgtcaccacagtcaattttagaacattttcatcccccccaaaaagaaaccccataccccttagaagtcctcccgtttcatgtaaatggaatcatacactatgtggtcttttgtgtcttgcccttatttagcatattttcaaggtttatatgtgtggtagtattgtatagtacttcattttttttttttaatggtcaaataatattccattgtttggatatgccgtattttgtttatccattcatcagttgatgaacatttgggtgtttttcctttttggctattatgaataatgctgtgaacatacgttttcatttctcctgagtatttacctaggaatgtaatcgatgggttgtatggtaactctatatttaactattggaggaatggccagacttctccaaagcagctgcaccattttacggtattcaccaagagtatatgaaggttctaaattctccacattcttgccaacacttgttactctctgactttttgattctagtcatctgtgtttccctaatggctaatgatgttgagcatcttttcatgtggttggtgaacatttgtatgtgtaatctttggagaaatgtccattcaaatgctctgcccgttttttaatgggttgtctttttattggtgttataaaagttgttcatgtattctagattcaagtgccttatcagctgtatgatttgcaaaaattttcttggattctgacatgtcctttcattttcttgatggtgcccctttttaggaacaaagattttaaattttgatgatttccaatttatgaatagtggggtcttactagttagaaattagaccttaaaccacaccctcctcaatattttggttatataagttgaaacccaaatgtgagaggactggggaaaggtttgaattaatatattttaaggtatgctatagatgaaaaaggattcatcagggaacatgccattcacctgttcaaatcctctggtgacctcacctttacccacaaaataaagttcagactccttaatgaggtgtggagtaaggtgggctctgatttcagcctgctttatttctcactattccccttccaatgtcttcatctctagtgccactccctgaaacatcccagctttcaaatcttgtgatgaatttattacttcatcgcctttctacttctagaatcccacttgtcctttgggacatgggtcatgaggtttttcctccatgaaaacttcctcatctcacaggcagacatttgtccctgccctcatgtattgtacattcatcaggactgtttgctacaaagaactggacctgaatttgagctaatagtctgaaaggtgcctttccatacaaggcagaatgcaatagagcaattcacatggaaggcagactgagattctcttgttcatggcttggtcattagtgcctactggatattcgctgaatgaatgattgtttattgaagttaactggaaagatcctgaggtcagtgggtttctctgattatcatgaatgtctttattgcctatgttaaaataacatgaatggggtaactcccttttgcccttctggcatccaagtccagctcttaccaaaaagtgctcaaatgtaaaactgagtgtttaaaacatttccccaatggcagaacattctcgtccaggttctttcccccgatgaacagtaatgactggcgcacagtctcctcagtagggtagatggccagcgaacacgatttagtcacaccaaatgcatacaggccgaccctgatagtatttggtcagttagtactggaactacccctgtcacactcatgagaatggttgtaaattggattttaagggtgtgtactttcttttcattctttttttttttttttaatgttttgtagagatggggtctcactatgttgtataggctggtcttgaactcctgggctcaagcaagtctcctaccttagcctccgaaagtgctaggattataggcgtgatgcaccatgcccagcctcttcattcttttgttcatgctctcctctcttggggtgtctgactcaaattagtattctttagttatattttgtgttcttatgttcattttttttttttttgagacagagtctcactctgtcgcccaggctagagtgctggagtgcagtggcacgatctcagctcactgcaagctctgcctcccaggttcacgccgttctcccgcctcagcctcccaagtagctgggactacaggcgcccgccactacacccggctaattttttggtattttttagtagagatgggatttcactgtgttagccaggatgatctcgatctcctgacctcataatccgcccgcctcggcctcccagattatgtttatttttaaaatactttaattaaaaatatttcatgccgggcgtggtggctcacacctgtaatcccagcactttgggaagctgaggcgggcagatcacgaggtcaggggtttgagaccagcctggccaacacggccaacctgtctctgctaaaaatacaaaaattagccgggtgtggtggcacgcgcctgtagtcccagctactcaggaggctgaagcaggggaattgcttgaaacctgggaggcagaggctgcagggagcctagactgcgccatcacactccagcctgggcgacagagttgcactccagcctgggcggcagagaaagaatccgtctcaaaaaaataaataaataaataaataaattcacttagcacctttctgagaattaggagaaaccagttggccatttcgggataccttttctttgtgtgttcgttaaagcttggattgtggcaaggtagtacagaagagaaagaaaaatgtcaacttttttgtctagttagggacagtgagctatgggtaccttctgtagttctcgttctaagagagttttgtatttaggggaactgaggccgtgagggtgcaggcctttagggccagatagagctgggcttcactcttggctccgcttcttgctagctgtgactttgccagctccctcacctccctgagcttcactttcctcctctgtagtgtggagatgcaaaaggcttaccttgcagggtcattggcaagattaagcaaggaaaattatatgaagtgcctaatacagagtaggtactgaatacattcctgttccctctcttctctcttaaatgtctgttaatgaatggaactgcagagaagcaaatagagtaagtttaatacattttacatctgacattaagctattaagggtatggattcctactcccacctgaggattttagactttgaatcaaagttgagtcactgaagagggcaaaaaatgtctaattttaggatgggaaggcggtcttaaaaacacctccagtgtttttgcatctgtctgaattggaaatgtctattcagacagtcttctctattcaggtctgtgtattcagtctctctgtctgtgtgtctgtctgtccattttaaggaaagttcctggcaaaagatggatttttttaggatttgaaggagattgcactgcagtgcttgagataactcttctggttacagtgtgataaagtgtaacatcctgtgtgggaaaagagcctctatagttttatggtatgttaaattaggcctgtcatttggatcttacattaataacaaaaatacagttcctcccgtttgctgcagtaatgagtaattaatataatgcaaaggtcagagtgagagagactataaatgggagtaggaaggcctatacattgtatgtggaaggcagttatattttttcccctttggtcaggcaatgatctacatttcttcttaaaaatttatgaataatggattatatttggcaccagtatctcaccatcttttaaaggatatattattttgggagatttgggagattattgctcaggtacagaggtcctcattcttgactgccttgtgatgatcatctgtggacctatatgaatccagctgcctgggtgtgagttccctggtgactctgaatcacagccagaacaggaagcactgtgggctggtctattcctcattttacagatgaggagactttggtggcaggagcttgacagatttacccaagatcaggaacttaactgccccttcctttgtgtggtatgaattaatttttatagttagttgtgtgaatttatagtatagtgtggattttttatttaacaatgtgaacctgacatggctttccctttgtagtctttgacccagtgcagcagttccatttgcttagcctttcgtcatgctcttttgccagatctgcaaaccaagcctattcacggagttttcttcagttaatcaccacagttggtagcatgtacctatgttgttgttgttgttgctttttcccacatattcaggttgtgcatgtattaaactgtgaagtttggtccaggtttttaggaggatttttagatgcatttttaggaaacttgaaaatacatgatatctcttggataaacctttggtaaacttgatttctatttttaatgtaaagctccttgacagtattttattgatccttttaaatttcctcagtcttataatctgagcactagtaagcagtggttttaaagatttgtcttgtatttggaagaccgattattattgcaaaggtgcccttgcattgcatcttgccagaaaaattggcattagtaggccgtctgtatttgaaaacaccaagtttagacaggaacaacacaggcccagtactgaactattaatatatagattgtaacagacataatgaaaaccacttaggattagcaaaggttgattattgtttcacaatgtggttgttctgtctttgggaaaccaagacagactgcaagtctggtcacatggtggtttggtgtaagagactttcttgctccattgtggaactgggtgtgggtccccatgtctcaacaactgctgaggccttcattctggatgaacaaagctgtagatttttcatgagagaccatagtagacacacatgggaaaggaagtgttaggagagtgaagccgtcaggctgtattttctacttttgatatcataggggtgcatgacaaaattcacaagcatcccttccttatgacaaatgtttaatcaccattatttgcttacttcacaggaaagatacttaaattccttttcgtaatggtcaagcattctttcctagttaaagattctaattcctttcattcttaggaacttaaagaattgactgatttattaacataaaaactcaaatgtggctggagtggggactgaggaacacacgtgaaagtgcgctgtcatctctgttaagcagagggatttattaggaaactagtcactttggaagctagatggtgaattaattttgtggttagtagtatctttagcttaacaatgtcatcctagtttttcttggcaagcaagagagaggctggagccaatgagggctggccacagttctttgggggtgatatttaataagatgcacgttgtctgttttagaaatagagtaactgtcctttaggctctctcttctgtgggccactgttgctttacagtgctactgtaggaaaagataagttggaagtcttcttttttctccctaagactgctagtttgatctttttatgcattatgacagtgtcttgagtgcagtggactgaattacttttatcaagtagaacaaataacatatcataccttcaaaggatggttatgaactgtgtgtttctctgaaagtgaatgagcaagagcccagatgaaatttctgttttggaggcaggcagtgtgtacatttggtccccaactcaagactgggttgtgttccagagtctaactcagttatttggaactcagatctactagtagtaatttctatctattgtgttgattcagcattgtaagtggtgggtacgttcccagcctagactgaaggaatctgtttaattcacagcagtttttgaaattgtttatggtgatagtggaattctggatcttgggagctggtagtcatgtgaaagagaagtaaggactcatgccccatgccccaggagcctccctgtgcaggctgtgtggcgtccaggggtctcatgccactgcagccctccaggtctgtgctggccctccttgttcttcatcctccttcatctctctcttaatttgaagcttctacttccctggttaagctcactttctttaaatcatggtagcaaagcacatggttcaaattcatttccctgctagactaccgctgttattcagggttgggatgactacaggctttattcatgtcatttcactcatgttctttaacccttttagaggtgtacaatgttaatatttttaaagaggaggttccttactgataaacagattgtctctttgaaatgtttgcattcagtcattacagcaaggtttcaaggggaaagttgagcagaggcatgtgaagtcaggcagaccccacgtaaggaggctagtcctgatacctggaatcaggaagaaaccatgcctgctttagaaaggttcttcctgtcactccaaaacagtgactctgctaaatttttttcaaaatactttctgatcttttttttttcttttccatttgggaacttcacagcttgaaagggtcttaggttttggcgaagtggcttggtttctgtgacctttggaaagttgatcagggcatggtagtgattgtaaattggggcatcttataatggccagagctgggcactcgtcctgtctatttttctattcttttataaacttatcaaaaagtcacttttttcatcaaacagtgggaaattattgacctctccattctgttagtgcctctgtgaagggtttgaactactggtttcaaagaactcttttcattcaaacattttatgatgcaaaatatattagggacttgatttttctggtatcatttaaaaaattcgtattcacaaagtcttatggcaagcttaatgttttgatttacttttaaattatgtaaaagtttaaaaaatacattacaagcctcctccagccctcaagcacatgactctttgatggtgaattctgcagtatagactgtgagctctgtgggaattcaggagacaggcgttggagagtcagtgtttgtgggacactgggagtgagatcctgcctgagggtgtgcctaatagtactgggctgactcagaactggtgtaattagggaagagtagtgtaagatgggtagatgagatggccctgattatggaaagtgatgataataggttatgcatttatacaatatgttagagtaaaatgtaaatatagtttggttatggagttataaaggtaggtgaaagtgtaatttgtgggtgtcactagtgttagtgatttctatgctaatactaattacatctgggattaaatgactagagattgagtacagaattattttacagtttgtgaaagtgaacaccttataatactgctatattccatgttccttaaaggtagaggatatcttacattttttggtgcctccatttcctagcatattgcctggtgcatagtagctgttcaataaatgttaattgagtaattgaatttcaactttgcatgatacacttgtgatattgtcagtctttccattttcctagaagatgaaaggaataaagatgttttctatggcctaggactactaattgtaaatatttgccgggtgcggtggctcatgcctgtaatcccagcactttaggaggctgaggcgggtggatcacgaggtcaggatgtcgagaccatcctggctaacatggtgaaaccccatctctactaaaaatacaaaaaattagccgggcgtggtggcgggcgcctgtagtcccagctactcaggaggctgagggcaggaaaatggcatgaactcggagacagagcttgcagtgaactgagatcgcaccactgcactccagcctgggcaacaaagagagactccatctcaaataaaaaaaaaaaattcttattatgttattataaactaacttcgtaatttttattgtaaataaatatgttagcaagatgtttatatgtgtaaatttacacacacagatatacatacacattcctttattgaaacatgctttatttgtaaagcaaattttggggttttgattatttaaagcatatgttctgataaaaagcaggataacacaacattttggtactcatcacaaattaacttaattgatttcttgaataaattaaaactattggcagcatgggtttcttatggctgtattttatagctctggttagcaagtttgtgtgtgcgtgtgtgtgtgtctgtatgagtgtttgagacagggtcttgctctgtcacccaggctggagtgcagtggtgtgattgaggctcaatgcagcgtcgccctcccaggctcaagtgatcctcccacctcagcctctcgagtagctgggattacaggcatacgccactatgcctggctaatgttttaatatttttgtagagacggggtctcactgtgttgctcaggctggtttccaactcttgggctcaagtgatcctctcgcctcagcctcccaaagtgctgggattataggcgtgagccactgtgcctggcctggttagcaagtttgactttagagtcaatgaagtaacatcccaatggaagcatgctttcatttaacaatgaagatagatatggcaagaaccataatttctgtcaaggggatttaaagttaaggtagccattgaaaaagctgttttccttcactatctttctctttttgagtttctcatcctttaatgcgctattgtcattaaatagccttatgttctccctgaaggaggaggtgaaggtggaggtttgtctgcagtggacctctaggtgtgccctgcccagcaccagagaaatcatagggcaggccttagggcatttgagtgactcctggagccccaaggatttaatgtatttgagaattcgtttgacttgagaatttgacaaggaccgagtaagttaagatagggtgaattgtgcaccactacaactgttaaaatgatctaatcgcttaggagttcatttatacatactaaagtctgaaaaactgtagactttggtttatattgtattcacgataagtggtcacaaaaaatgaattattttgtaattgcatttgtgtgtatacgtgtgtgtgttatttctggtagttttttgagggtaccataaaccataaatgtagttgtttaaaaaagtattagggataggaagcccctggatctttttgctggccttctacttaaaattatttgtcctactttcataaggaatagataatttctctttagttactattgtgatgtccaattaatttagcatagagaattaaagattataattttcaagtcttgatacagtttggaaggaaaatggatttgggagagttagggctacagttttaccagctacagctgataaaagctttttgtagtagagtatttgctcttagaatatttagcccaaatgtttccttctgaaagtgggccgtgtttatttgtcttcacttccctagagatattttcattttattggtgaaattgaatgtgtgctgttttcttcctgaagagcctgagaccttcttctaaaggtattgaatggtggtaaagtatttggtagtaactacattatctccagtgagttaaattcttagtttcttgtactctattatagatactgatattgagtgttttgttttgttttttccttcgctttagaagatgcatatgctgataaggaaatatttttaattttaccaaaagggatcaggcagacaaaattatttttcctaaggtgcagtaagattgtaagcgctatactttcctatttctataggatgtctgaaaattccagaaacatagggagatttttattttaaacagtgttagttttcattttcttttcttttctttctttctttttgtttttgaggtggagtcttgctctgttgcccaggctggagtacagtggcatgatctctgctcactgcaacctctgcctcccgggttcaagtgattctcctgcctcagcctcctgagtagctgggattacaggcatgtgccaccacaccccactaatttttgtatttttttttttttttcgagacggagtctcactcttgtcgcccaggctggagtgcagtagtgcgatttcagctcactgcaagctccgcctcccaggttcatgcctcctgggttcatgccattctcctgcctcagcctcccgagtagctgggactacaggcacccactgccacgcctggctaattttttatatttttagtagagatggggttttaacgtgttagccagggtggtctcaatctcctgaccttgtgatctgcccgccttggcctcccaaagtactgggattacaggcgtgagccaccaggcctgacctaatttttgtatttttaatagagatggggtttcacaatattggccagactggtcttgaactccttacctcaggtgatccacccgccttggcctcccaaagtgctgggattacaggtgtgagccattgtgcccggcctagttttcattttcaaatagcatgctcaatacgtttttcttcaagctccagacacttttgcgagcaaaagtacataattttaaagccatggatccaattattaatgtggaaaggtaattatgttttaaaaaataaattttaaagtatttttcccatggttttactcttttcagataccttacttgtcaacagaaggctctttgaagctactactaagaggtagtaagtaagtctccacaccaaagagaaggtgggaaggcacccccaaccatctggttgcatgagtcaaattaggcatcactgttgatgcacccttcatatctaaaacagttttaaattcagttgacttcaagtcttttggctccatcatctctgtttctactgggactgtgacttgtggcctggacaacaagtgccgtgacttcctaactagcttccctgaatcctttcagatgctcccacgtgcagatccattctccagcttcattcagcgtgagcttttaaaatgcaaatctaattatgtcacatactcatacttaaaaaatttcctatggctcccaagactgcaagtacagataaaatccttaacatggcctagaaagccctctgtgatccgggttctgctgacctcgcagcctcttctacccttgctctctgggctccagcctctgtgggctaagtagtccagattctgacaagtgcttgcttttgatacagacttttgatattttgttgttcctcccagctgggactcacttttcttctcttattgcccagttgacttctcattctttgatttcagcttaagtgtcgcttctctgactgcttctgttccccgattattgactcagttaccttgtgttcttctgcattccagcacttgccacagcggcatgctaatgtttgcacgaatatctgattgtgttgtgtctcctgcagtggactgtaagctccatgagagcaggggccaggtctgcttgctcacagttgtgtctctcatgtctagcatggtgctaggcgcatggtcaaagccgagtgaatagttgttgaacaaaagaatgactgggattaaggacctattcaacattcatagttgagtatatatgtaatacgtataaccctgtggatgttagtaagtaatgtggtttgcagtgagttgtgtctgttttactgggggggatgtggactgtatcccagtgaaagaaggatttcctgtagactctgataggaccctagaaatcatttattttagttcttccattttatagatgaagaaacaaacaaccagaggaccaaaatgatctagctgggtaggtaattatgtcaagataaatttgtgtctgacatccaagccagagattttcctactcttccttaatgttcctttgaaacactgtcaggagtacatgttcatttaatccatttaatctccgcttgcccaaggtatgggttaaaaagggaaggctgaaattcttcaggtgaaggtgattattttgttttttgacactgctagttttgcctgtgactagccttatgaagttattaataaaaatatcccccatccctttttaagatatgagcatccagtaatttcatttcctggtataacagtattgccaaataattaataaaattttattgtctactccatatgactaagtagtgaaaaacagacttaacaagtttgaactgtcatacacagtgtgttttttaccagttgttgataagaaaagtaggtcatcaatatagaaagaatgtttagaaacatattcaaggatttttttttttttttttttttttttttttttgcgacagagtctcgttctattgccaagctggagtgcagtggcgatcttggctcactgcaacctccgacttccgggttcaagcgattctcctgcctcagcctcccgagtagctgggattacaggcgcgtgccaccacgcctggccaatttttgcatttttagtagagacggggtttcaccgtgttagccaggatggtctcatttcctgaccttgtgatccacccgcctcggcctcccaaagtgctgggattacaggtgtgagccaccccgcccggcctcaaggattaatttttaagtgagattgctaggtcactcatgtctataaaagttttgcggttggtgtgagacctcttgggattaatttggctctttgagttgtgttctgctctttgaagagagacacagaattaagcttctgagtctggtctcctgtggtgcactttagggagatggctgctgccagtgttgtgagtatgcgggggggagggggggagggaggaggcgggtcaggtagcgcctgcctttgtcttcccaagggacgtttcttcagcaatgctttttcaaagctccagggaccaaaagaggtggttgtgtttataaagatgctggtgataagcagaaaattgggagatgtggagggttgtaaacatgtcatccttgcacattatctctgtaatagaaatatatatttctgtcattgaagagctagagatgatttcgaagtccttatatattctcacattttagtaactgcaaaatttctgtagtgtcatttctattatattttaagtgagttacaggcctcattatggcatcttttagttcataaaagggtctctctttaataagatgtgagggaattacagttttgttttgttttgttttgtttttttaagagacacagtttcgctttgtcttttggtatcaagttcagtggtgcaataatagctcagtgcagcctcagactcctgggctcaagggatcttcctgcttcagcctcccaaagtgctgggattactggtatgaaccaccacacccagcccagttttaggaattttatcttttgtcttcaggttcattatgtgttactgttttgctgctcattttacttcttgtcagacttgattttcggcagtcattttcatagcgtcacattacgctctgcaatgcgctcactgctttctgcttcacattgccagtgagtgcttaggtttgactttaggtggtccccaaccaagtctctttgtaagaagttcctaaaatgagtatagattataaaatgtaaatatacgagtgctcttctttgaaaactttaaaaagtatgatacctctttattatacctcaccttttatttttatttttattttttttgggtatcactgtgtcccccaggctggagtgcagtgtcgtgatcttggcttactgcaacctctgcctcctgggctcaagcaatcctcctgccctcagcctcctgagtagctgggaccacaggcatgcgccatcatgcccggctaattttttgtatttttggtagagatggagttttgccatgttgcccaggctggtctccaactcctgagctcagcctcccaaagtgctgggaatacaggtgtgaaccaccgcacctgtaatgtctcaccttttagatactatccttggggtgtgtgtgtgtgtttctagtgttttatgcatgctctttcaggttgttcctcttttttttttttttttttgagactgactctcgctctgttgccaggctgcaggctggaggagtgcagtggcgcgatcttggctcactgcaacatctgcctcccgggttcaagcaattctcctgcctcagcctcccgagtagctgggactacagttgtgcgccaccacgccctgctaatttttgtatttttagtagagatggggtttcactatgttggccaggatggtttcaatcccttgacttcgtgatccgcccacctcggcctcccaaagtgctgggattataggtgtgagccactgtgcccggcccaggttgttcttttcttggacaactgagcacatagtcctctggctaagctaaggattttcagtgagaagtaagatttgcttccttggtcataacagataccctcttgtttgtctcagtacatttgaatgcctacagctggtttctgtattttgatttttccatttttactcatatttataaagtgtaggcaaagtgcagtttcacatttaaagtgttacacaaactggccaactggactgggggctgtcaaagcagcacccacaggacagagctctaagtgccattgttggctgatgtggagaaactgaattgtatatatgattcgggattgattgttggaaaagtatgacagttcatgggctgaaaagttggaactgctccgtactttgtagttcaaggtcactgcatctttctcagaagttctttatctttggaggagttatacgtcttcaggctgaaacgtgacgggcctggaattgatgagctttggaactctctccaggcctagctctgtgaggcccgagcctggaggcttcttggtagatcttatttgcattttctctttattcttagaaactttaaaaactaaatgatattgagttattgaattgaaacaaaatgcatttttactggtatgcctcattcttggcatcttacctgttacctggattaataatgatgggatgaaactatttggaaggctatgtaatacatgtgaatttttttcccttaatttttaccattcctggtgttataatcaattgaaccaacatcaaggctattcatacttgcagtcagtcggccatgctaagtggtcaatagtttttctagaaaaaacatttttttcaacaagtccatatcagcagtggaatacaaatctctttcagccaaaactgctgtgtatgaggagatctgttgtgtatctgacattttgctgtgctttatagcaaatgttgcatgtggtcttttttcttcctcttttaaaaacagcttctattaaaataggtaaggcatgtttttttttcttggaatgtctcatgtatgaatctgttaaagagttgcatgcagtagaaatatgcaattcgttaggtaaattctttctttgagtgtcactgctggatttaatttagaaaatttgaaaaagctcagctatctcatattcggaaatgatgatttttttttttttttttttttaaagagacatgatcttgctagagtgcagtggcatgatcatagcatactgcagcctcaaactcctgggctcaagcagtcttcctgcatcagccttcttagagacagtgcctcattatgttatccaggctggtcttgaacccctggccttaagctatcttcccacctcagcctcccaaaatgctgagattgcaggcgtgagccaacgtgcccggccaaatttttatatttaatcagagtacctcctatatttgctttgggtgtctgctctctcgtgaatgtgtattctatgtaggcttatatattattacatttcccacttccttttttttttttttttttttttgagacagtttcgcttgttgttcaggctggggtgtagtggcacaatcctggctcactgcaacctccacctcctgggttcaagcaattctcgtgcctcagcctcctgagtagctgggattacaggcacctgcaaccacgcccacctgattttttgtattttactagagatggagtttcaccatgttggccaggctggtctcgaattcctgagttcgggcaatccacctgtctcagttgcctaaagtgctaggatttacaggtgtgagccgccctgcccggcctccatcttcttaaaaggaattttttactgttggcattgtcatttaaataactgagtttaggatatttgtctcctcatctgctgtcttacctgcctttttctattgaataacacatcggatctcttctacattaaagtacctgccatacaggtaacagtggcttggaggaaacatggtctttcctctaatgggacattttagagtcttgtggttgccactggctgagggagcattctctgcccactgaacgcttgagtaatcgacgccctggaatggtctcagcaaatgggctgagcaggattttgctactagtaggggttttcctgtatgtgttcctagcaggatgtgtttcctttcatatgaaccatagaagtacatctgctggaatctttaaacagatagcttttcaataaacaggaaaaatgtcaaaattgtcattttttatgagatggaagtagaatagagaaaatgtaacatttactcaggtgttttgagtgtattttatttggtgctgttgcaatataaataccctgtcttgtctgcattttttcctcctaacaccctacatgtttcctatgtagcttataagataagtttttttttttttttttgagacggagttttgctctgtcactcaagctggagtgcagtgacgcgatctcggttcactgcaacctctgcctcccgagttcaagcaattctcctaccttagcctcccgaatagctgggattacaggcatgtaccaccaagcccagctaatttttgtatttttagtagacatggggttttgccatgttggccagtctggtctcgaactcctgacctcaggcgatccacttgtcttggcctcccaaagtgctgggattacaggcgtgagccaccatgcccggcccttttctttcttttgtattttgtgttttgagacatggtcttgctctgatacccaggctggagtgcagtggcatgatcatggcccactgcagccttgatttcctgggttcaagcagtcctcccacctcagctccccgagtagctgggaccgcaggggtatactacaacatcacacccagctaatttttttttattttttgtagatatggggtctcgctatgttgcctgggctggtctcgaactcctggactctagtcatcctcctgccttgtcctcccagaatgctgggagtacaactatgaaccactgtgcctggcatgtaaattttgtacatttaacttcacatggtagtattataagaagcatgcctttacactctcctagaggttgaggattatcacctgactaataagatgaaggttttattgcaagagtacaaattttctctgacacataaagcctttaaaccatagaggtagaccttatttttacttgttcttggttaaaatattcacccaacatgtaagaaaaattttaggccaggcgcggtggctcacacctgtaatcccagcattttggaaggctgaggcaggcggatcatgaggtgaagagatcgagaccatcttggccaacatggcgaaaccccatctctactaaaaatacaaaaattagcagggtgtggtggcacacacctgttgtcccagctactcgggaggctgaggcaggagaatcgttgaacctgggaggtggaggttgcagtgagccgagattgtgccactgcactccagcctggtgacagagcgagactctgtctcaaaaaaaaagaaaaaaaaaaagaaaaattttaacttttttgtttccttagatgttaagtattatgaatattagttatcagcttttacattttatttgaagataaaaagaggagtgtgttatctccttattaaaaatttattatgacagttgctggatagtcaaaacctgtcccgtaatccattttttttctttttaaagtgaaaacaagtttattaagaaagtaaaggaataaaagaatgattactccataggcagagcagcccgtaatcctcctttttggccttcagtatcacctggaaaacttggtgagggagacaactgtccatgtttctaagatagaggtttcaaccaacgcccagagagagcatctcatagttgagcctgtgttctcaacctattcctgcattgtctcaaaggtgtatcaatttttattataataaaaaccattctagaatagttgctgttgtattggaaaataggaggagagtgataaattacatcttaaaaagacaagtaaggtttgtatttcccatgttttgtagaggttaaaaactctgttgcattatctcccattgaaagtaagtttattttgaaacttgtaaatattcctttgatttgcttagtgaataacttactgctacatcgtcttcctctttattactgagatgatcttactgttgcaagcaagggaaagcctatgcagttttaagaacttgtacttgaaagacctaatgagcaagcagtttttccaaagttgaaccactctctgacaggacatttaaaatcatacctagtatttccttggaatttgtgcctattgtgttagttcaggattttttcatttactctttttttttcttttttgagaaaattagatccctttataaaatgctttagttttagggggacattttagtcatctaatttatgatttgatcagtttgggacaatatagctgataacagaactcctaagtttggtgatatgccatcttaatttaaaggttaaaactgaacagtttttaaagtggtaaaacactaataccatttgacaatgcagacagctctcttaagaagaggaagtttttgtgtttgggatagttcccaatttttcctttgtttgcagagaaattaaactgcagaaataccgtgctgaaatgggagaacataaaattctgtaaagagtccttgataagtggtgccggttcttttatatgaaaattctacttttagcccataatcagtagggacttgcttaggttttctccctggatagggaaaagctattactgggctcttaaataataattgccaacatttgttagacagtatgtactatgcttcagattctatgctgagtactttatagtttttttaaaaaaacagtttggagatataattcacatactagacaattcactcatttaaagtgtacagttcagcggtttatagtatatatatataatcaaataatctgcaaccatcaacacagtcaattttagaacattttcattaccttaaaagaaacacaccaggcatggtggctaatgcctataatccaagcagtttggaaggctgagatggaaatattccttaaagccagcaattagttagagaccagcctgggcaacatggttagacccccatctctaccaaaaaaaaaattagcctggtgtggtggcgtacgcttgtggtcccagctacttgggaggctgaggtgggaggattgctcgagctcaggagtttcaggctgcaatgagctatgattgaaccactacactgagtgcagagtgagactctgtctctaaaaaaataataaatagaccgagcacggtggctcacgcccgtaatcccagcactttgggaggccaaggtgggcagatcacctgaggtcaggagtttgagaccagcttgaccaacatggtgaaaccctgtctctactaaaaatacagaaattagctgggcgtggtggcaggcgcctgtaatcccagctacttgggaggctgaggcaggagaattgcttgaacctgggaggcagaggttgcagtgagccgagtttgagccattgcactccagcctgggcaacagagcaagactccatctcagaaaaaaaaaaaaaaactctaagcaaccatgaatctactttctgtctctctagatttgcctattctggactttcatataaattagtatgtcgatttttgtgactggtttctttcatttataatgtttttaagattcatccaagttgtagcatgtattagtacttcattcctttttattgctgaataatattctgttgtacaggtaatatcacattttgtttatccattggatacaatggatagtctgtatttgggttgcttctaccctttggctcttgtaaataatgcttccatgaagactcatgtacaagtatttgtttgactacctgttttcagttcttatgagtgtatacctaggagtggattgctgggtcttatgataatgctttgtttaattgtttgaggaactttcagacttttccacatcagctgcaacattttgcattcccaccaggagtgtatgagggttctgatttgtctatattctcatcaacccttgttactctcagaattttttattttagccatcctagtgggtatggaatagtctctcattgtggttttgattttcatttctccattgattaatgatgtccagcaacttttcatgtgtattggacatttgtacatcttctttggaaaatgtctattcaagtccctttgattcatttttaaattggactatgtttttattattgaattgtaggagttctttttatactctagatacaagtgtcttatcagatataaagtttgcaaaagttttctcccattctatgagttgtcttcgatttcttgatagtgtcctttgaggcataaagtttataaattttgatggaatccagtttttctaatttttcttttgttgcttgtgcttttggtgtcatatcttagaatcctttgcccagtccaaggctgtgaagatttactcctatgttttcttctcagagttttatagttttagctcttatgtctaggtctttgatctattttgagttagctattttacgtattgtcccagtaccatctgttgagaagagtttttccactgaattgtcttggcactcttgttgaaaatcagttgaccaaagatgtatgagtttacttctggactttaattatattccattgatataaatgtctgtccttattccagtaccacacagtcttgattactgttgctttgtagtgaggtaagttttgaaatcaggaaataggagtcttcctaactttttctcttttttctccccagggtcatttgggtatttttggatcccttgcagttccaatcaatcccttcatccatttctacaaagaattcttctgggagtctgatagggattgcattaaatctatatcttagtttggggaatattgccatctcaatgctaagtcttctgatttttgaatgtggaatttcttttcattcatttgtgtctttaatttctttcaacagtattttgagttttcagagtatgagtctttcatctccttgattaagtttatttctaagtattttatttctgatgtattgtgagtggaattgttttcttaatttcacttttggattgtttgttatgattttataaaaatacggctaggcatggtagctcacacctgtaatcccagcactttgtgaggccaagacaggaggatcacctgcggtcaagagttcgagaccagtctgaccaacatagtgaaaccctgtctctgctaaaaatacaaaaattagctgggtgcagtgtagtcccggctactcgggaggctgagacaggagaatcgcttgaaccccggaggcggaggttgcagtgagccaagattgcaccactgcgctccaccctgggtgacagagcaagactccatcttaaaaaaaaaaatgatttttatatattaatcttgtatcctgcaaccttactgaacttactggttcttttagtggattcctcgggattttctgtatataagatcatgtcttcagcacacagaaatagttttacttctttctttccaatctgaatgtctcttactcctttttcttgcctaattgccttggctagaacctgtactacaatcctgaatagaagtggcaagggtggacaagctcatcttattcttgatctcagggagaaggcatctttcgccattgaatattgagttagctgtggtattttcatggatgcccattatcaggttgaggaaattcccttctattcctagtttcttgagtgttttatcatgaaagagtatttaattttgtcaaatgctttttttttgttttttttgtttttttttgattcagagtctcactctgttgcccagactggagtgcagtggcactgtctcggcttactgcaactgctatctcccgggttcaagcaattctcctgcctctgcctcccgagtagctgggattacaggtgcccaccaccatgcctggctaacttctgtatttttagtagagatggggtttcaccatgttgtgcaagctggtcttgaactcctgacctcaagtgatccccctgcctcagcctcccaaagtgttgggattacaggcatgagccaccatgcccagcctcaaatgctttttctgtgtctgagataattgtgtgatttttttttcttctattgatataatgtgttacgttaattgattttcagatgttgacccaacctcgcattcctaggataaatcccacttgattgtggtgtataattctaattctttttctgtgttgcttgatttcgtttgctggtattgttgaggattttttgcatctgtattcataagagatattggtctgtaattttcttgagatgtctttgtttggttttggtatcaggataatactggcctcatacaattagtttgaaagtgttcccttcttctctatctttggaaaattttgtgagtacttggtattttttaaatgtttgatagactttagcagtgaagtcatctgggtctgggctttcttgtctgtggttggtttacattctttttttttttttttttttttttgagacagggtcttgctctgtcacctaggctggagtgcagtggcgtgatctcggctcactgcgacctctgcctcccaggttcaagcaattcttatgcctcagcctccctagtagctgggactcctggctaagttttgtatttttagtagagactgggtttcaccatgttgcctaagctggtctcgaactcctgacttcaagtgatctgccttcctcggcctcccaaagtgtggggattacaggcgtgagccaccatgcccggcctacattcttattacaggtatcattcccttcattttgtgaatgggaaactgaggctcagagaggttaagtaatttgctaatatgttgcagagctcagatttgaatccaaattatcttatgtcagttactaggatgacaatagtagctagtatttattgagtgattaattttgtgtatttaaccatacaaggtactattatagcataagaatctcctgccaccatcccatcaccaattgatcatttaatgatcacttcaactttatatgcattgtacccatttttggatagagaattttacacttaatggagacttagtgacttgctgtactgtaccacggccaggaagtaaatagtacagctgtgcttctcacttacgaggctgtctgactctggagtttgctctcttaattgctatactctattgtgtgcctggagggcctgagacattctgtgcaagaaaagcggctatgccacatgtacacaggtgagcccagatcagatttgaccttggaagtgaatgggctcacactgcccttcaagctccgcttagagatgcctgactcagcacagcactgcggaagcactggcttttcttactgtctctgccctgtagctaacattctactctgtgattgtagcaaaagaacttctatatcattctatccacatgtatttaggatgaaaataagtatgcataatatggaaataacttttttttttttttgagatggaatcttgctatgtcgcccaggctggagtgcagtggtgcgatcttggctcactgaagcctccgcctaccaggttcaagcaattctcttccctcagcctcccgagtagctgggattacagatgcctgccgccacacccggctaatttttgtatttttagtagagatggggtttcaccatgttggccaggatgatcttgatcgcctgacctcgtgatccgtctcagcttcccaaagtgctgggattacaggtgtgagccactgcgcctggtggaaatcactttttaaggtagtttagtatgtatgtcagccagaagatttgtatagtatctttcaatgaagacaaagcattttacatatttatattaatcttcctatttttatgaggttagatggtatctggcctatttgagtgaagaggaaaaatcgtctctctttttcaagtgagaggccttcctcaaatatccattcacatttaaaagtgaggttctaaaagctgaccttatgcctgtgtgagtggaggggcacattgaatggtggacctcactgagggcagtgatgtctgatctcttgtggggtaaggcaggtggtatcttgggagccaggaggaacaaggggctggaggccccactgtatagaaccaggctgtcagtgaggcatctgttcacacctgtgctgggtgtcatccaggcccatagtcaggcctctcctggcttctgctggggagagggcaggccagtaccctggttgtgcagccctgggatctgggtgtccagctgctcctaattcaggctttcagtcattttctctgtagtccctctcccacatccctgtctttggagacacacagtttctccttggagtgttctggggattcacagtgggccttgatgtcctttttgtgcgctcctcctgagactcagctgagtagaggacactcacacttcagtcagttacacgtgcatgacagctttccatcttcgaaagtttattgtcacatttgctctcttgtagcctcttttccagtcctcttgtcctttcatgtttttacctgcttttattttttgctttcattttattaggattttaggaaggagtggagataagtgctgtttgtgtttcttttgtaaattcttcatatcctttgtctaattttctgttgggttttaattgtatgaatttgtaagaacgttttatttatgaaggatgttaactctgacatggtgcaatccttttttcttctacattagcttacttttgaaacacttgcttgaagatgctggtagggattgcagcttctataacttgtacagatggttgcagatggttgtgtggggaagtggagcccaagaccagctggctgtacgttggcttttgtatagatgtgctttccttttgcttttcaccacctcatggaagctgtcttatctaactcacgcttgagaagtattcatattgattccaaaatgaaggaccctggccacgaatcatttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagagaggccactttcacacatgcgttggaagggtaagagactctggcaaaaataaattcgtctctctgcatttagcagtgggctcagggccatgaggaagggaattagaggaaaggaattagcaacagcccaccatgtgtctcgtctggcatgagtggacaggtgttagctctcctctgtatatgaggatctgattttcagctgagttgtcgatgttgaaccatgttccatttccacttagatttttatccaggctccttctatctaaccaacatgaacagaatgtcctgcagtagcacataggaaaattacattgggtgcagtctaggaaatcttaatcagggagggcctggtgatctgaaagcacaaagctttcagtgtctatcagatgatttagtcgaatttggagtctgaaatgacacataagacagcctaggaacctagctctgtgtcacctcccctccccttcagagtccctggtttactagggaagtggctgtggtggatgatcagctcagtgaaaacccagcctggttttgtttccccccgacaatagcccctgcatttttcctttcctaggtcccaactgttactgctgtatcactccaggccttcctcaagtctggtttactgtcaaatagcttcctagcccagtacctggctttgagcttgttcctgtgtaagctgtccagtgtgctcctgccacatttactgtcatcctaaacatcactttgatcacattgctttccatttaaatacttttgctctgcttttcccagacctggctcttacccgttaggctgctttaggctgacttttcctgtttctcactgtgtaccacttagcactaggcggtttggtagtgagttgctctgattattacgtctgtgttagaaggagattagaaggcttttgaagtcaagggtgatggctgtgtcttttgaattcctcccatagctattcttgttgaaacactctggggaatagacacaattctcagacagcagagtgttgatgtctagggaaaatgtttacaatctgaaaaattaccttggcaggctgaggacaaagccacaaaatcgtaacttgtttttcggctttcttcagcctcacctctaccagagaatttcactttggagttttcttatctgtaaaaggggaagggttgaagtacattatctgtcagctcccacccaaccctgaaaggctaattttctttaattctttcccttaatctttccattgaaattaaaactgatgagctgtttctggatcttgaattaggaatttttcatttctttgtaattctttccctgacgcattttgcagttgtctccgggtatgtgctgctaaaagaaatttggattgcaatttggctactttttaggagagcagacaaaatgccataccattctgtttttcctacttggagcatttcatttgtaaaagtaaagctttcagtttggtgcataattctaacataattctcactcttcctttgcagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaaggtaggtaatttgatcttccattctggtagacaccctctgatagtctccatactttttccttaatagattgacagttcactaagaattgtatttgtgaaaccattagactctgatgtaattgaagttaagttccacacgccttactaaccacatcagtttttctctaacagagaatcattaaatagaatagtgacctctgttctggggatgccctctatggatgaaaaaattattataacgatgttgtgagcatgggcaggcataggaattttaagatttcattcttaatcatctgcttttcacaaaaatttttcttttagagtgcagttttaaaaactggcttttactccaaagtaaagttttaaaaacagttacattttcaaatgggcagaaatttgtaagataatattctctttttttgtgaagtcataaggatgagccctttttcttttcttaatttcctttttttttttgagttggaaatggaacaagaactcaagaaaatgtcctcaatatagatttcaattctggacaatagtaagtttcagcgtaggatttaaacagtgttaacaagtggtagaaataaaagatctttactgagaatggttctatgttttcttcaacttcagtagggttccaagccctcctccttcctttatcctcccagaaagcctgctccaaggtgggagattagataggaattttgtgcatttgctgaccaatcatgaatactgcagatcaaaatctatagttactttatcagcaaatcccagaactgcaaataatgaagaaaaaaaagctgtgaagagggcctagaaacagttgttttctagttagcttttaggaggaaaatgagtttggtgagtcctgagctccagtgataagggctgggtgctggtgaggatgcagatgttgggtcgtatgacagctgtttccactctgctgaaaacagcgggggaagtggatccccgctgtttctgagccccttatattcagggtacatctcatcacaatggatcatgtgattctgagagtggttacaataaagtgaatttctgtcagagggttgtttcccattgtatgttgatgttttttccttgggaaaactctcattgggaaaatgtccaattctcttggacttttgtttcagagatgctggtgactaacttgttttattataacatctgatttttacttcagtggccagatagataacacagtagaaccatctcctaaccgaagaagggagatgggtgcctttggggaacaaatttgatacgtgttttcaaatgtaccttcttattggcgaagatgaatcttttcattaagttgaaaatttattttttatttagatacttttatttctgttcaaaaaattgtcgttcagtggcagataagtacactacactgttataagtgttcttcatctggttttggagtggggatttgaactcaaggccagttgcatttggtctccacattgttttagcttattccttcaccaagagcaaggggcatttggaaacttgacattttactggtaggctttatggcagccaactgagaagacagccatagcttgttagctaaggtcagacactggagcaccatgatttgttttggagttacgagtttttatttccccttttatagactgagggataaatgtaagactttttttttccttcaaagaaatggaacaagccaattaagaagcacaaaatagacataatgaatggctaatcttcctctgaattcagacatttcctttcaactttcacatccacaaaggttctgtgagttcatctttgcttttacagaccatgagaaactgagtttcacttatcccatttgagggagacctgtgtgcagtgccccagctaactgatcttatgatttggtttttccttgcattcagtgacctacacttaatgaatgtgtccttgtatttcattctttaaccagcattatgggaactaggatagaataagttgctttacaaattgtcatgtttagatgaggtgttgctttttagaggagcatcgagggtctttcccaggctataatactgtctgtctagctttgctccttaaatatgagtttgttttagaggaggtgacattggtataagctaagccctgtgacagccattggaaataagatcaatacttgggtttctatagtcgataggttcatgagtactatgtgagatttttgtgtattaaagtgtgtgtatttagctcttagcgtcaatgtggcatagagggaagatcacaaatctgggaattgatgagctgtggagttcagtcctggctcagtcactgacttgtagtgggacgtggatgtgtctctttatccttccgctcctctgtttctctctctgtaacataagcagctgtgtataaaagttattttctggccgggcacagtggcccatgcctgtaatcccagcactttgggaggctgaggcgggcggatcacctgaggtcaggagttcgagaccagcctggacaacgtggtgaaacctcgtctctactaaaaatacaaaaattagccgggcatggtggtgcacacctgtagtcccagctactcaggaggctgaggcaggagaatcacttgaacccgggaggcggagttgcagtgagctgagatcgtgccactgcactccagcctggacgacagagtgagactccgtctcaaaaagaaaaaaaagttattttctgccttggaaattctagatcatgtcagaaatgcttctcaccttccatggttctcagctatgaagtgatttccagtgcagttggtgtgtactcaaaattcagcaaagaaaacagttttgttccatttttgtccccctaattcaatgtataactttggcaagtagatgcctttttactcctggctgctttttcactaaggcaaagctgagcccagcaaagaggagtggtcctgtggtccctcatgacagtcatgtgcctaggtagttctcagtaggatctgctatggcagggcttggcccgtgagccctggagtgtcaggtgacacttgccttttttttcttctaagttgctgttcctacctgagatgctggctggttaccaggcatcagtagctggtagaaaatagaatgatcttccatgttatcagaaaacctacatttctctatggggctgactgccttcttgatgtctaccttataattttggtatagtcatgaatatttgaataatggttatacattttacagttgatatttgattgtttacacaatatgagtgagtcttcatatacgattagttggtttgattgtctgtaagcagagtacctgctgtgtgccagcatctgtgccctccaggagcacttgtgtctaagaaagcatcctggcagattgctggtactgaggtgtttgtctcctcattagaagtacagcctcgaagaagaaatatgatggggactccaactacatggtgaacccattaatcccttttcagtacagggctttgtaatactagggctctttaccctggaaaagagactcctacaactttagtgtcttggcaactatgaaatagttttatcatgaggtgttgctttggtttaaaggcaaagaaaaactaaattcccaattataatatgaagttatgtttgaaatcaagatagcaagaaatgatgtttagatgtgtgttaggctccaatacatgttgatagcagcctggcatgattttaaacacgaaccttaaaagatgggtatggcttttaataattatctcatgggcttctgagaatgttttcccttttttgtttctggttatagacaggcaggttagttttggtgatgcgtttgggactctgtacataataatactgaatatgtacacgttggaattaaggtggattatgaccctttcagaaaggctcccatttgaaaacatggttttccatgaatttcttttgaaagctatttagtgtcagcagtaaataaggcttcttattgcaacctcatgaggcttgtggttagattctgggagaatgtaaaataagttagacatggtttctgtcttccaggacttaaaatctgaagtgaaaagagtaatagggataaatacatcaaagcacatgcatatacaaagacacacacatatgcagcaagcagcacacttaagaatgaatgtatgcttattttaagcatatggtttatgaggtgtttgttaggaaggttttattagggaaagtgggatttttgaagaggtcactgccggaggaatatagaaagtcctcagtcctgaggtgggttgatttagattagcacacgtgattcccactctcttttgtaatgcttccatcaagctgtggcttgccactctgccatgacttttcaaggtgtggcttagtgcatttacttattctttagtccttcagaggatgaataatagcagtcttgctgaacataagttggctttgtggttttggctatgaggaatacttttttttcttgccacaactgcacaagctgccttgtctcaagagcacacaggttttcagccctctgtgtaatctaccacgttggcatgaataagcctttcctttgtggagtagccacactcgtgacgtagatagaactgagacattccctccctattgtgaaccatggagggctcatacacaccagtgtttctggatagatacacatacaacccccccgtcccctccctccccccgacacacttcatatcacaacaagcctgtaaatcctgccttaaacaagtaagagggggaggaatcggtaagaattatatgctcttgatctcttgacattctcttggctggaggatgcgaactagatggctcctgtcttcccaagttgctttctttctcccttccttccttgagtattgtgaaatactgtgaagcaactttggtgaattggaatgatagctgatttcaccctcacagaaactacctgggacaagaatgctgctctggccaggataggatgggtatggccaggtctctgttagctttttgggtcatgatctcttcttctctcccatgggctcctttgttgtagctgtgtggtactttcttatacacaactgtgtttctcccatttattttaggagctgtgtgtgggaatatttgggatcttgctttatttatgtctgtgaacaatttttcaactcattttgcagtttttcatgtagggttttatgaaagaatttagctctacagaaaatcatttgaaagactgttttttttttttttttttttttttagttctcccaagggtgatacatagccagtcttctagatgcataggattaagagctcattgcctataatagcatatattagagcattaggactttaatttcttatagaacctaggttgatgaaggcagctttggaatgtttctgtcatgttggttgaggaagagatcttgattcatttcagtcagtattccactaatgatgatacttggtggtcttttcttcctgttcattatccagctcagatgttgcctttgattatttactgaaacagaggaactcatccattgggttctcttagttgcttcttcataccactggtaccacagcctgcgttatcacattattaaaattattattcacttaacggagggaatggttagaattatatgctcttgatctcttgactcacttggatagaggatgcaaactgggtggctatgtatatggtagccttttgtgcaggttctccaaaaacttgccttactatattgtggtaggtggcctccaacactgaatagggctagcctgtgtaaccatagggtatggtggaattgatggagtgtgaattctgagactaggtcataaaagcccactggctgctactttgtctcttttggagctgccatgttgtgaggatactccagcagctctgtggcaaggtccataggacctcctgatgactgccagcaccagctcaaccagccatgtgatgagccatcttgaaagtagatcctgcagccctagtaaagccatcaggtgactgcagccctggctgacactatctcgtgaaaaaccctgggccagagccacccagataagctgtttttgaattcctgatccttagcaactgtgtgagtaataaatgtttattgttttaatcagctgaattttaggataacttgttaatcagcagttgataactaatacatatattcttagactgtattacgtgactcataatgttagttcacacaattcatatatgagtaattcagagtgacttaaaaggctttctggtagttttgaacactatatttccacctagcctttaagaaaaaaatctacgtagaaatataatatctatatacatataaacattcttaagtcctaagtgaataattgagggattcctttcaatagcaagagaaagctatatggcaagattttgttatcctgtattccatggtaccttcatataacctaaaaaatgtgttataagatcatagtcattatctcgtacttaacttcaattgtgttattagtttttaggaaataatgtgcaatgttaacattgatgggactaaaagtgatgttttattttcttctttataattacctgcacttaaaaatatttttttacaatgaacttattacatattgagattttgaaaaatattatcagtaatattaccagagtacatataaagagctaactattgcttaaatgtttgtgaaatttaacacagtactttagaaaaatcacattcattcattcacatattcattccttagtgcctgcatgtgcagcgacctgtggtgggttcttgctttttttttttttttttttttttttgagacagtcttgctctgttccccaggctagagtgcagtggtgcgatcttgactcactgcagcctccacctcccaggttcaagcacttctcctgcctcagcctcgtgagtagctgggactacgggtgtgtaccatcatgcccggctaatttttatatttttagtagagacagagtttcactgtgttggccaggctggtctcgaactcctgatcctcttgccttgccctcccaaagtgggattacaggcgtgagccaccacacccggctaggttcttgcttttaagaagcttcaacaactgtgcttgatctctccaggggggtgctttgtgcatgaagtgctttagcactggggtgtgagagatagtttcaccctaggcttagaaggtaaggaagacatcacagagaaggttcggtttgaattcaggtttttttttttcctctgcgtaggagctaaagatgaaacagaagaggagccaacccaacttttaaactgttaagttagtagaggggctctgtccctaggagggcaaagaagtaggtggtaggcacattcctccttcagactccaggatgtctagtttaggtggatttttgtagtattgcagaaatagaatgtttgattggaagataaacaaatcatttatgcatagtgtgaactaacattatgagtcaaaagaagctgaaggatagctttttggtagaaaatcctacatttcttgaccctttctttcactttcagtgtgaatttggcaaaattggtattttccttgattgttatggggaaaagaactagaataagcactgttttatattttagaatcattgttttaactagatcaacatggcgtctttcgtttgtatcatctttaggaaaaagcagtgacttctgtcacgttgatggaaatgagactgcagaatgtcagcagatcgtacgtggatagtccccttcatgaacagtgtctctgttttttcacttggtagggtgggatcattcctctgttctacagttgtagaaattgaaaccaaattgagtggttgtccaagaccgtgaggttgtttgtgaattagaacttaggttgctgagtccttatttgatttgtacatgtatatttttattaattttttttctactgagtgtgaacgaatttttctttaggggggaggatatagaatctgtggtttagccgggcgcggtggctcaagcttgtaattccagcgctttgggaggccgaggcaggtggatcacctgaggtcagcagtttgagaccagcctggccaacatggtgaaaccctgtctctactaaaaatacaaaaattagctgggcatggtggcacacgcctgttatcgcagctaatcgggaggctgagacaggagaatggcttgaacacaggaggcagaggttgcagtgagctgagatagcaccattgcactccagcctgggcgacagagcaagactctgtctcaaaaaaaaaaaaaaaaaaaaagctgtggtctaatggacactgaatcctttgcattctttctctgggattagagagtttaataacaaaaacagtaacttgacagggctttcattctgtcagctcagagaattgtcttaggtttggaaagtacttggtctataccatgccttgtgaggacacagtgacagtgatgaaatcgcagcagttcacatttgttgagggcttcctttaagtgccaggcgccgtgctgataagtgccttctttcatgggctacttgagagggaatggcagtctcctgacagtgcttttctgtgtgatccacagtctttgccagcacctgctggatttgcattggctgcatgtctgccttactgtgcattgctgacaggcaatttccatttctacacattgtggtactctgttttagacaacagtggcagtgccggtagccctttgtacagatgtggacatttggcacttggtagctttggtgttaggggcagaggattttgttcagagccagccagtgtcctgacatgtcgtgggatgcccattcactgcctcctgaaatagattgtctgatgcctggagcaccttcaactgccaagtgtatgggccgtgaaaagctgggggacaggactgggaggggtggaggatgcagggggagggcaccaggtgcagaacaatgacttccaaattatgtcacgagctgccagccacacgagcacggcctggcctcattaccacatgaagtgccacagaagggccttttcattttctcctagtgactgtgttatccacagttttgctgggaggggtggggtgggcaccctgctcacccccagttaacaatggagcacaaagtcctggcagaaggaacttcccaatgtaccccggggctatttttgatgacagtgagtggctgtgactcactgaatgtgtgccctggcagatgatggtttccaccccaccccctcccctggagatgagcaggcagcctttgtgcgtttccttggccagcttctcctgctgctgcagttcactgatatgtccacagcagccggcccgcaggcctgacagggctctgacagtggtttttaccatatatggccatcagagcgctgtggctgtcagccggccaggataatttccttcctttgctttgattggctgcacgggtggctcagagaatggtgggatctgggagtgtgtggtgaagagaagccactgagtcaagtgcaaagaacgtttaactctttactgggtttgtggagcgtgccagtctgtgctaagcaggctgacaattgctgccagcagaagccctcagtgtgtaaacatggtaaccccagtctgggaaagctgctgtatctccggtaaagaaaggtatctgaacacacattactctgaaataaactcaaggtgtcatgaacacatttctggagtcacggttttgcccagaagccaccttataaccacatgtagcaaatcatctgctcctgccaagttgaatatcttcgcccattaggggtgggacctgagttgagtctggggaagaatgagctgagagggcatgtgatgggacacatgtctgctttcttggaggaacggtgacttgggtttcatttctggctgactgaattgagtctatactgcagtcctcttgcttgtgtggaactgactcagccatggagcccaaggcattagcccctcccaccccccaaaaaaagttgtaatatttttctatttatcatctccaccatccaaggagggtggattttcattctgagacctgtggattaaaccaatgcagagctgcaatgggaagggttagccctggagctcttcagcgttcacagagggtttcagtagatcaatctccaatgtcatttgcttactacgagggcttagacaaccagtttctctattttctgatttgatattgaatgctttaattttccatattgcatttacatctgtagttcttctgcttttcagcttttgctttctagctcaattttattttaactagattctacctcatcttgggttccaagtttttatttgttctcagcccagaagcatcatatggaattacttgtctgcaataatgagcagaaagcattaggttttcactttataaattctttaagtcaggaagttaggaaatacagctactctggttgctatcgcatatttgggcaaggttgagtaaggaaatgttaacttttccgtgtttttgctttctgataataaaatgtttgtagttttacaataacttccctcaagttcttaattgattttaaaatatggtctattcagtattaaacccagtttttagagaggatctgtgatgcaaaaattatttgcttggcattttcacttctgtccaaaaagactgctgttttttactcacaggcaggtgaagtctctgtaggcccatactccctctccccagcagcttttgtttctagcttaccttaccttacagggtaactcaatctgtagggtttattccagagcacctccttttacctcaaggatggtatttctggttcccttaaagtaaagcctcctcagaatgttttattcctgggccatgagctgtcactctcagggaccagcctgtgcacaagtcatatattgtgtgcacccgtctttttggtctgctgctgagtctctgttttccatgccgctgtccccttgtcccatgaccacaatcactctagctcctccccgtggagcagcaggggcttaagaaattcaaacaaaacatgtatccacataaataatactgtcataagaaaaaggaagttgaaaaaaatggaaaacccacttcaatagatacgcttttgactcctttgaactctgcacagtgtgaatggagcccttatgcttgggctgaaaacttttcctctacttctgagcacatgtgtgacttaacattctccttgctgagttgaagaattctcagtatgtatcacccaaagccaaaaataagttatgattgaaatttgggcacataaagtgattttgatactcattttttcctaaaatgaaaacttagatgaatattaggtaggggtttgaacaatgtggaaatcttttaactgttctttgagtcaggtcatgtaaagtatctttgtttgccttccccaggatggggtgggggctcttaggcccttacatcttcgggtggtgtaaccagtctggataataggcatagaggactgcagatcaggagatggaaaagtactggaagtgagacagctgcctgagttggattagataagggaaaccgtgtagaaagcagtctgaatccagcaccctaggaaggtgtgggtttatatgatacactccagaatgcaaacttgaaagaaattgtgtgtgggataccttgagcttcttaaaggggaatatttgatttgacttatcactcgaatgaatgtgtcactttttatcaccatgggaatttattactttgtgaaaacatacattagttatgagaaagagtaggcctgctgggtaaagcgttgtgcgactttaacataatgttacatttcctttcttgcaggaaccagtgattatcagattgatccatctttttttgttttttcagagatggagtctcgctctgttgcccaggctggagtgcagtggtgcgatctcagctcactgcaacctccgccttccgggttcaagtgattctcccacctcagcctcccaagtagctgggattacaggtgcccaacaccatgcccggctaattttttttttttttttttctgagacagagtctcattctgtcgcccaggctggagtgtagtggtacgctctcagctcactgcaacctccgtctcccaggctcaagcaattctcctgcctcagccctcccgagtagccgggattacaggcatgtgccaccacaacgggctaatttttgtatttttagtagagacgagatttcaccattttggccaggctggtctcgaactcctgacctatctgcctgccttggtttcccaaagtgctgggattacaagtgtgagccaccgtgcccggcctgtatttttagtagagatgaagtttcaccgtgttggccaggctggtcttgaactcctgacctcagatgatccacctgcctcggcctctcaaagtgctgggattacaggtgtgagccaccgtgcccagcttagattgatccattttaacaccaattggtagtgtcttcaaccacaaaccaatatgtgggtcagaaataattatgtgaggaatcattcttacatgaagaaacagtcattctgaatgatcttttgtaatatgtaggacatattggaagcaaaattcccaatgttgaatttcgagagtttgggaaggtgaacatggctgcggtacatgtgtaatacaccactagctgctttaaaaacacaccccagcacagaactttattgagacgtgtctgtcagaaattttctgtacatgtttgtgtacattaacagttttttttattgtactcagtactgccctcaatatataggatgagtctacttcttaaatgtggattcctttttagaaggagatgtgagatcgataaataagatatactgggctgggcacggtggctcacacctgtaatctcagcactttgggaggctgaggtgggcagatcacctgaggtcaggagtttgagaccagcctggtcaacatagtgaaaaaaaatacaaaaattagctggacgtggtggcgtgtgcctgtaatcccagctactcaggaggctgaggcgggagaatcgcctgtacctgggaggtggaggttgcatgcagtgagctgagattgcaccactgcactccagcctgggtgacagagtgagactccgtctcaaaaaaaaaaaaagggtcagaggggatacattgttaataagtggaagctgttgtgattttccagtaagattgataggaagtgcccttacagctaagcaatatcatttcttcttttttctttttttaattttaattaaattgttattattattattgagacagagtctcgctgtcacccaggctggagtacactggcgcgatcttggctcactgaaacctctgcctcccaggttcaagcgattctcgtgcctcagcctcctgagtagctgggactataggcacacaccatcaagcgcagctaatttttgtaattttcgtaaagatggagtttcatcatgttggccaggctggtctcgaactcctgacctcaagtgatccgcccgcctcagcctcccaaagtgctgagattacaggcgtgagccactgcacctggccttattattatttttttgaaacagggtcttactctgtcacccaggctggagtgcagtggcgcgatcatagttcactgcagccttgacctcctgggctcaggtgatcctcccacctcagcctcccaagtagctgggactacaggtgcgcaccactacacctgactaatttttatatttgtagggacagggtttcgccggatttcttaagatttatgttgaatttagtgtgcctaaagaggaatgttttttgctaagtcatttaagttattgaactttccttttatagcaatttgataaagttatatttttactgatgcttacattttgattttcattcactttctccccgcaaaatgcccattggaggaaatgttgcctaactctgtgggtttagttgaagtatcagtctccaggaactcggctgtgttgtagctacttcaagatttttaagtgttttccccaaagcaaatgatagtgcttgtatctgggacggtttctgccacggtgaaggttgctggctggaacatgctcataagacatcacccttagctctggccagccacgtggaaattgtgccattacacctctcccttgtgccagctgtatacatgctttggaagctgaattttcctttcggctcatgttgcttggctctgggcaggctgtactggatctttcagataataatgtctgtaggccagtgtcctgacctatttcaccaatgtcccacgagtttatgaactggctctggagcagagcctttgggaaacttggtgctggccatttttgccacctgttgggttgacatgctagtaatcccaatcatttggagttttagctagaaaggtataacaaaagctatcctatggcatgtgattgggactagtaagtaatcaatgaatcaaaatttatttaaagcaaggagtctaatggctattacattttcagctaaactacttcaatttcatgccagaaaagtagtaatattctagattaagcaacagaggtgatttatccctagtgaaatagtggactgatctgttagtaaagtgaagtttttctatctctaagctttagaagattggtgggagtttcttaaataattcattttttagtttaaaaagatatctaaaagctggctttaattcttgtacatcttcctttcagcctctgcattcatttaaatttgctgcttagaggttcaggtaaactgtgttgtcaccatgacatgtggtggatgtctttctgagtggcccctcacaatctagctaattatacatggattctttggtttgttcactacatgataaatcagtatgtgtcgtgcagacgaatgagaattgtgttcttattagatcctagtgcaaaatgtctttcagaatgatgtttcctcatctttaccatataaggccgttattagtatggtttcctttaatctccatgaactggagccctcagcagtttgtaagtgcccagctttgtatttttaataacgtatgctgatttggtgaaatatgttgttgtgcttttgttttgatttcattatgagtaagaagatacttagaggtgtaagcccttgaaagcaggatagctgatacttgactgtgtgtttgtgaacatccagcatgccaaataatcagtgtacctttaaaatgccatctacccccatactgtcttcacatttttgttcttttatcactgtcagatatttagtcaattgcttttctcttgtgctacagtagaatactactttctctgttttatttaaggatttatgatgacatcacaaccagaggaagcagctgcttgtagaatatcattttttattaactgtgtttctgatggccaattgccaataatttttaacattacttgtgtgccttttttttacaacccatggcatagtggaaattttctttccctatccaaatctagtatggttggtcagtgatattttagatctttgcttcttgactttctctgtgcctcagtttctttatttggaaaatagggtgataagattcccacatcttaaaggttgtcatgaggacaaagttatcaaggtcttcagacagttcctagcttgtaatttaagtacttaaaaagtgttagccattgttattatttgttttgatagaaaggacagaaatagctggcagttgctctttcagtgacattcaggttccagagaaaatgttgagctctagtactttcaggctgtggatttattggggctgagctgggaatggcagtaatgcttattattattctcagatatcttgactgaagaatactggtgaatagctattaacttttagccagggttatttaattttaacttcaaaaaagaagtcatttagtaagaagcttcttagtatgtaattaagaacaactagtgctagtacttccagattcccctcaaaattgctttgtgtttgaataaaagcgcttcttagcccagattggaaaaaatcatttggtgttcttggaagttcagagctcagtactatagttggccatcaaggatgccaaatgtggtttcctgggcagagcctaggaatgcaaagaccctgatgtaaaacaaaacaattcaggtagaaaagcttttttccttgggagtaaaaaaaaattttaatgcaaatttaataataatgcattggtgtatttcttaactttattatattttaaattctttttttcaaaataagatgtatcaaaataataggacacacatgtactcacaagattaaacagatgttaatattttgccatatttgtttcatatctcccctttttgaaaaaagtaataaagcataacagatacaggtagaataccattcttatttattttctccttccccagaggtaatcttttcttcaaatatgtatcatatttttattacatatatgtttatctgtaacatgtacttttatttcgcgtgccttaaacttttatgtaaatatgtattcccatactgaaggacagtgaaattgcttctgcttttgccactatttccaacaatgcggcaataaatattcctcttgtacaaaatatgggagcatctctctcacccagaccacctagaagtggcattgctgggctggacttcctcacctctacctgttaccaaattgctcttgaaaggaattgtaacaaggtgttctgtaagcagtttatgagttcctctttcctgacatccttgtcagcacttatatttatacttttacattttcaccagttttgatgagtataaaatgtgaccatgttgttttaatttgcagttctctaattatcagtgagattgaagtatcttttcacacatctattgcgtcttcagattttcttcgctgtgagttctctgcttgtgtaatttgcccatcgttctgtttggttgttgattttgttaggtatgtatgttgcatacctcttcttgcactttgtaacttgtctgttcatttacatttttaaagaacaactcacactgctgaatttggtttgcttttgttgctgtttgtgaggagctttgcatcagtatttataagtcatataggcttcaatttttctcccttatactgtcctttgtatcaaggtgttacattccttatatgatgaattcagtggcacttttcttttttctgttctctggaaagctttgtttgaaatgatctcttccttgaatatttggtgacactcacctgtaaaaccatctgggcctagtgttttttggtatttgctgattgattgattgattgggaggtggtgatgggtagagttatactactgatcttttatggttatggatctaatttacatttatttattcttgaaaatcttttgatgttacttttacttctgtgagattgtgtatttcatctagattattcaattttatatatattgtcaaatgttattcctagtgttttcatactctgtaaatttctactttatttgtaagttatgtcccttttaaaattattggtattcatttgtgccttatctcttttcctgatctatccagtttagttgattttgttatttattttttttccactgacttctttttttcctctttttttttttttttgagacagagtcttgcactgttgcccggactggagtgcaatggtgcgatctcagctcactgcaacctctgcctctcaggttcaagcacttctcctgcctcagcctcctgagtagctggaattacaggcacccaccaccatgcctggctaagtttttgtatttttagcagagacggggtttcactatgttggccaggctggtcccgaactcctaacctcatgatctgcctgccttggcctcccaaaatgctgggattacaggcatgagccactgtacctggcatcttttctaataattttacattctttggatgtactctgttcattttctaacttctcaaggtagcaactcaatgcattaattttcagtcttttctactatatgcatttaagactgtccatttttcactaagatctgttttagttgtatgttgcacatttggatatgttgtgtattgctcagttttaactttcattctgttatccattatgatttttaaaaaacaattatttagtaaattaaaatattttcaaatgtactggagatttttggtttatttttctattaatttttaattgtattgcattatactcagaagatgctctacctgctattgactccttggtattttttgagatttgctttgtggtctcctaattgataatttaaaacaaattaatgtttaatgtatgtttgaaaaaagtgtatttttaaatgttaggtacaaggttatatatattcattagatcaaagttgttaatttttataaaatcttctgtattcatattaattttgtctgtttaatttcttaaatctttgttgacatctcttacgattatgactttgtcattttcttcaagttctgtcaacgtttgccttaattattttgaaattatatggttagatgaattacagtttatagtggcaatataactttccagtgaattgtttctttagatgtcagatagtgacattaatcgctaatagtgcatttcaccttaaagtctgtttgttctggtattaactaccaggtatactttttaatatgccgccctcctttatttgccttttggtgccattatttttttaaaatatgtgtagctggatataatctaatctgagaggccttgtcttatctagtgagcttaatcttgcatttactacaaatcatgatttatagttggttttatttccaccatctttgtgctttctagttttcatgcttttttttcttaaaaaatttgtctctgcttttcatgagttgcattcatactttctttggtcctttttttctttttattttctctttctattggattgagccagtttttaaattctagctattgtagtacacctccacccccacccacccccagaaattatacattctctctctttccttttagtatttactctgcatttggatatctttatttaaagtctaaaattagtcaatttttaagtctgatcatatgccttttaccttaaatggtattgttgtctaatgttttgtttctgtctttttaaaatctgtactccaagttggtattattagtactgttttacatagtacctgtttgtatttgctttatttatttatttgctcactgttgttttgctatacctttctactttactttcttttcctgaaatgagtccttaaacttaattcttcaaaattaatatagcaattctttgagacaaatctaagaatttaattttttgaacaagggtttacccatggtaaattctgtctctttttgtctgcagtgccttttgtttgcttttttcttgtcatcattcttgaatgatagtttttctgggtatggaatacaagggtggtggtttttcttagcatttccaagatgttttccatttttttgtttctctgattgcttctgagaaatctgctcacaatcagtctaattactctgtcagtaggtaatctgtcctttctctgttgttgcttctgggatcttctctttgttttaggtgttctaaattgcactaggatatgaatagataagaatttgttttcacttatactgccggaggtgggatttgtgcatcttaaatctaaagacttatgcatttaactgaacctgaaaaattctcagacattatctctttaatttttgcctctgttccattcttttaattctctccttttggtttgtctatttaaatgtgtgtcaaacttcattctggccttccagccttaggatgttttaagttatgaaatatcacacattcaagccacgcatggtggcacacacctatagttccagctatgtaggaggctgaggcaggaggatctcttgaggccaggagtgagctatgattgtgcctgtgaatggccacagcattccagcctaggcaacgtgagacaagaacaagagagagagagaaagaaaggaaggagaaagagagcacacattcaaaagagttactgtatctatagtttaataattatgtaaaataggatgaatgcctgtgatcccagtaccatcagcttaagcaacaatattacctggggtagtaactcaaggatgcaagtgaaatctccatcttacctgcatgatttttgtgagaatgcaataagataagcaaaaccacgtggcttagacctagtagctggtcgttctttaaggagagacaccatcagaaatgtggtagattccagcatttgttaaatttcgggtaatgtttattgagtacttcaagtgctggggcagaaccaagttctttaccttgattgtctcatttagtcctcacatcagctcttaaggaataaactgttaaacattctagttttatagatgaggaaccgaggttgagggatggagtaatttggctaggacttcacagctagaagatggcagaaccatgactacactctgggcagtctggttctcaaccatttatacttcgctgcctgtaaatgaactgtgtggctccttcctgtgacacccagattctatatgatatggtgttcattggaatttccttttttgaagtccttttttggtgatgcgttttggaagatccaaactgggttgcaagggaaagtggaggaatgtgaagaaacctaggccttaggtctgtaaacagggccatattcaggcctcaacttagaacttacctttcccagaagaaaacctctccagagactgtgaccccacaaacctgcttgaatgtcttccttctctgttcctatgtggcaccataattggctgtttaaatgtctctctcctctcactgggctccacatttagccaggacaggactgccttgttcacgtctgtatctccagcactcagcacaatgtctggtccataaaagttcacaacacatatttgttaattcttaatgatggagtaaattattgtactagaagaactaataatgtgacagcttttattggatattttattccagatactgtggttaatttttttacttattttacagataattgtaatactgaattgtgatttatctaaaagtgttctctcatttaatccttacggtaattgtgggagttaataagtatcattgttaactattttacagatgacgaatgaggtgaagcttagagagattacatgacttgtctaaagtcacctgtttaatcagtagagcctggatttgaacccttacctgtcttattccagagcctgtggtctttacacgttaacgttctgctttcctggagatttgcacagtcaagtcaaattggagaaatcatagaaatttctgttcttgaaaaattgctaagaagcctgctccagtgttgggatgatttgccatataagagcaaaaacaacaaaaaatagattaagccatacattgcagtggttcctttctgtgcacctgctcttaaagcatacacagcttcagcgtggactggcattaagctattttaaaaaggaaaccactttcatatacccattgttaacaatagcagttgtcttagttgacacaaaattggtctgataaccctggttggtttgctagattcaaatgtgtgacatgagcaaattgtggtagctatttatgaccaacattaagcattttattcttaatcagatgtggaactggctaatgggtgaggtctaagttggtgttaactagattgtctggctggcatttctgttgattgaggatagcagagagactgagacattacaatgtagtaggctctttaggccctaatgatagctaaagcttttcttttttttttttttttaactttttaaatttctttttttttttcttttttcttgtttcttttttttttttttttttttgagacagagtctctctctgtcgccaggctggagtgtagtggcacgatctcggctcactgcaacctctgcctaccgggttcaagcgatactcctgcctcagcctcccaagtagctgggactacaggcgcacaccaccacgaccagctaatttttgtatttttagtagaggtggggtttcaccttgttggccaggatctcctgacctcatgatccacctgcctcagcctcccaaagtgctgggattataggcgtgagccaccgcgcccggcctttacattttaatagtgccattcatttccagaactggtaatttatatattggaggatattgtcttattgtattaacattttgaataataccaaggtttagggtttttttttttttttttttaagccatggaacatccttttaatttacaatttggctatttagaattgtattttggcaaaaagactttcatattctcttttgctatgtctgctagtgcagttggttacatctttttggttctagggatttggattcttgtaatttgatcgcatgtccttggtagtggctttttctagaagtgaaagttgatattgactatacgatgtcatatctagaaaattgagagttttgggtggaggtaataaatgagaaatgggcctgagaaaatgtataacgtctgtggtgttgatattacataataggtttgtttctctcttctttcagactggtcgaattgacaaatcttaccctacagtatgtggccacacaggaccagtgctggacatagactggtgcccacataacgatcaggtcattgccagcggttcagaggactgcacggtcatggtaagctcccagggtgttgtgtgcacacaggccagtgagactcacctactgctttcaaaagcatgtgtgtgggtgtgtgtgtatgtatagaggcttgaaaagcagaacgttatagcagttttgactgtctgttggattttacaataatttactacgtttaagtttaattacagataatcctttcaagaagcccttaaatcaaaaaggttgtactgcagtgtctgccgtgtctttctttttcttttttttttttgagatggagtcttgctctgtcacccaggctggagtgcagtggcatgatctcggctcactgtaacctccgcctcccgggttcaagtgattctcctgcctcagcctcccgagtaattgggattacaggcatctgctaccacacctggctaatttttgtatttttaatagagacgaggtttcaccatgttggccaggctggtctcgaactcctgacctcaagtgatccgcctgcctcggcctcccaaagtgctgggattacagtcttttctgtgagtgtgtttgtgtatgtgcttattgacagttgacatgttctctgttggaagattttagggaaagtaaagtgacttttcagtaattctgtaatgccatttgaccacatgaatttcccctcgccccaaaaggagagaaaaaactgaaactgctggcacagactgtacaagacagtgacgtaagatgccaaagttatgcagataaaatgggatatgtcacaggtggtaaaagagtttttgcaattgcttgtttccaagctaatggcagaactgtgttctgtccagtggaccctggttaagaaagtccttttcataaagatatacaaacaaaaaacgtgaaaggtgaattaagtactttacattccctcctttagtttccaaaagtaggttatgtgtgaaacaaggctttggaatactttttaatatgatttcttgtccttagttatgatttttaactttaaaatgtgattattggtttggatcagtttttaatgctagcccaaagtaggctgaaaaggttaggcataaacacaaatgggagtacttgctgcccctgaaataagggaagatggtctctaattaatttgtaagcagtctcgcacatgtcaggtagtctcgcacgtgtcagcattggagaaccatgctacttttattttcctctctattggctgtggactgaaacattgtttggaaagctttattaattaaaattattttacataaatacaaattaattcctgaactgtgtcatttaaacatttacccgcttttcctcatgggcttttggctgggaatgtctcctcctgtgatctcataattttggcagctaaagcatattaaggaaatacgctgctgtgaaagggaattgttctgtttaatgtgccttgctaaattgatcattttaatggctatggacgcattttgttaagagaaaggaatatcgtttagacctgatgccagaatttttttttttttttttgggatggagtctcactttgtcacccaggttggagtataatggcgtgatctcagctcactgcaacctctacctcccaggttcaagtgattctcctgcctcagcctcccgagtagctgggattacagccctgcgccaccatgcctggctaatttttatgtttttagtagaaacggagtttcatcatgttggccaggctggtctcgaactcctgacctcaagtgatccccccgcctcagcctcccaaagtgctgggattacaggcacgagccactgcgcctaactctgatgccagaatcttaaacggagagtctgaacctcttttgaagaagcaggtttgatccatctctggctctccctgtctctagcattactggtcacgttatccttttaaaaaaaatagtgtgtattataaaacagaaaaacacaccaaatagttaagtgaaaaagcagactcagggagttaagtgatttatgacatagcgaacaccatgaaaccaccttccatgtcaaaaagtagaactttcccaacctcctcagacttctccatgtgccccatcccagtcacaacatccctcctccctctcaaagtaaccactctcctgacttttgtaatactcatttccttgcctttctttgtagtggtaatcactcaggtgtatacctctagactctagattggtcttgccagttttaaaaacttgatatgtagtcttttaagtcttaatctaaagattcctccttcatcattttcttttccctacaatttatctattcggaagccctgacctttgacctgtgcttttcaaccatctggattttgctgattgtaccctcatgttgcagttcagcttgctcctctgtcctctgaatttcctgcaaattggcagctggaacctgaagtgcggtcagattcaggttctgtccttttggctagactatattgttcgcattatgttcttccatacgctaggaagcacatgatgtcacagtgtctgggtttcatcctttttccatttgtgtattctgtgcctatatccagtcattcactaggggttgcaatatggtgacagtaaattctgtcattttgttttcaatttttagctggtaaaattttataagataatgtcctcacttacttactatttagttaccaaatagtatagttcatttaggaaagcaggataagtgcttgattctttccttttatttacctagttctcaagataatgaattgattctctgtcatcctcagaaggtgacaaattagggtttttttttccccgttcctttcattttgaagtcatggatttgaacatatttgatgggttcaatccattataattcttatctcaaagccgactttctcgccttttcccattgaaacctcttcaagatttctgagtccttttgaaatgaccatcatagtctttgagtctttgatagatagattccttgctatgtgatatgttgaggtgtttcaggctcactttggacatccctgcccaagccatttctttcggaagtcctggtttattttaagggaaaattatatctattaagtatgcagtagcattatgtatatatatatatacatttaaaaatactgtattaccaaagagagtgtaatctttttgctgtggagggtttcccctcagtgttgatggctgctgactgatgagggtggtggttgctgaaggttgggctggatgagaccacgacaataaagtttgtcatactgattgacttggcctctcacaaaagctttctctgtagcatgtgatgctgtttgatagcattttacctgccatagaacttctttcaaaattggagtcagtcctctcaaacccttttgctgccttatcaactaagtttatgtaagtaatattctaaatgttttgttgtcatttcaacagtgttcacagcgtcgttaccaggagtacattccatctcaagagaccattttctttgcttatccataaggaacaactcctcatctgttcaagttttatcatgagattgcagcaattcactcacatcttgaggctccactttttattctctagttctctatttccaccatatctacagttacttcttccaccaaagtcttgaactcctcaaatgttgatatttagaactccttccacgaatcatgaattttcttaatgtcacctaaaatggtgaatcctttccagaaggttttttttttttttttttttaaattgagacggagtctcgctctgtcgcccaggctggagcgcagtggtacgatctcggctcactgcaacctccgcctcctgggttcaagcgattctcctgcctcagccctccgagtagctgggactacagtcatgtgccaccatgcccggctaattttttgtatttttaatagagatggagtttcaccatgttagccaggatggtctccatctcctgatctcgcgatccgcccgccttggcctcccaaaggtgtgagccaccgtgcccagcccagaaggtttttaattcactttgcccagatccatcaggggaatcactatcagtggtagctgtagccttatgaaatgtatttcttaaataataagatttgaaagtcaaaatgattccttgttccaagggctgcagaattgatgttagcaggtgaaaacaacgttaatctccttgtacattttcatcagaggtcttgggtgataaggtgcattgttggtgagcagtaatattttgtaaggaatctttttttttcctgatcggtggttctcaatggtgggcttaaaatattcagtaaaccatgcagtaaacagatgtgctgtcattcatgctttgtttttccatttctagaacatagagtagatttagcataattatttatttatttattttttattttattattattatactttaagttttagggtacatgtgcacaatgtgcaggttagttacatatgtatacatgtgccatgctggtgtgctgcacccattaactcatcatttagcattaggtatatctcctaatgatttagcataattcttaagggccctaggatttttggtgcggtaaatgagcattggcgtcaacttaaagtcaccagctgcgtgagcctctaacaagacaggcagctcatcttttgaagctttgaagccaggcattgacttctcctctctagccatgaaagttctagatggcatcttctttcagtaaaaggctgtttcatctacactgaaaatgtgttgtttagtgtagccaccttcatcaatgatcttatccagaccttccggataacttgctgcagcttctccatcagcacttgctgctttcccttgtacttttatataatggagatggcgtctttcgttaacctcatgaactaacctctgctagtttccaacttttcttctgcagcttcttcacctctgtcagcctccatggaattgaagagagttaggactttgctctggattaggctttggcttaagggaatcttgtggctggtttgtatttctatccagaccactaaaacaaggctgtttttgcttttttatcattcatgtgttcactggagtagcacttttaatttcctgaacttttcttttgcattcacaacttggctaactggcttaagaggcgcttagcttttggcctgtttcagctttcaacatggcttcctcactaagcttaatcatttctaattttttatttaaagtgagaaatgtgcaactcttcctttcacccaaacacttaaaggtcatttagggttattaattggcctaatttcaatgttgttatgtctcagataatagggaggcccaaggagaggaagagacaggaatacaggaagagcaggtggtggagcaatgagaaaacacacagcgtttatcgatgaagttcactgtcttatatgagtgcagttcatagtgccccgaaacaattacagtagtaacatcagacattactgatcactgtaacagatacagtaataacaaaaaagtttgaaatcctgcaagaattgccaaaatgtgacacagagacagtgaacatacgctgttggaaaaatggtgcagatagacttgccttagggttgataaaaagcttcaatttgtttaaaaaaaaaaacaaaacaaaaacaccaccacaatatctgtgaagtgcaataaaatgaggtatgcctgtatttacctaacctctttaatattaattacatctccatctcctttctttcacacagagaatgcagggtcttagggatacagaagaagaattagaacatcctgatctatctcatttgtcttttcacgttatacatgtaatagtctcagagtgaaaatactaataccaccaccataccatgatactgaaaatcgttaaaaaactaaacgacttttagttgaaaaactaaacaactttttaaaacccatgctgtgtctattatccctccatttaaaaatgatgtattctgtattttcaagaccacatagctgttacattcagcagtctctcctcccttggttctgtgagtaactacattgaagtactctccatcaatcattgtgtcaatcttgcaccaggcatttggatcatccgaagcttgttcttgggtggattccttaagaaggagtgggaacaatattctctgagttcttgtatactgataataagttatctgtgatctttttacttgaaagtgagtttctctgaatataaaatgattgggcagggacagtgcctcacacctgtaattccagcaatttgggaggccgaggcaggtggacgggttgagcccaggagttcaagaccagcctgggcaacatggtgaaaccccgtgtctacaaaaaaataaaaaattagctgggtgtggtggtgagtgcctgtggtcccagctgcttgggagcctgaggtgggaggacctcttggacctggaagatcaaggctgcattgagccgtgatcgtgccactgtactacagcctggttaacagagtgagaccaatcctgtctctaaataaataaataaataaaattattgactcacagtttttccttgagtaactaaataccttattccattttcttttggcataggtgttgctgtcaaagtcagattataatctaatttcctttcctttataaatcatatgctctttttgcctaaatgttcataagattttttttcttcaaatatagttaattttactagaagattgttggtcattctgagttggtatctctagataccatgatatgctctttcaatatatagtttccagtcttttttttttttcttgcattacagtttttaattttttttttcctgttcctttgctttggttttctttatcagaagctcctgttatccatatgctttgtcttctttacttctctttagtcattgtcagtttctctccaaacctcttttcttttcctccccccactccttttctttctttttttgagacaaggtcttgctctgtcacccaggctggagtacagtggcacgatcatgccttgacctcctgggcccaagcaatcctcccacctcaaccttccgagtagctgcaaccacaggcactcaccaccatgcccagctaattttctattttttttgtagagacgaggtttctcacaatgttgtccaggctggcctctaacttgtggcctcaagcattcctcccaccttggccttccaaagtgttgggattacacgtgtgagccaccatgccaggccctaaaccttttttttttattctttttttttagactttattattattattattattttgctcttttccttttatttcttttgggggcattatttgttgtgtttatttgctcttgtgttctttcttggtttgtcttcatttatttctaatttttttcttgatgtctgtcactttgttttgagtttttcaagttctggtttataatgttttatatattgttttcttattttgaatcactataatgtagtttttatctcttttgagcatgtctttttagcagtcttatattgtctaaagggatcttattctgtgtcttattttctttttttctgacagtaattttggagttcaaccttgatttttttttcttgcttatttttatgtggatttaattttcccaagctttttaaatggtggcttggttcagatagctgctctaatttcacagaactccctctctgacatattcagatagtgttcagaaacatggtgccttgctttctaatatttcctagcctggcttttatgtagcctctcttatgcttttatccctcttactgctatcctgctgaaattcgatttcatttcctggagtgtctcctttgtgggcccatcctggaagggagcccgctgtgggtgattttgagagtgctggggtctagattgtgcctgcctcttcagaccttttaaattcagtacccatgtgcccagcttctgttggaaaaggcaaaatccttcccagtttctgctgctgatctcacaccggcctgctgccctcaggtctgtcaggtgtccccttgctgtcccttcccacacacacccgaggctgatcacatgcaggtcgtgtggctgttggtgtttgctcccacctgcttaaattttggggatatcacctagtttgtgtaaatgttgtccctggatttttgttttgttttgttttctgctagctctgtctttttacggagggacttcggaaaaacccccaaaaaatgctgccactgagattctctcatcttcccagaatcctcaatgtcgcccttttattggcattgctggagtgcacattttgtaaattaaataatgctttgggataaatctttctaattttaaaaaatctttaagtatagaactgatatttaaatcaccctttaatcacttaatatcccctatatcatgttattattggagtaattgaagcttgtatagcttagcagttgaaatgaaagtttaaagaaatgtttgatcttctcctagcctacctgcttcttaataccttattttccaccttgctcttctgaaggtaaaagaacactgtattatagatcaaatggtttcagacaacaccccccgccaccccccgcctttttttttttttttttaacggaaaagctctgtgtagtttctcaagcctaggctattggtagtagctcatgagctacaaatagtagatagtataacaaggcctagttttagtagaagaaggatatcaaggagatcctgggagtaggagttctgagcatttgcaggtcgcttcgcttaaacgctctcagccccagttgccttccatataatatggaggtatgataataatatgcctatcgagagtcaaaaggaagctgtaaacgtataatggactgttattttttgtaatggggattttgatggatacctatagtggattcctagcagcaagagtacctttaatagacatttcatagaaaaatacagtagaaccagtttatcaaatgaactgtaaaagaataaaagtaattttttaaaaactgctttttgtattacttatggtataaatccatgaagtcctaagcatttaagcattgatttgttaattttgtgggcattgatttagtgacagctactttgcagttttaggagagggaacaccaatcttaagatacattcccccattttttagacgtggcttctttacacagcctaaaattaaattatattgacacagtttacctttcatgtactactttgtgaaacagcattttatactatcacacagcagttgtgtaaattgtactcccagaaactacacttcactcctagctttgcagagttttggctctgtgagttcttttcttcagcagtatcttctcaaagagagttttaagattgtggctacctaagtattttacttgggggaaatattagctccaagaaaataatagtgctttaaataatacaaagagcagtcaacttaagtttagtgaatgatgttgattcaacattgttccttatctgcagggtagtaatcaaacacaaatgcaaaaaatggctaatttggacaatgggattgcataattgttccttccagagtctgggagttggaaagatattgcaaaatgatagtcttaattgtctccagctatagaatagtccaaatttttaagtttaaaggacgcttctcccttctctcaaatcagtttattcttctgtagaaatcaacaaaaataccctatctaatccatttttgcttccattataaattttcctaatatagttttttttggcgggtgggaaggcatttgacaaagactggaaaacctgctagacaatttttaaaagagctttaatgctttctaatatagtttttgccctgaaataaaaatggaagtgatgttttggttcctctcaggcattcagcagggagggcttcgtcttaattccattttgtacagattgcatctgggccatttgccagaggatattataaccctggcagatcggaacccaacactcggttcttggttttcccgaactcggtgccactctgcacgtcatggttcatttgggaatgccctgatgccctacatgcaggcctttgtgggcgtctgtaggacgctgtactggtctgcagctgctaccacatctttaagctttctcctgtctcatgtattttcttcatttcccatttggaattggtttccttaggaatggaaaaatagggtcttttgggggtgtaaccctttttatggctgtaactctagtcctagcccagtagcaagttgatgatgggtgactaaaatagggaagcagtgtctggaaagcagtatttgaaaaataaaactatttaactaattgtactttaaaattagcacgtgagagaaacccaagtgtcttagttttccttttttcttgttgggattgttctcttgagttgtcctttttccatatccaggctttcacatgtgaaaaggatgcccatggtacagtagttctgaacatgtgcttaaagttgtttttttccagaaccacaatgggattttactgatggattcactttttcatgtaggagcccttggaactgaatgtcatttttttggttatatagatgagaggtttctatgttgcacaggctggccttgaacgccgagcctcacttccttatgcaccaggacaacaggcctgagccaccacagctcctctgatttcatttttgtcctttcaaaacaaaacattgccatagtaatgtgttgtccaaacagaaaatgttaggaacacacagcattatttaaattaagaaaataaaataaaaaagaggaagtagggataacttgtactctctgctgcactgagatgcctactctgggtgttttgtgtctgttttcctctgcactcactgcatacagttttgagaaagctggttggtattacagtaccagtctgtagccatagaacaaagaaaagctaacaagcctgcacagagatcagatctgtccttactgtggtaattggcctaggtataaaccagagctttcacacataatgatatcttgggtgtaaattagttagtattaattaattgggtacagtgctgaattaatttgaagacaagactcattctaagaaattctgatgttcagacctagaaatatatatggcgtcatagtggtcatattaacagcaaaaaaagtcatcatgaaaatatggtaggctcttttttttttttgccacgcgctattctaagcctttatgtgcatgataatatttagttattgtatccgcacagtaagccatgagtgtggcctattttacaacttaggaaacaggctcagagagtggcagttttgttaagggtcacacagctgataaaaggctcagccagacccagatctgtctagctccaaagaaagccccatgctcttctccctagttgcagtatttcctattagggtggtgctttggggcatgcaaaatgtttgagctcatttaacccttctaataacccctgagtaagcacagctgtccccagtattaaggaaattcaggctcccagaagtgaaatcccttcttaatgctaacatgaccaattagtgtcccagctctgacaggagcctgtgtcttctgacacccaggccagcatcccatattacacacaagaggaccaaacatgtaccaagtggtgcttctgtttgttgttgtccctgagctgcaggaacatcagtccaaaccgagcaggccatcacccagagtagcagacaaccctgaagagggcagagagccacataatgacaggcctgtgagcatggcctttgggtgccagccagagcatgtgtatgctgagtgtggaaagacctacagaccgcccccaacccccaagctctttccacagtccaccgtagagaacaccaccccctctttaccagtggacacaagaattctgttgtcttcttatttcatttcagagactttttcactcactttcttctcgcattgcagtccttgtgcttatagtattagctttttcactctggtgctttttccctagcagctcctgagccagcttctttatggcattgtttaaatgctgcatgcactttttagaaaattgctctacacatctgcgtgttttattttgagactggatattcaatttctcctcatattctgctctactttcacctaagtcttgttcatccttagaggtcacctcctcagggagccctcctgggtggaccaagcttggttagcaggaagctaatttcgtagtagtgcggtcggcttatgccagcatagcattggttgcactgtgcaataataccaactaacactcagtgtctgccttatgccaggcattcttctaaatgtgtcagtttcatgttaccatgttagtcttcaaaccgcctcacagaaggcaggttcaatattaagtcctggaaaggttaggtgaatgtcctcaaggtcacaccactatgtgactgaatcaggaattcagtcacatcagtctggccagagcccataatctcagccctgctgtgtactgtctctgcattctggaggcactatgtgtgtgtctggctctgtgctgagggttaattaattccttaattctcttagcacacctcgcaggcataggtactaatgttttctctatgcagtgatgtttgccaggatcatcacaggtagtggcccaggcaggatttgaaccagactctgcctgactctggtgctcactctctaactgtctgtatcacaccacttggatttgttgtctttgattttcagtctgatagaagtctctgctttctgttagaccatcaacttctcaagagcagggcctgtatttagttacccagtactagatgggttacaatacaatttattgtaactcaataaatgtgttacaagaaagagttaaccaaggtagtaaaatggcttaggtgcttgtcttatgtgaataaacccagctgagggaaccgttaaaccagctggaggtgaggtaaagaaggaacacacagagtttccttattttaaaaattaataaatgttgcttcatcattaaaattttcttttaatccaggaaaagatgatggggagaagctagagaaaggaaaaggttaagtccccattatgagctctgcttctgccctcatattttaaggttggaaatgctgattataaacaaagtctcccatcactccacgtctcattagtgatttggaaaatgcactagctgtgctcagagtgagacacagaggcgttttcagtccttgcaaggaaacccagcaggccatggttggggtgccatctggagattgaaggtggtattaccactctgtcagttctaagtggggtcacagtgcatcttgcaaaatgcttttcctgttgagtcactgaagtcccatttcataattgtttttctgtcgacttcatgctttgatcaaattagtagtcactgttttctgtttgttctgttcaaaatgtcagtcctgctttatattcagatagtcaagttcaatgtggagttgtttcactaatcataaattcttgaataaaaatagtgcatgtcaggatgaaagctaacatgcagtaatggaggagagcagatgcccatgttctccgcaggggaaagaggcctgggtcaaggtctcttccgcagagggagggagagggcagggtaggtcttccttttccttctatgcttgttcacacctgccttgcttaaaatttggctctggggaaattaggtgatgttctaagcttgggccctcaaaatgcaggtttatttttgttatgatttgcataaggggttatatttagcctgggcagaatttagctgtaaaaatgaacaaatcactcaactcatgactttttcccactcttcagaatggcaaactttttgttctcattttttgcaggacagtagaactgagctgaaccctaaacactcatccagtctagatctctgccttccactaagcaattgaaaacagacaattgtttgtctccttctttaaagttcccacaaaggaaaattctttttctcacgtgttctagtgttgaacatgatttttcattgacaagttcttaaatttttcatgagctagttcctcaaaatcattttctgatggtaaatttacttgttttaatcttcatgtagaagataatgattttaaactttagctttttcataaacttaaatattatttaatatctggtcttcggtagggttcttgatgctactcagcttacctgtaactcagcccttttcttagaggttgtttgtttcttaaccttttgaaacctttgttgttcattgttaaacataaagtctttcattccttccactcatactttccctgtccctttctccccctgtgcccaggcatgtccccaattaagatgtggtgagtcttctgcatgtcttcactagtcaagaggattttcttaaataacaagttttattgagatataattcacatagaattcactcatttaaaatgtacaattcactgagttttagaatattcacaaccatcaccacagacaattatagaaaattttcatcacctcatatagaaacccaaatcctttagctatcacccctccacctgcctccctccactctccccaacactaagcaaccactattctactttctgtctttacggatttgcctattctggacatttcacatacatggaatcctgcaatatgcggtcttctatgtctggcttctttcactttgcataatgtttttagagtttgctcatgttgtagcatgtatcagtacttcattcttttttatggccaaataatattccagtgtatgaatatgtcgcattttgttcagccatttatcgatagatggatatttgggttgtttccacctttgggctattacaaataatgcttctatgaacattcttgtacaagtttttgcatagacacatagtttccatcctcttgggtatatccctaggagtggaattaccggatcatatgataactctgtttaatcatttaaggaactgccaggctgttttccaaggtctgccaccaaatggtggctataccattttacattttcaccagccatgtgtgcaggctctgattttttcacatgcttgtgaacacttgttatctgtctttttgattctagccatcctaatgggcatgaagagagagcttgtggttttgatttgcatttctgtaattactaataatgccaaacatcttttcatgtgctttttcgccatttatatgtcttccttgaaatgtctatttagatgactggcctatttttcaattgggttatttgtcctttggttgaattctaagagttctttctatattcaggctatgggtctcttatcaaatgtatgatttgtaagttattttctcccattctgcaggttgttttttcactttcttcatagtgtcctttgaagcacaaaagcttttaattttgatgaggtctaattcatttttttcttttgtaatattttctataatacatgttataaaaatattaagtgtatttttgttttccaagtgtaaaattatagaaaatatgttttaaaaactatgtcatcccatcaagaaccacagacttagctaagtgtcttcattcccattccttttcttgagtgtttcaatcattttgtagttttctttcaattttttgcatgcttctaactggagagttttgaacttaacaaggaatttagaataaaatcccaaataatattaaataaaagctgagaggaaatgttttgtagtccttgttggtatcctgatctccgataacatattacattttaaaaacagccgatacttgggagtctgaggcaggagaattgcttcaacctgggagatggaggttgcagtgagccgagatcgcgccactgcactccagtttgggtaacagtgtgagactccgtctcaaaaacgaaaaacaaaaaacaaaaaaacaaacaaaaaaaaaaccgcctaacacggtcatttcacaacattctgcctttcatccagatatcactctatgttctgtttacatagagcaaatctttatagtggatggtcactgtaaatgtgataatgaaaggcaatagctttcatgtggatcatctttcttccttgtccaacaggtatggcagatcccagaaaatggactcaccctttccctgactgaacctgtggtgattttggaaggccactcaaagagagtcggcatcgtggcttggcatccaacggcccgcaatgtgcttcttagtgcaggtgggagctgagctcagcggtcctccccttgtcttccactcttgtggctctctgagtggggggaagcaaatgtgttttggttgtgtgctatatggttttaaagcagattattaggaaaccatggtgaagagtattggggtgcactgctcccccagcccacatacatacttgtgtgtgtgtgcacgtgtgtgtgtttcaaggccatttcgacaacctgaggaaagctatgaatttcctgctataatttcagcaggtttcatggttcctgccagggccctccatgaaccatagttttggttatttctgatatggtagaaggtgtactttgttgggagccagaagccctgtgttccctctgtggtgttgctgccagctttgggagacccctattaggcaaatacactccttccttttaaagaaaactttgattttcccctgctatacaattagtacatgtatactgtagagaacatatataaacaaaaggaaaaaaaaatcacttttaatcccaccactcagagagaagatcattattacttttttgatgtttctttccgaaagatatttctgtgcacatacataaattattttacatacagagatgggttcatacactttacacatgggctgctttctgcacttggtggtaggctgtgacccttttcacgtgccattaagctctcttcctatttttaatgacttcatactaatccattttctggatatacctcattttacttgataagtcccctatttctggacactggtgttgtacagaaatcttttcctttatctaaaattggagatttcattttcttttatgaaagcaatacagagagcatgagggaactttgtggggtgatggaaatattctgtatcttgatcatagtagtggctacatgagtttatacatttgttgaaacttagcaaatatatacttaaaatgggtgcattgtattgtatgtaagttataccttaataaaagtggtttatttaaaaagtgatactaatgttagagataggatttttaaaggtctttcccctcaccagtaaaaaggaggaggggcagttcagtttttaactgggaatacacaatgtttatgactcatagtgagttaaataaaaaattataatgccaagtaactattgaaactaaggcccacttttcaaaaaagatgccatgttttttataatcaccatcgactatacttgggaatcatttttgatgttctctcagaacctcagtctgattaaggagaggaaaaaaattccagagctggaattccttcatggaaaattccctgctacctttctcatcaaggctcaatacagggcagcagcaacagactggtctgcattctcccttttacatgtgaaggagaatgggtgattgtcgtgttctgcatatttttaggctatatgatccagctgccggggctgaagttacctgtttgcctatagggaagaaggcagaggaaggttcaattgtccatcccagagtttagcttcaacttttgttactgttgtgtagtttttttctccagtttcctacttcttttttttttttttttttttttgagatggagtttcgctcttgttgctcaggctggagtgcaatggcatgatctcagctcaccgcaacctccgcctcctgagttcaagcgattctcctgcctcagcctcccaagtagctgggactacaggcatgtgccaccacacctggctaatgttgtatttttagtagagacagggtttctccatgttggtcaggctggtctccaactcctgacctcaggtgatctgcccgcctcggcctcccagggtgctgggattacaggcgtgagccaccgtgcccggccagtttcctacttctaacccttaggtaacttaagtatcctggatgttagtgactattttttctaaatgatttccaaattgctttgttggcaagaatccacctctaggatgtccttcccgtattttgcttcatccttgaactaacatcctaggagcaacacatgctgcctctttttaaaggggcctggaggcgtggggcagacccttgaaggaaggaaggagttggtgagctgagatggtgaatgagttgacattgtgggcttctttcagaatccgtttctgaatctatgtagctacttgattacagtttgggcttctcaccatgatcagagcagtcttggcctatttttctcttcatttaaaggtacagatctgttgtgagcaaacaggccttactcttggcttttcccttccactgttgtaccatctttaatatcccaaagctgtgtcttagagtctcactgatttgaataacctgccacccagagtttttgttgagtgccctaaacagtcatttaaaccttttacttttagtttatttggcacgtgaaaagggtcacagcctaccaccaagtgcagaaagcagcccatgtgtaaagtgtatgaacccatctctgtatgtaaaataatttatgtatgtgcacagaaatatctttcggaaagaaacatcaaaaaagtaataatgatcttctctctgagtggtgggattaaaagtgattttttttccttttgtttatatatgttctctatagtatacatgtactaattgtatagcaggggaaaatcaaagttttctttaaaaggaaggagcgtatttgcctaataggggtctcccaaagctggcagcaacaccctgatgcttgttttactagaaagggaaacttgaagtcacttgggtctaccagcccagttaactctttaaagaaaatagggttctgttttggtgtggttctttgtttttgtttggttgattgtttcatatgaacccaaacttaacaagttgtgtttttactttaacacttttatttcttttatacaaactttttcctttgtcacttcagtttttaacgctgttagtaagtagggcctctggtagggcctctgacaatcagccgcatcttttctctctctctctttctctctctctctctctgcatatacatatgtgtattctcactgtatctgtagttttctgagtgtgttacataggtgtttctaatcttctaatctctgatggttttgcctgttttaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgtgagtattcctaggatgaaaactcagtagttggagcacttgagtgagtgtgagctttctgctttttaaggcaggcagcggtactggtcagtgggaccctgttgtgtgtagacaccaactgtgaataagagaaggcttataaaggcttctgtctccccagttgtgcttctctccagagttgtaaattttccagcttttactcaagtctctcactttgtagccttttttcacaaagaaatagtttgtatcagttcactagagtccttaagagtttataagtcttgatcaattaaaccaattggctgcattcctgattttgcagcttagtattgaatattgatgaatcaattcctcacccttttccaaacacagctgttaaagatgcaacaggtggccgggcatggtggctcacacttgtaatcccagcactttgggaggccgaggtgggtggatcatttgaggtcaggagtttgagaccagcctggccaacatggtgaaactctgtctctactaaaaatacaaaaataaataaataaataaataaataaatgcgcagggcgaaaagcaacaagttctctcatcagctcagtgtcttagtttctgccacccaaactggacctcaacaaaatcacataccttgacaaaagatggacatttgggtcttcagtcggtgttgaaactacacatagtaagtctgagaagtcctcatttgccacactctgaggcccttcctgagatgtggttgttctttggctgcatctcttttcaagagttgggcaatgatagtagctggtgcttactgagccctggggacttgcccagccctgtgttaagtgttttctccacccgacatcttctaagggttgtcctagtgcattcattaaactactgaggtcaaggaaagcgttaactagacaaggcttctttctgccctatgatattggtagaaatggtagggcatgcctaatctccttatgttattatcctcttgagaaacaaacatttgtcagagtcctttcatgtgttttattttcacagtgcatagacttgggttggcagcaggatatggtggagagagcgagtcttctgagttaaatcctggcattcttgcagcctcacagagggaccttgaccagatcacatagtatctctttgtttcctcatctggggaagggggatggttaacactgacctccctcccacacccaggtgaacatgaatggcagttggtgaggttggatctgtgcccgagtttctccactcaccttgtcttcttgcagtttaatgtgtggcatgtgcctttttgctctccaggagaaggagaaagcacatgaaggagcaagacccatgagagccatcttcctggccgatggcaatgtcttcaccactgggttcagccgcatgagcgagcggcagctggctctctggaatccggtacgccctccccaggctttccacttgctttcacttgagctttctctctgttctgagcaggtcttccagtgagtaagtagattatgggattcttagtgtagttttctaaacgcctgattgtcttagattggatgtgaagttcttatcctcgttggagacttactggtaaatgtatttcaaagacatacttttgatactcctgaagaggctgttgactatatattttttatttttttaattttttttaattttaattttattggtcatttttgggtgtttcttgcagagggggatttggcagggtcataggacaatagtggagggaaggtcagcagttaaacaagtgaacaaaggtctctggttttcctagggagaggaccctgcggccttccgcagtgtttgtgtccctgggtacttgagattagggagcggtgatgactcttaacgagcatgctgccttcaagcatctgttcaacaaagcacatcttgcaccgcccttaatccatttaaccctgagtggacacagcacatgtttcagagagcacagggttgggggtaaggtcatagatcaacaacatcccaaggcagaagaatttttcttagtacacagcaaaatgaagtctcccatgtctacttccttctacacagacacagcaacaatctgatttctctatcctttccccaccttttccccttttctattccacaaaaccgccatcgtcatcatggcccgttctcaatgagctgttgggtacacctcccagacaggatggtggccgggcagaggggctcctcaattcccagaaggggcggcagggcagaggcgccccccacctcccggatggggtggtggccgggtggaggctgaccccccacctccctcccggatggggctgctggccgggcgggggctgcccccccacctccctcccggacggggcggctggccgggtgggggctgaccccccacctccctcccggacggggcggctggccgggcgggggctgagcccccacctccctcccggacggggtggctgccgggcagagacgctcctcacttcccagacggggtggctgccgggcggaggggctcctcacttctcagacggggcggctgccgggcggaggggctcctcacttctcagacggggcggctgccgggtggaggggctcctcacttctcagacggggcggctgccgggcagaggggctcctcacttctcagacgggtcggccaggcagagacgctcctaacctcccagacggggtcccggccgggcagaggcgctcctcacatcccagacggggcggcggagcagaggcgctccccacatctcagacgatgggcggccgggcagagacgctcctcacttcctagacgggatggcggccgggaagaggcgctcctcacttcccagactgggcagccgggcagaggggctcctcacatcccagacgatgggcggccaggcagagatgcccctcacctcccagacagggtggtggccgggcagaggctgcaatctgggcactttgggaggccaaggcaggcggctgggaggtggaggttgtagctagccgagatcacaccactgcactccagcccgggcaacattgagcactgagtgaacgagactccgtttgcaatcccggcacctcgggaggccgaggctggcggattactcgtggtcaggagctggagaccagccccgccaacacagcgaaaccccgtctccaccaaaaaaatacgaaaaccagtcaggcgtggcggtgcgcgcttgcaatcgcaggcactcagcaggctgaggcaggagaatcaggcagggaggttgcagtgagtcgagatggcagcgtccagcttcggctcggcatcagagggagagcgtggaaagagagggagagggagaccgtggggagagggagagggggagggggagggggaaggggagagggaggggactatattttttaaaaagaatgaagaatctagtgttttggatttggaaaataagttcatatttcataaataatatgatcagttgtctaaatcaaaatagtcatgcttgggaaaatgttcataattagcttaagtggggaaaaatacaacatacattctatcatctcaatctctgtgtacatgtgtcggaaggaaatagatcaaaatgataatagcttctgtcacccactgggctgtaggattttgatggaatgatttttatgttcttttttatatctttcaactttttaaaagcacacatattttataattaaagaagtactttaaaaaaataaaatagggtaggcgcagtggccattcctgtaatcccagcactttgggaggctgaggtggctggatcacttgaggctgggagttggagaccagcctggccaacatggtgaaactctgtgtctactaaaaatacaaaaattagccacgggtggtggcatgtgcctatctataatcccagctcttgccaggctgaggcaggaaaatcgcttgaacttgggaggcggagattgcagtgagccgagatagcactactgcactccagcctgggcgacagagggagactcagtctttaaaaaaaaaaaaaagaaaaagaaaacagtaacaaaggagaagggctttctcatcattgtcatgaaatcacgctgatgtatgcgcgcattatgttgtcaaatcagtgaaattttgtgagttggatctcatttagcatccctgttgctgtttccatgtatgagtattgtatgtgcatagttcaaacttctgttattctaggaaaatggctcgcttaattgggatagaagaatatataataaggttataaaaatttatttttaaaaaaatgtatacatacacatatatgtattattattatcttccccccagaaaaatatgcaggaaccaattgctcttcatgagatggacactagcaatggggtgttgctgcctttctatgaccctgacaccagcatcatttacttatgtggaaaggtaaacagtaattttgatgtttggtgttaaatcctgtaagtggaaacatttatccttcagagatttagaggacgggcaatgtgttgtatctgtttaatttttctaatttgtgtgtgtatgttataagccaaggacagataatttggtatttttaggtcttgagactggactgtgtgcagcttgccagttgtgcagtgataacacgccatgttgcatacttttgactgaagcagaggttgggctggggtattggggaaaatgctccaatcagggcgctcttgtgaaaaaaagaagatacactggtgtttcatcttcacctagcagtgctacctgattggtgattttagatttatctgtacttatgtcagggatgggcaaccagttggccacatctaatgctgaaatttgttggataaccctagatgagcatgtgtatacttagtaccacacaccatggacttggaaggagaatggtgctttgtggatgcaaacttttgagggcctcagagactctccagagggttcttgttcctggggttcagtgctagggctctgggcttgaagatatgaggcctgactaaagctcaggggtgataacagttatagggagactccacactgaactccaaaaaccttcctcctgccttatgagctcagcatacctagactgtgggtagctttattatttcatttttgtaagtgggaaccttatagttcccttttttttcttgtaggctcaatttcccttagaactttttgtagttgaaataaatgaattaataacagtggagctgttgaggtagtccctagacctgttagatagcccttcactgggtggtaaagctggtgtttgcttttcatagctgattgagcatgctgcagacctgctttacatttttataggtcattgttttagaaatggagatcttgtctgtttccttgaaagccattttactgcagatgttaacaggtgttaagtgcatttaccttgctgttgttgcccttgactgaattaaaacaaacaaaatgagcagttactcagatattagtaacatgagatggaaaattcttttgggcatgcagaaatgactagtaagggtttagcttcttttccattgctttagatatctcagtcattgagacaaatggaaatcatgagaactgggagcactgttgaggcatgataccacctagctatttttgccttcttctttcttacatatatgtatatctcctctctgccagacaagattgccgtcattgttcaggttggtgtaactgtgtgacaattatttgtacttagactaacatatgcttcagtactcaaagatatctgactattctaagcaagaaagtagtagaattgtacacattgccatgagatggcactttctgaggatactcactaaaactgagtttcttcattagaaaaatctcactttttatcatcatactggcataacagcattgcgttatgccagtaaatgaatacttaaatcaataattgcattctcagcagtcctcttagtctttgtttgtttgtttgtttttcacagttgaattgcaatgtagctgtttggcagaggcattaacatttttgccctaaccctggcctggtgcctaggctcaggggagtaaaattagagccaggagccaggaggctgaggagaccacttaaaaggcatgctagcatttgataagtaaggggttactttgtgaggaaaagaaacttttatatgctttaggcaagcctctttatgaggaagaaaaggtcagctactgaagcggggtcccaactactgctgggtttgtagaggagagagacacccccataatccagatgtttcagttaacaatcagacacagacttgtctctggtttcttacagggtgacagcagtattcgctattttgagatcacggatgaatccccgtacgtccactacctcaacacattcagcagcaaggagcctcagagagggatgggttacatgcccaagaggggacttgatgttaacaaatgtgagattgccaggtaaagaatcgagattgtcaagtattctaggttggtgtaactgtgtgacaattatttgtacttggactagcatatacttcagatctcaaaaatatctgaccattctgagcaagaaagtagtagaattgtacacattgccatgagatggcactttctaaggatatcactaaaactgagtttcttcattagaaaaaaatctcaaaaaaaaaaaaaaaagaaaagaaaaaaatctcacttttttttttttgagacggagtctggctctgttgcccaggcaggagtgcagtggtgtgatctcagctcactgcaacctccgcctccctggttcaagcaattctcctgccttagccttccaagtagctgggattacaggcgcccaccaccacacccggcacatctcactttttatcatcacctgaatgcctggtgataccagagcaatacagctacaagaaattctatgaagcccaagtctttctatccttgtgtgtactgtggaattaatacctcatttcctgcccatataactgaagtgcaacaatgaagcagcatagctggggtgtattgcacacctactgaaatagtgaaacatgcatctttaatcttcaagctgaggccatggtcagcgttccctggtgggcaagtagggagagcctggctcggggatggaaaagtgggtggttttcctaccctatgagtggaagaaccagagtcaaaactgtatttggggccccactggtcctaaaatagagaaaccaaaggtcctataatggggcggtaggttagcttgatttaggaagttcagctatgatataatttctacctctctgtactacttctgatttttagaaaattcatattctaaatgctagcaggcttcctaagggacaggcttttttctcatgctagtcaacaaatatatcctctgagactcagtgaccactggccatttcaaacaacagaataattagcactacatcatcacatataaggtcgtaccaaacatttgtgtaacactgtgtttatgtggacttttaaaacgcttgctgttctggtctcacaattaaagaattgatacttacgtcttccaaataaaaggaagagaatttttataagccccttttttatattaatctctactaaaaataaaaaatttgctatgtgtggtcgtgggtgcctgtaatcccagctaattgggaggcagagtcaggagaatcacttgaacccaggaggcggagtgagccgagatggtgccactgcactccagcctgggcaacacagcgagactccgtctcaaacaaacaaaaacaaacaaaccaaaactctctatgtgattttttttttttagttggaataatgaaggaaagctgttaaagataattgaaaattgtggtttaaaccaaactaatcaaaatatggttcaaaatagactgaattcaaatttatgattacatccaatattttgaaacacatttgttgtcatctaaaagttcgacagactataaacacagttgttcagaatgtctccgatttatgaagtgtttcttgagcatttattgtatgccaggactgtgctaaatatgctacttgctacctctttcttttcataacaatcatatgtggtaggtgtaacttttatccccattttatggatgaagaacttaaggcttggtgaggttgtcacactctcgtgggttttggtagtagagctggaagtcaaagccaagtcagtctttttattggctatactaaccacagaattttcattaaatcagtctttaaaaatgtttttgggccaggagtggtggttcaccctgtaatcccaacactttgggaggccaaggtgggaggatcacttgagcctgggagttcaagagcagtatggacaatctagtgagaccctgtctctacaaaacattaaaaaaattagccaggtgtggtagtacgtacctgtggtcccagttattccagaggctgaggatttggcttgagcccaggaggtcaagacctcaatgagcttgtgccactgcactccagcctgggcgatggagcaagacccagtcccaaaaaaaaaaaaaaaaaaaaaaaaaaggtttttggtttatctgggactcttttagtttttggttgaaatagtaaagaggcacatttgacacaaccttccttttaaagaggatgatgattttataaacctttaccaccctgagctctactcagcttttgttcccctgatgcgttagagcagtgtatctgccaggttgtcttcaatggactcctgcccagtttcagatgccaaaggctgcaggtttccaggagaaatggttttgcatatttgatgtggctgtgtcttctctgacttaaactcttggaattcagaaaacatttccccagcagcattgacgcccacattcaactccccccttgcacaccagccgtttgatctggtgatctggccaggatgctcactaaggctacctctcttgccaggagctttagagactttttttgttgtttcccgtcttgactgaaaaagaaaattggcttgaccttatcagggtcatcataagagaagtcatttctggtctgtttagttctcttgtaggatacaaataaaaatgttatacctttcttccccattacagagctctttgctcccttcttccagtattacagtgcaagtggctttacattctctttccacattttggatagtttcacatttttcttgagtgtcatgtacgatgtggtttgctaggatgagaaaatcataatcctaggattgttttcttttgctttctaaaagtcatatttatacttatatgttcaaccacctcaagctggcagaagaccttgtacccgcgttgtagatacaatctaacagatgtgtgttctctcctgtaggttgacatggtaattttttcataagtgagtcagtttcagtgttgctattatttccaccacagttggtctgtcccccagataattggcatttgtcatcatcatacgtagacctctactcatggttcttgtctccagtctgccagttcctagcatagtgactctcagcttccgttctctcatctgtcaaccgggaacactaaattctgcctattcccggggtggatcagatgtggggatgggtaaagaagcacttgacatttcagacagcattgtagaaaactaattattcatcctgttagtcagcctcatatttcacttaatgcaactttgcctttatttcccctctgaagattcttcaaacttcatgagagaaagtgtgaacctattattatgactgttcccaggaaggtgagtgctgagttttctagacaatccatattttaaacaaatgtaaaaataaaattcaaaaatcccaggcctttcttcttccttacccacgggtgccaaatgtctcttgtagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtggtgaggaccagtggagtgcaggggtgcttggctggttcaggctttatcctctagaaagcccttgtggtccagggcgtcggcgagtactgtcccagctgggtgctcaggggttttcagtaaatgaaaaagtgggagaaggtcctcggtcacgtgatggtggtggtttgtggcaacacttgcctcctttaacggagttaaagctcctttagccccattaaaggagccaagtgtggccacagaccaccatgattgggataggtatcagtttcctcctatctctcagtgtgaacaggagcctcttgggtttttcctgtcttttgccaaactagttaaacccttctctgatttgggtagaaataaaatatcatgggagtgtggggtcataggcaccagggagaggaggtccctggaaggagggagtggcacgtgttcagatgtagctgagtggctacgacagaaggatctggcggtgtggggctggcaacaagggggatttaggcaagagccctttgggtggggaattgggaatcaagcctgcctttgactcgctgcggccactggagagtgctgctgttgccgggagagcaggtcctgggtaagagagaaggagtggacacacagggcaagggtttccctcccaagaaggagcctcacagatggcaggagctctgtagcctctgggagagtcacccctctctctggtcagatagaagttactcttgatggaatgattggggtggttaggacgtaggacactgttgaaggagcctgttttgtcctatagtctaactgtgacccaggagaccctttgtttgagtaaatgcacaggcttcgggatcagaagtggcactgtgacactgtgacacactgttgttttgccacgggatctcagatagatcggccagtgctcattgcattcaaagccccagacatagtagggctttgacttctcttttcaacttggtgactatggcttgccgtttgcaaaatagaaaactacattttatatcttacaagttttgaacagtgttgaactttgtttactgcattttaatcactgcctcctttttttgttttcttagcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattac

SEQ ID NO: 38692 - DNA, 9619 bp, Homo sapiens
aaaatagaagagactcactctgaaaccaccattccagaaacccgggcagggctcggctgtccctctggctcccagattcttttggcggctctcgctttgggaggctctcacattcctctgcagatctgccccttcctccttcctcctcttgctcctgggccactgggttttcaaaaatccggaaaatccaagaggggcaaggagaaaagcagcagccgcctgaatcgagtccaagggtggatgtgtccggcttcacaacgagccaggccgggaaaacaaggactgaggcttacacaacaggccgccaactcttcgaccccggctgcgcagccggagcccccgccggctcgggcgccctctccccgccccagaagtggccagccccaaccccggaggaaggagggggcgcgacgaggctgtcgggcgacttctagccactcgctgagtggtctcttttgtttgcctaattcctcagcagtttctgagcctgacgctgaccctgctctgaatcccaggaaccccgtccaaaggtaaccccagcagaaaccggttcctcacccgggacttacgacccccgatcaccaccctcgcgtgcacgcacacactcaacagtttggagtttggagagtgagctccggcgagcagatggcgcggccagccgtctgtccgtccgtcctcctctccgccctgcggggcccggccagtggggggcgggctgcgcccccagcctgccttccccggcgctcgcagaccctccgctccgccagcgagaaggcagctccaaaacaaaaaggcgattccgggaggtggcgtcctgaggaaggaggggatcgccaaaggggaggtgaggggtggggagagggaggagggagggggaagcaggctggagaatcgggcaaactccgctgcacttccgtgcgtcccggcggggcagggacggccagctccgccctcccgcgggcccggggcgctgcagccgagcccccgcctactcctccgcgcggcttcccagctggccagcgccctcgctcgctggcgctcagtccgggaggcgagagggaggaaacgacccgggaacgagggggcccgagagcctccggggctggtccctgggaccgccacctcccctcctctccctccgcctgtccgccctcgccgggagacacctcacgcccccgtggttggagcgcccggcgggggagcttgccagctgccgctgcctcgcttcctggactccgtcatcctcctgccttttccgtgacgcaaatggagtaaaactccgaaagtttgcaaagcgtggggctgcaaggagcaccgcgccagagccaggatcgggagatcggggtggggggaggggggtgcgtggaaagccgccgcgccagctggggttggggagcagagtcgcggactcgccttcccaccttcccattccccactcctgctccgcagggacgggtcgtggcgcagctcagagattgttttccggaggaacagaaacggcctgcgcgttccaggcgtctgacctaagataccgagagctgcgggtgcagcaccctagccagacagggcgaccctgccctgggcgactagcttggaaggagggaaagacactactctacatctgcagcgacagggaacaagtctaggtgccacccggttccgtgttgcttagtacagcagcggggactggatgttctgtgctagccagcggcagcaaggagagaagtggtcaggtagagaatcttcgagaagaggcaagtgggatctgaccctcggtcagcatatcgggaacactttgggcattgattctgctaggcactgtgctgggcactggggagtagtacaccacaaggcagtcggggtttctatcctggggggcttacagtccaccctctcttgtctttaatcaatccattctgtctcagtcattcattcagccaagtcatgcactcaagaaacattaactgagtacctactctgcaccaggcccctgagctacaaagacaaataagacattatccttattttccaaaagctcagatatgttgtgacaagtagacaaatgctccctgcccagtgtgactagttagtgccatgaaaagtgcacatgagggtacctaccccagcctgggtagagcaaggatcaaggaaagcttcctgaaggaggaagtgcctaagatgaggcaaaggcttcaggaggactccctttcctggctataccctggagtcttgtctaccctgtctagctagatcttcccttcattctctccctagtcacttattgcagattaactggtacaaggtagttctgctaaagatggatacctttggctgttttgagggacatggttcccagacctctggctccaaaacccagtttcactggttcagtgagtggatccgactcccttcgcaggtctggcatttgaccagaataaaggcctatgtacaaaccccagaaggctaggtatcaatttgcacagagaaataaaactgtcaagcagaactgaatttctgcatcaatagatcaaggcagtttgggctaccccttgggaagcccagttaccagaaagttagctcagtgagtctggaacccccaagaggggaaagggtatgaggagtctctcagtcaagtaaccttaaaaccttgcttcctgtcatggggcagccttcattctaaagacagttcgtcctagcatctctaagacagaatatacgttttccccacgtgcttttaggaccccccccttccctgtgatctatcttctgtccacatagcctttctccaaactgagtttaacaatagcatcagggctgggtgcagtggctcacacctgtaatcccagcactttgggaggccaaggcaggtggattacttgagctcaggagttcgagaccagcttggccaacatggcgaaaccccatctctactaaaaatacaaaaaattagctgggcgtgatggcgcatgcctgtaatcccagctactcaggaggctgaggtagaagaattgcttgaacccaggaggcagaggttgcagtgagccgagattgtgccactgcactctagcctggtgatagagcaagactccaatctcaaaaaaaaaaaaaaaaagatagcatcagccaggtgaggtggccaggagtgagaggctgcagtgagccaagatggtgccattgtatatgtcattatactccagcctgggggacagatcgagacgctgtctcacaaaaaaaaaaaaaaagcaaaaaaaagcatctacttccttagtgcttgctgagtgatggacactacagtaaacgctttacctttattagtttacttaatacaattgggatttctgttcacccaatagggtccccctccagcccaacctccccgaggcgtcctcagccaccacccttgacagactttagttggttcccaaacactcagtcacacatttacagaccagccattttggatttactcccacatgtgttctagacgggtttttttgtaactctcaggagccacccttatttccaggttcttgggaggaactcactcctcagcctcactgagatttccagaacctgtatcttcccattccctcccctccagggaccttcttcagtcctaggggaaacaggccatgttagcagtctcaggaaactgcactaacccttgtgatctccctataccctgcccattcctatggaaacagtccctttagtcaagtctcacattattctttttttcttttctgttttttttttttttttttttgagacagggtctcactctgttgcccaggctggaatacagtggcacaatcacagctcactgcagcttcaacctccctgggctcaggtgatcctccccacctcagcctcccaagtagctggaactacaggcacccgccaccacatccagccaacttttgtatttttgtatagggggcttttcactatgttgcccaggctgatctcaaactcctgggctcaagcaatccttctgcctcggtctctcaaagtgctgggattacaagcatgagccaccacccccagcctctcacgttattctcactggggtgtgttctgtctttcctgctgggaccctgattcatacacaggaaacagcatccatccctcatccaggcatccaatttccatcctttaggaaaggaaacagcaagggagaactgtgcccagtggttttcaggctgactctgctggtggcagcctgcaggacacactggactattactgtaggaatgcagacaaaagatgatgagggcctgacatagggcaggggtaacaggctggagagacaaaaatctgggagagcttttggaggtagaatagactgggaaagcaaccaataagctgcagctattgagtgaagtatcaacccacatgttaaaaaagattttttttgaggccgggcatggtggctactgcctgtaatcccagcactttgggaggctgaggtgggcggatcacgaggtcaagaggtcgagaccatcctgggcaacatggtgaaaccccgtctctactaaaaatacaaaaattagctaggcatggtggcgtgtgcctgtagtcccagctactcaggaggctgaggcaggagaatcgcttgaacctgggaggcaaaggttgcagtgagccgagattgcacccgccactgcgctccagcctagcgacagagcaagactccatctcaaaattttttttgactccactttccccaccagctattgccccattcctctgctcacctttgcagcaaaattccttgaaatagctgtctatactaagtgcgtccaattttttttctcctgttctctctttaaatccctctggccaatcttttactcccacactccactgaactattcttgtcaaggtcatcaatagccttggtgttgctggaccctaatggttattctcagtccttctcttatttagccttttggtagcatttgacctggttgatcactccttcctcctggatacattttcttcatttgcattggagagaacatactctcctggtatttcttccacctcactggttcatcctcttctctccaataattcttttttttttttcttttttgagacagtcttgctctgtcacccaggctggagtacagtggtgcgatctcggctcactgcaacctccgcctcccaggttcaagcaattctcctgcctcagcctcccaagtagctgggattacaggcgcccgccaccacgcctggctaactttttgtatttttagtagagatgggatttcaccgtgttaaccaggctggtctcgatctcctgacctcatgatccacctgcctcagcctcccaaagtgctgggattacaggcatgagccacagcgcccagcaagcctccaataattcttaacgttagagtaaccacagtagagttgtcctcttgtcttttgtatccataggcactcctttgatgatctcatccagccgaatgacttcaaataccactcattctagtaatgcccaattttttaaatctccagccctttttaaaaaaactcttaactcatatatctatttctccttgacatctcccctcagaagtctaatggatgcctccaaccaaaaatgtccaaaattgaatttctgagccgggcatggtggcttatgcttgtaatcccagcactttgggagcctgaggtagcaggatcgcttgagcccaggagttcaacaccagccatgacaacatagtgagaccccatctctacaaaaaatttaaaaattagtagccaggtgcagtggctcacgtctataatcccagcactttgggaggccgagggtgggcggatcacctgaggtcagaagttcgagaccagcctagccaacatggcaaaaccccgtctctactaaaaatacaaaaattagctgggtgtggtggcaggcgcctgtaatcccagctacttgagaggctgaggcagggataattgcttgaacctgagaggcggaggttgcagtgagctgacatcgtgccattgcactccagcctgggcaagactctgtctcaaataataataataataaaataaaaaataaaaattagctgggcatggtggcatgtgcctgtagtcctagctactcaagaggattgcttgaggctggaaggttgaggctgcagtgagccttggtcgtaccactgcactccagcctgggcaacagtgtgagaccctatctcaaaaacaaaaacaaacaaaaaacataagtgtcaatcctttgctcaaaaccccgaagtatatgcctctcaacataaaagccaaagtcttttcaagggactacaagctctttaacctcttcctctcctccttgcccactctgctccagccaagatagctttcttactcttctgacatgccaggcacattcctgccttaaggcatttccactgtttcctcttcctgaaatgttctccccctagatatccacacatggcttaacccctataaaatatcaccttctcaataagacctactctggggctgggtgcagtggctcatgcctgtaatcccagcactttgggaggccaaagtgggtggatcacaaggtcaggagatggagaccatcctggctaacacggtgaaacctcgtctctactaaaaatacaaaaaattagccaggtgtggtggcaggtgcctgcagtcccagctactcaggaggctgaggcaggagaatagcttgaacccaggaggcggaggttgcagtgagccaagatcacaccactgcactccagcctgggcgagagagcaagactcgatctccaaaaaaaaaaaaagaaaaaatcaattagattaaaaaagcaaacaatctgtattagctttctgtttgttttagagacaggatgttgttctgttgcccaagctggagtgcagtagtgtgatcatggctcactgcatccttgaacttccggcttcaagggatcctcccccctcttaccccgaaaccctcaccagtagctgggactataggtgctgccaccatgcctggctaattttttttttttttttttgtccatagggactgagtcttactatgttgcccaggctggtcttgaactcctggcttccagtgatcctcccaccttggcctcccagtgttgggattacaggcatgagccaccatgcctagcctggtgatgttttcttaaactggctaagtttatgagtatttattatactttataatttacatattatattattttccagatatcgaatattttatatatatatatatatctttttgagacagggtctggctctgttgtgcaagctggggtgcggtggcaccattgtagctcaatgcagcctacaagtcctgggctcaaatgatccttccccctcagcctcccaggtagtcaggactacaggtgcgcaccaccatgcttggctaattctttaagattttttacagaggtgggatctcgcttcttttttctttttttttttgcctaggttggtcttgaactcctggcctcaaatgatcctcccacctcagcctcccaaagtgctgggattacaggcatgtgccaccgcgcccaaccctcaaatattgtattgtaaaagacaatgaaaagcatacaaaacaaaaatgatcagtgagaagctaggtggcgtcaaatgcccgggcaaaaaggggttaggtctgcagcgctatactcagatgtaacttacagatgcaactagcggaaacagcattaaatttgttaactcaatgcttggtggccagaaattcatgtcaggataattcatttgagcacagactaaagggtttggacttgtagttatagtccaagtttctcaaacttgctgggttttatgaatcatctgacactttagttaataatacagatttccaggcgactcccttatagatcccttttctgtgggcctaggaagcagccaatcagtatttcatgggttcggtgccacctatcccaacttgacaatgagagatcgctctgcatgccaggtgaaggacctgacgctggcgggcggcggggactaccaggtcagccccaggagagccggctccggcaagctcccccaaggcatggcaggagcccagtgcaagttagcacagtaaacccaatcaacaagccgcagtcacccctcttccccagaaatggcctcttcagctcttgcgggggagactctgaaagtccccaaaggacagaagtctaggaggaaatgattgccgcagaaagggatacagtcttggctactaaaaaccgcgcggaaccgcctagggacccgctcccaaccacccacctccggtgcttctaccccctccctcgcaaacgcgaagaaaagaagaaacgcgagatcccagtgcagaggcgtggtcccaccctggccaatgggaagtgagggcgtgactttaagtctttctttcattggcccagggtcccaggccgtccaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccagggaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaactttt

SEQ ID NO: 38693 - DNA, 23768 bp, Homo sapiens
gggcgatgtccttgctaatttggagactgattcagtccccttttggcccccaagttacgtaaagataaggactttggagatgttttctcaggaaggacagagctgaaaaacaaagttccgtaagtctggccggtaactacatctttccttcctaacaaagaataagccgcaattcactctctctggcacctgaactttggggtaacgattaactgcgatccgaagccttcaggcaagtaaaaaattcctgaagtgattacgcctgtttggaggcttgcagggcactaggggatggggaaaggtgaatcgaggtgctctctggctcattcgcagccggctaacccgccatatcttacacagctaagggctgccgacgccattttgcagggtgggctgcgcagactcttggcgggaggccggcgcgcttgagcgggagaggacgtggaagggttggaggtggggagtgcgcgttacgactggaaagcacgcgtgcgcacaggcgacagcagcggaggggtggggccagtgtacgagtgcgcgtgctcggtgggagcccgcggagtacctggaaggaggtgggggcgaggtagaaaggagtggggttgaaaagcgcttgcgcaggacggctacggtacgggggtgggagggcttcggagcacgcgcgcggaggcgggacttgggaagcgctcgcgagatcttcagggtctatatataagcgcggggagcctgcgtcctttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggtaactgctggggggagctggagcgaggccgagcggggcctggtggcggtgagggtgggggtgaggggcgggaatccggctgcaaccgggtctggtggagaccgccagaccgacgggaggcctgagcgggtgggaagagctgcctgagccctggacctggagggattggagccgcggggggagccggtggcgtgaagggggaggagacgagcggcctgaagcgtctggggcgtgagcggtccgaggcccggggcctgaggtaaagtggaaccggccgcctggaagttcggcctttgccggggatacgtggcggagctccaggcgtggtttattttctaacggcggtggttcataggcttctgatgccaggccccgggttggtggtcctggaggctgggttcaccgggaagcatgggcctgcttgttggagcgggtagatgcacagcctggcgttattctggcctcagagcctggagctgccggacgtagacttacctcgcgtgcttcggccagttactgggggtggggaggcgcggcgcggcgtgaggaggccgcaaccgctgggagcacgtggttgccacgtggttgggggagggaggggggtgtgggcgctacatccgggactcaccggcgtgttgccactcgtgagccagggatgctgtggctctgttgaagtgggaaatgttaagaggctggtagcactagggttctggaggtctttgttcagtgcttacagcatgtactgtgatggcagctctcatttttttgagccccttttctgtctcactgcggtaggtggagctagccccactttgcagatgaggatactggtgcccagagataaactcacttaacgaaggttgtacttagtaaaggcaataagagactaaatctaaaccaagacgcttgactccgtagctgctgcttcgtgaatattaatgaggcttcgttttagggggacgtcctcgcatgccgccatttgtgcggcattgaccaaactgcttttctaaatacaagaaacacgtagagtgttcggtttgagtcagatcaagacctaagactattcgcagaattttgggagcaccacccccctcgacttgcggtagtcctgccccaaaaaggagagtcccacttgggtttttgatctcagtaggattaattgcagaagcctaatctttgtactattcagactttgaagtaaatgcaaatcctaccgtgaattttatcttgttcattatccgtgctgagatttgttaattaaacgtctgttcacatttaagcatgtatatgtattggtaacggttagatgatagttaaatggaatcatttaaaatttttattctgacagtgttttgaagaattttgcccattcatggagtgagagtagacatatgtattcaaaacattaaggctttaattcctagttattttggatagctgagaattctggtaaatttatatcagtactttttgataactatcggaaagaaccctccttgtcttaaacataatttctgaatatagtttgaggcgtatgtcactttctgttgctttaaagagtggagtgttgatccctgtagcaaacttcggttcttttacttttgtcatttttcttttgtaatagtaagctattcatgtttgtaaccgttctcatttcgaaattgccatttgggaatttaggtaggtaaatcagctgttttaaatagtgggaaacttaacattggacattacatttggtttcagataattgcttcaggttgagatttactaaaccattgagcttgtttatgcagaataacagtacctatcagcgtagttagagatgaaatatggtatgatgagagaatggaattatagtcttttatgggtgtctgtagaggtttctgttcaagaaatctaggaattgatcattctgctttgccctctggtagctaaaatagtgaaaaactagttcaaaagttagacctgacctttttggttacccacacttaagtttcagtgttatttttctccttgttagagttgcttttttcttcatttacaggttgtgaactaaaggccgacaaagattatcactttaaggtggataatgatgaaaatgagcaccagttatctttaagaacggtacttaaactttcaaaataaactacttaaccctacttgatttcagccttttagtttctattcatgtggcttgagactttttttcctttgctgactgcttataaaatactatttcttacacctgggtattgtgtgtacctcactgtctgtacatctttgaagaacttggcatctataccactcatttggtaaccatgtaaattccagtcacactgttcaacttgccttattttcttcagttgaattacaaagcccttgtaaaaggcatcgataatctttcatgtctaccagagactagccttctgctcaacttagaagttgctcaataaatatgttaggtggtctatattgtgtgtatgcatatttatgcatttcttaaattttctgaatatgagaaactgatttgccaagatcacaaaacctgaggacaacattgcacaaatttgttttccagggtaatagtgagaggtttatacttgttttttaaaaaaatcacagtcatgtgcctcattgcaactgctgggtcaacagatggatcgcatatacaatggtggtcccataagattattataccttatttttaatatacctttcctgtttttttttttctttggaggcagtctcgctctgtcacccaggctggagtgcagtggtgtaatctcggctcactgcaacctctgatttccgagttcaagtaattccctgcctcaccctcccgagtagctgggattacaggcatgtgccaccacacctggctaatttttgtgtttttagtagagacgaggttgttaccatgttgtccaggctggtctcaaactcctgacctcatgatctgcccgcctcagcctccctaagtgttgggattacaggcatgagccaccaagcccggccctttcctatgcttagatgcacaaatactgtgtttcggttgcttacagtattcagtacagtaacactgtacaggtttgtagcctaggtgtgtgtagtaggctataccatctaggtttgtataagcacattcttatgattgtacaaagatgaaattgtctaacaacacatttctcagaacctagccctgtggttaagtgacgcatggctgcatataacatttagtgggggggtgtaaaataggtggaactcaaaagttgaagtagtattttttttttgttcacaggtcagtttaggggctggtgcaaaggatgagttgcacattgttgaagcagaggcaatgaattacgaaggcagtccaattaaagtaacactggcaactttgaaaatgtctgtacagccaacggtaagggcacttacatactttggatgttgtgtcaaggtttaattctgttttaaggtaggtttggtgtcatttagttgtgccaaggagatagaaagtggttctttatcttctgtcactggagttcgatggtcaactcttgaacatgggggcttctgctgctacttttatcagaggtggaaaaacaggttcactggtttgttgatttggcttatgtgtttgcctgtaatgtttattgttcattttcttcacatgtttagtgatgaaaaatttctcccttctaggtttcccttgggggctttgaaataacaccaccagtggtcttaaggttgaagtgtggttcagggccagtgcatattagtggacagcacttagtaggtatgttatttttatatattatactacttagtttgtcctctttagtgcagttgcttggttcccagtttggacttaaagcatgggtatagtactactgtctttttaataggttccaatgtgagtctagaaattggagaggacaaataaatttttggggcgggggggagaggaaatcttgctgtcacccaggctagagtacagtggcacgatcttggctcactggaacctctccgggattcaagcgatcctcctgtctcagcctccccagtagctggggccacagacgtgcaccaccaagtccagttgcgtttcatagttatagtagagaaggggtttcgtgatgttggccaggccgatcttgaactcctggccttaacgtgatctgcacgccctggcctctcaaagtgctagtattacacgtgtcagccactgtgcctggcctaaaaattattttttaataaagacagtctcattataacggctggagtgcagtgatgtgatcatagcttgctatatcctcgaactgctactgggttcacctcagcctctggaatagctagaactacaggcacactccacgcctggctaattttttttgtatatgtgcagatggggtctcagtatgttgcccagattggactcttggcctcaagtggtccgccttggcctccccaaagtgagattacaggcatgagccaccctccccaggcttcttgcatttaaaacctggcagtgaacattaggcctcaaaatacttttgttaaaaagttccttttcccatgtgctctttttttttttttttttaaatagaatagaagtctcagtttttagagtatttactatcagtgttctttttttttctgacttcttgctgcttgagttttataatgtctaataaattgtattttagctgtggaggaagatgcagagtcagaagatgaagaggaggaggatgtgaaactcttaagtatatctggaaagcggtctgcccctggaggtggtagcaaggttccacaggtagagatggcaattttattataggttttgtattatagcttttagtttggtgatagaacagctcttgttcatgagtacgtatcttttcttttaaaagaaaaaagtaaaacttgctgctgatgaagatgatgacgatgatgatgaagaggatgatgatgaagagtaagtatgattttagaaacttgatatacttccggaatcttgacaaaaaaaggaatttgacatagttatatgcatgagggttttataaaagtcatttacaaaaagccatcctatgtaatagtttataataaaagggcaggtggtcatctgttgtcagtttaagttaaatgagctgagttgaaaggatattgggtctgtgagcctttacaatgctgtgacttgtgactcttcagaagggtagactatagtgtttgtgaagtttgattatgtccctttgttctgaagatttagtggatgtgttatacccatcaagcctggtatgttttatggtgagcagttaatgagattgggttgaaagaaaatatgattaaatagctctatattcattttacaagttgttactcaaggtttgttattccctaaaaggattttgtcttatggttttatgtagatatttattgacaaaaataagattctaaaagggatattaagattttcttgggatttaaaatatggttggaaacaatatttgatgactttatattaaactagatcaaactattgttacaaacagttaatacgcacactggtataaagtactgtttataattggtcttatgtgtgccagtaccagtaatgcattgaatactttgatttggctctcagctttgtccttcagttctgaggttggtccatatgcatttattgaaaacaaatataagaacatgcactttaaaagagaacctgcatgaaagatcaaattgggagtttaggttttaagctggtggttcttcaaaatctttgagcatgacgatgaaggcagaaaacaggaaaaaggccgaaagagccgaaagcttaaaaattcaaagtatgaccaggcgcagtggttcacacccgtaatcctaacacccagccaagatgagaggatctcttgaggccagcccggtcaaaatagcaagacccaatctcaaaagaaaaataaaaattcaaagtacttgcatgtcaaacttataaatgaacgcaaacttaaaggtagtatttgactgttgctgtttttgttttctttttttttttttttttttttgagatggagtctccagttgctcaggctggagtgcggtggcgccatctcggctcaccacaacctctgcctcctgggttcaagcgattgtcctgcctcagcctcccgggtagctgggactgcaggctcggggcaccatgccctgctaatttttgtatttagtagagacagggtttcagtatgttggtccggctggtcttgaactcctaacctcgtgatctacctgcctcggtctcccaaagtgctgggattgcagatgtgaaccactgcgcccagccaaatttttgtatttttaatagacatggggtttcaccacgttggctaggctattctcaaactcctaacctcgggcgatctggtcacctcatcctcccaaagtgctgggattacaggcatgagccaccgtgcccggccactttttttcttgagatggtgttttaccatgctactcagactggacttgaatctctgggcacaagctatcctcccctctcagactatgaagcaggtggggttacaggagcataaccaagcccagcttgtttggttatcacttttaagaatatttctcgttagtaagaattgaaatacattccaagagaagaatgggaaacaggctaaaaacacaaattagaaatagggatggtatggttcggattggtttagtctgattttgagttacctttgtacaagtttataaaataagtgtttaatagcattcaccgaggctcggggacaagcaatcccttccagaaaggctttggagtaggacctgattgtagtattgaccctgttggggctttggaagatttccttttttaaaaattgatataattaggccaggcatggtggctcacgcctgtaatcccagcactttgggaggctgaggtgggtggatcacttgaggtcaggagttcaagaccagcctggccaacatggtgaaacccggtatctactaaaaatacaaaaattagctgggtatcgtggtgcctgcctattggtcccagttacttaggaggttgagtcaggagaattgcttgaacctgggaggtggaggttgcagcaagccaagaatgcgccaccgtgttccatcctgggcaacagagggagactcccatctcagaaaaatgggtataaattcatgatgtaaccacaatgtaattttgtttgtctttaagttgggcattgataggaatgaaaagtgtagatatcaaggtccaaatcagtacctggttttttttgtgggattttttttttttcggcaagtctcgctcttgtgccccaggctggtgtgcaatggtatgatctctgctcgctgcaacctctgccttccaggttcaagtgattctcctgcctcggcctccagagtagcttggattacaggcacttgccaccacgcctggctaagttttgtatttttagtagagacggggtttcaccatgttggccaagctggtctcgaactccaaagtgctgggattacaggcgtgagccaccatgcaccgccgcaagttttcatataagttgaagaaagtgtactaaggtctgcatagtagtaaaggatgccttgagggaaacaaatattaatagaaacttcagtggtgagatggcaagggcccagcatagatagatggcaatgaaaatgcaaagaggtgcatgaaggttcgttatagttacttagaaatctaaccttttgaacacagatcaaaggggaatttggttcctttttgaggatggaatgggtatatggtgtgggctcagatgactcttgatttaagcaagaaaggctatgtaatgtgcatagtgctgatgtatactatacatagatgtatgtaatacgttgatagtatgtggcccttaaatgtcttttttaatttttggggaatttcttaagtaaagctgaatttttttttttttttttggagacagtctctgttgccccggctgaagtgcattgttggctaggctggagtgcagtggtgcaatcatggctcactgtaacttctgcctcccgggttcaagtgattctcctgcctcagcctcccaagtagctgggattacaggcatgtgccagcatgccaggctaattttttgtatttttaatagagatggggtttcgccatgttggtcaggctagtcttgaactcctgacctcaggtgatctgcccaccccagcctcccagagtgctgagattacaggtgtgagccaccacaccctgccagtaaagctgttttgatagtagttttgatagctattttgatagtagtttaatagacttgttttaacaaataagaaaaaatgtttaaaaaaagcattctcatcttgtttctagcacaggggaggcacctgcagggattgggttctaatgccagaaacttgtactgacaaaatcactgttaaaaagccacttgaagggctatttgtgacagctttttaagttatgatactttttctaaatacagcaaatatttcttcggtattggaaagataggtgtttcttacatgaagttgctgtattgggatttagagaccagtacgttcagttgttgaattaaacgtgaaccccttggtatttgctaatagagacttctgcctgacttgccctccagtgactcgatttgattactcccctccattgtttacctattaacagttcacacctgtaatcccagcactttgggtggtcgatgcgggcagatcacctgaggtcaggagttgaagaccagcctggccaatatggtgaaaccccgtctctgctaacatacagctgggtgtgatggtgggcgcttgcaatcccagctgctggggaggctgaggcaggagaattgcttgaacccgggaggcggaggttgcagtgagccgagatcgcaccattgcattccagattgggcaacaagagtaaaactcaaaaaaaaatagtgtgcagttcagtggttttagtatgcatagttgtgtagccatcaccataatcaattttagaacatttcatcacctcaatgagaaatcgtactctataggtattacccctcatgctcttcagctctagtcaaccacgaatgaactttgtctataggtttcctgtccctcatattttgcacgaatggacttctgtgactgttttcttagcacagtgttttcaagtttcatccatgttatagcattatcagtactccatttatttatatggttgaatacattgtatgggtatgtttggttattcatcagttggtgagcatttgagttgcttctacttgttgactgctatgaacgcttgtagacatgtcattttacttggatgtacacctaaagcagagtggctcacccattgtattcccactagcagtgtatggggcttctgatttcactccaacctactgatttcactacaccctcacttgccattatctgactctaatcctggtggtatgaagtgctgattgtgggtttgattgcgtctccctgtggactaataatgagcatcttttcatgtattcattggccatatatctttggagaaatgtttttgcccacttaaatccatttacttctctttgtctttactaagttgtaagaattcttttttcttttttctttttgatatgatttttgtatttttagtagagaaggggttttgccatgttggccaggctgttcttaaactcctgtcttcagtgatccacctccctctgcctcccaaactgctgagattacagctgtgagccactgtgcctggcaagaattcttttttttttttttttgacaagtctctgttgcccaggcttgagtgcagtgatgtgatcttggctcactgcaacctcctcctcccttgttcaagcaattcttctgcctctcccaagtagttgggattacaggcaccccccccaccacgcccggctaattttctgtattttaaatagagaccgggtttcgccatgttggccaggctggtcttgaactcctgaggtcaggcccgcctcggcctcccacaagtgctgggattacaggcgtgagccactgcactgggcccaagaattctttatgtattctgcaaacaagtcccttatcagacacaagatttacagattatcttccaccattccgtgaattgttacttaactttcatgatggtggcctttgaacaagtttttaatttttatgacgtccgatttcttttgttgcttgtgcctttggtgtcaatcctaagaaatcattgctaaattcaaagttgtgaaaatttgcccccttaattctgagttttgtcctttatatttagggctttgttccattttgagtaaacttatgtgtatggtgtgaatggaggggtctaaatatagactttggatgtagattagcagttgccccaacatgatttgttcaaaaactattttttccccattgaatgatcttggcaacctttaaaagagtcacttatggctgggtgtggtggctcacacctgtaatcccggcactttgagaggctgaggcaggcggatcatgaccaggagattgagactatcctggccaatttggtgaaaccctgtctctactaaaaatacaaattttagctgggcatggtagcgtgtgcctgtagtcccagctactcaggaggctgaggctggagaattcgcttgaacctgggaggcagaggttgcagtgatctgagattgcaccactgcactccagcctggcgacagagcgagactccgcctcaaaaaacaaaaaaatcactgtttctggactgttctgttgatgtgtctatccttaacatgtaagaacagtacaacactgttcctctgtggtttttatttatttatttttttgaaatgagtctcactgtcacccaggctgtagcacagtggcgtgatcttggctcactgcaacctccgcctcctggttcctcctgcttcagcttcctgagtagctgggattacaggcgcccgccaccatgcccggctaatttttgtatttttagtagagactgggtttccccattagccaggctggtctcaaactcctgacctcaggtgatctggccgtctcggcctcctaaaaagtgccgggattacaagcgtgagccacggtgccttggcccctttgtaggtcttatagctgattttttgaaatcaagtgtgagttttctagctttcttcctttccagattgcatttggcctctttgggtcccttaagtgtcttttttgtttttgttttttgagatagggtcttgctctgtcacccaggctggagtgcagtggcagaattacacagttacagttcactgtctcaagcagatcctcctgccttagcttttcaaatagctaggactacaggcgcacaccaccacgcctgctaattaaaaattttttttgtagagagggttctcattatgttgcctaggctggtcttgaactaaaacgatcctcccacctcagcctcccaaagtgttaggattataggtgtgagacactgtgccagttcttgggtttgtttataaattttaggatctgtttctacagagaaaccagcttggggagtcttctaacgattgtatttaacctgtatattcggggagtgtttccatcttggcaatatctgaacatggaatgtttctatttaggtctttaatttttttttttaacacaaattcactctgagtgtacagtttaatagaactatacattacttaaatatacatacattatacagtggtatagtgtgtatttatgcaaaactactcattgagcaacttcatttcccagcccctagcgatcacaattataccttctatttctttgagtttgactacttttagatacttaatgaatagaatcatacagtgtttgttcttttgtggctggcttatttcactttgttcaaggttcagtcatgtagcatgcaagaggattttcattgtgtgtacatatacattttcatttagtcatttaacacttgggttgctttcacctcttggctgttgtgaacaatgcttcgataaacatgggtgcacaaataatcacttcaaggtcctgctttcaattcttgtgtctactcccaaattttgaaagtgcttaatgtcttgacatttcatttgtagtgatgatgatgatgattttgatgatgaggaagctgaagaaaaagcgccagtgaagaaagtgagtagatacaatgctacaaggttgttaaactaacaatagaaatggtgattttttagtgctatttgcttgttttgtagttaagggaagctggtgtgggagatcatctcatactgaaaattagtcctgaggaggattacagaaaacttaagagtggggaatggtctgttttctttatccatgtggccctccacccagtttgttagtcttgtgtaaccttttgtccaagtggttgctgctttttccttccttttttttttttttttgagacggagtctcaatgtcacccgggctggagtacagtggcgcgatctcagctcactgcaacttctgcctcccgggttgaagcgattctcctgcctcagcctcctgagtagctggaattacagactcatgccaccacacccagctaatttttgcatttttagtagaccaccatgtcggccaggctggtctcgaactcctgacctcgtgatccacctgcctcggcctcccaaagtcctgggattacaggcatgagccaccacgccaagcctgtggttgctgcttgtcttacatggcttggacagctttgtttgcactgttgttggggtcagggacagtgattaagataaatttctaattgcagtctatacgagatactccagccaaaaatgcacaaaagtcaaatcagaatggaaaagactcaaaaccatcatcaacaccaagatcaaaagtaagtggctacatttacacgtgggtctcattgatctagttggggaaaaagattctactgtggaagaatctagtgtgtctgaaatttgataggcctttatagaacccctgtaattgctgtttaaaagttaaaatcagcttgctgcagccaggctcagtggctcactcctgtaatcccagcactttgggagggaggccaaggtgggtgggatcacctgaggtcaggagtttgagactagcccggccaacatcgtgaaaccctgtctttactaaaaacacaaaaattagccaggcatggtggtatgtgcctgtaattccacctactcaggaggtggagacaggagaattgcttgaacctgggaggtggagtgcagtgagattgcaccactgcactccagcttgggcaaaagagcgagactccgcctccaaaaaaaaaaatcagcttgttgtgtgttgtaggtacacacacacacacaaacatactaaatgtaaggtggtggggcggggggagccaatagacttttttgaaagagatggaccctcactttgtcactcagtctgggttagagttgcgtgatctcggcttactgcaaccttcacttcccgggttcaagcgattctcctgcctcagcttcccaagtagctgggactacatgcgcgtgccaccaggcccagcgtatttttgtatttttgagtagagatggggtttcactctatatgttggccaggctggtctcaaacccctgactgcaggtgatccgccctcctgggcctctcaaagtgtgtgagccaccacgcctggcctgaattttttgtgattgtgaagtcaatagttgtttcctgtaaggaatctttgttgaaaggtatgtctgcatagagtagaagttctcaaccttggctgcatgttagcttgaagtagaacatttgggcctagacagggtgtattgatctcattcctgaccctacccacttccctgcagaaaatggaatttaaaggaaaaaaagtttaaaggaaccccagtacttgtgctctacttatggagattgtcataaaaatggtctggggtgggcgccaggcatcagactacagtgactttcttgctttattcttagggattttctgatttccttttttttttttttttaacctgatgaaatagtttatttacaatttaaacgaataaatttcatattctacaacacatataatctattgactaaatgtaactaatgatgaacctccatacaaacaaccccactaaaaagtgggcaaaggacataaacagacacttttcaaaagacatacaagtggccaaaaagcatatgaaaaacagctcaatatcactgattagagaaatgcaaatcgaaaccacaatgagataccatctcacaccagtcagaatagctattattaaaaactcaaaaaacaacagctgctggcaaggttgcagaaaaaagggaatgcttacacactcttggtgggagtgtaaattagttcaaccattgtggaaagcagagtggcgattcctcaaagagctaaaaacagaactaccatttgacccagcaatcccattacattcccaaaggaatataaatcattctaccataaagatacatgcacacaaatattcactgcagcactattcacaatagcaaagacatggaatcaacctaatacctgatatggtctggctttgtgtccccacccacatctcatctcaaattgtaatccccacgtgttggaagaggggcctggtgggaggtaattggatcatggggtagatttccctcttgctgttctgttgatagtgaattctcatgagatctggttgtttgaaagtgtgtagcacctccccctttgtgctctctctcttctgctgccatgtaagatgtgccttgcttcccctttgccttctgccatgattgtaaatttcctgtggcctcctagccatgcttcctatacagcctacagcactgtaagtcaattaaacctcttttcttcataaattacccaatctcaggtagttcttttttttttttttcattttatttatttatttatttattttttatttttattttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtacctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagctgccatcgtcatcctggcccgttctcaatgagctgttgggcacacctcccagacggggtggtggccgggcagaggggctcctcacttcccagtaggggcggctgggcagaggcgcccctcacctcccggacggggcggctggccgggcaggggggctgaccccccccacctccctcccggacggggcggctggccaggcggggggctgacccccccacctccctcccggacagggcggccggccgggcggggggctgacccccccacctccctcccggacggggcggctggccgggcagaggggctcctcacttcccagtaggggcggccgggcagaggcgcccctcacctcccagacggggcggctggccgggcggagggctgacccccccacctccctcccggacggggcggccggccaggcggggggcttacccccccacctccctcccggacggggcggctggccgggtgggggggctgacccccccatctcccggacggggtggctggccgggctgaggggctcctcacttcccagtaggggcggccgggcagaggcaaccctcacctcccggacggggcggctggccgggcggggggctgacccccccacctccctcccggacggcacggctggccaggtggggggctgacccccccacctccctcccggatggcacggctggccggtcgggggggctgaccccccacctccctcccagatagggcggctggccgggcggggggttgacccccccccacctccctcccggacggggtggctgctgggcggagatgctcctcacttcccagatggggtggctgccgggcggagaggctcctcacttctcagacggggcagctgccgggcggaggggctcctcacttctcagacggggtggttgccaggcagagggtctcctcacttctcagacggggcggccaggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacattccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactctgtctgccctgatttccttttttgaactgacttagtactgtgcataaaagcaaactcccaagttactctttttttttttatttaaagagatgggtggcctactcttgcccaggttgaagtacagtggtatgatcatagctcactacagcctccagctgctgggcttaagcaatcctcctgccttagcctcctgagtagctgggattacaggcatgcaccaccatgcctagctaatcatcttattccttccttaaaggaaagattttaagaacaaaattatatggcgtgaatttattgatgataattccagttgtataattagctttataagggagttttgtgagaatatttgaggaaatccagatagaatgggttttaattaggaattgtatttattcttatgaccttttggaaattcatttctttttcagggacaagaatccttcaagaaacaggaaaaaactcctaaaacaccaaaaggacctagttctgtagaagacattaaagcaaaaatgcaagcaagtatagaaaaagtgagtaaagttatcttaaaaaaactttgtctcccccctcaaattgcacgtgtctggtttgcatagacttgaatgtttcttgtttttttgtttgttttggtttaatatacttgcctggttcgtggtatgaattttttcaaaaatttcttataaaacatttataatcgtgtctgtggtgatttttgcatatgcaaaattaaatatgccttattttccattatgcaaggaacgtagtgcactggttgcaagataacattctgaccttccatgttaaaatagatcagtgaaaaccctttgcctattctggttgtaagatatgctagagaaccaacagagggcgtatgagacttcattaaaattacaaacagctggaaaagtagatgctggctgttgcttggtattatagttaatattcatgattgaccctagtcagaagtgattttcagcagattgagacatttctctttgccctttacaccaagttgtcaccagttaatacatgtagtaatagctagatttcgtgaatgactaataggcttaaatctagtttccttttgtcttaaataatggaaatgtgggaagagggttaggtctctcatctgcttgactgggggatttgagtaggatatggaataaatggtttaaatgccttggaagcacatttgagagaagctttaattctatgaataatacttttagactccaactattgagagcaaatgtggggtggtgaaaaattgccaactcatttccccatgtttttcttgtaatctatagatttttcgtggcttcagtagattccttgtacagtgataagtccactggaaaaagaattttagaactggaacatatttcttttagtcacactgtaaaccctttagccttcctggttatcactgatttttgtcccttggatacaatgctaaaatgacatcttttagatgcccctcccctccattttaatatggtcctatctccttggtttaattgcaggcgcattgaacagtcctgggcactacatgtaaattaagcccaaagatggggagaaaggaaaaggagagacaaatatagtccatactgagtgtcatcaacaatccagactgaagtcttctattttaatctcaatccccttttctgatttgccacccatgcctcttcaggctggaaacaatctcttggttccctaaagcactttcttctgactgctgtgattcagtgaaccttgccctttgctttctattacttgtgcatttgcctcacctgacaatgttttaaatcgcctttgtatctccttagctgctcaataaatatttgaatgcatcaattaagaatgtatgtgacaataattttgaaatggaaattgtgaggtttattttactaggttattggaggcagttaagtttcttaatgctatacctgattctgccaaagtcccttggacatttgaaaaccttttcaatcttttaaaaatgcataaaagatacttagagggaaaggtattaattaaatttagtaaaaacaaatatattcaatgctttaaattccaaagtagtgataaatacaaacatttcaagatatttgcaatagtaatgttttgaaattttggttacaaagtcacaggtcttgccaatactgttgtagtttcttgcctatatccgtaatttgaaggaaatggtgagagtgattagagaagtgtaattactgtaattttttcccctattgtagtttcttgcctgtatccataatttgaaggaaatggtaagagtgattagtgaaatgtaattactgtaattttttccccattcaactttatatatctttaactgatgaccagatcattgttgttctgaaccagtttgtggtcagcaagtgttttgtggggttttgtttgtttgtttttaaagaacagtttgggtcacttgacatggttctccaaagggatgttatgggttgtatttggttctgggtgataaccgacttgttagataatttagataagcaaccgagttgccatgtttgtttgtcgaatctcaagtgtagcttatattttatgttcctagagaggttgtcagggaagatttgaccctttggcaaatctgtttgaatagagatactagccatgctgcccaatagggctttctggccctgaaaaagatacggagtattcttggaaagttgaagggaaaaagaataaactgatccatgtagtagcatgcagattattgaggaattttctaaaggtatctctctcggtgtatttctctacttacctgtaataatgcttttgtcttaatagggtggttctcttcccaaagtggaagccaaattcatcaattatgtgaagaattgcttccggatgactgaccaagaggtaactggattttctggggacatgattaaatccaagtttttttgtgatttattatgattctgcctttaccctttttaagtgttggctctttttaaaaagttcctaaccacagataatatttcatttaatgaaatacctgaaaactcatgtatttaatgaaatgcatgaagaatacagttggcagtctgagatgataactttagtatatttttcccagatttcctatagttggtaaattatttcttggttattgaattcagttttacttttttggtactatgttggttaaggaaattgctgtggttttccttgctgttccatttgactgcttggggcagtctggtcttggcttttttgggagttggtagagatcttttttttttttttcctagatcttatgggaaatacattatgccaaaatcatcctaacatgaaatctggaagcaagacactaaattgtggctactaccagatacataagcttgagttagctgttagattttacagttagtacatgtgaaagtcttagtcaacataaagattatgcatttatttttgctcttatttacagttgactcataagtgtaaggacaatgtaaaagtggttaaatagggatgttaggtatcgtgtggagaacggatgctgcatttaatggtctttaggtttcctgtggtcagcttttttcaaaaaattaggaaaatttggcaattagctggttttttttctgccatagtattttgcacttcaattatttaattgcacttcaatttttagttttcgggttcgtaaaaccctgataatggttaattttgagtttagctttgtgaaagttgtagtgatgggctataagatgatcaggttcagtctttggttgctgttctgttttttctctacatttgaatcctaaagtttaaagtgtgagttttgggagtttatttggaatactaaacattgattaatcataaattattttgaaactccgcgttatgcaactgtttatttaatattgaaaatagtggaaagtcagacataaataaccagcatgtactaacagctaagcagcataagagatgcattcttcaactactgccaaggaaagtgatgataaatttaatgattaagttgcagtagtcttctgtactttataacaaaggcttgtagctacaaagtcttgtagctattaaattactgaaccagcacttctacaagaagtattttctttttataaaaagtatttttggccaggttggtcttgaactcctggcctcaagcagtcctcccatcttttcctcccaaagtgctaggattacaggcacgagccaccttgcccagcctaccagaagtatttttttgctctagaattgaaagtgttctcaagtgtcagaatgaaatttctggaataaatagtaaatgtttaataacttgaacttgaattgctgttacagagattatcaaaactaaatgcttcctgtttttgacatagagatgcatgatgcaagcaacgacaatgtatatttgtttgaacctgatgataagatctctggctgggcgtggtagttcatgcctataatcccagcactttgggaggcaacatggcaaaactctgtctctactaaaaatactaaatttagctgggcatggtggcatgtacctgtaatcccacctactcaagaggcggaggcaggaggatcgcttgaacctgggaggcagaggttgcagtgagcgccactgcactccagtctgggtggcagagtgagagtctatctcagaaagaaagatttctatgatatttaatattggcattcggtattcagttaccttgtacctgagaacccattggctgtgaaacagtgacagctgagagaatcctgagtcatctcatttctagttcttggtgaacttctggacttttcttcagaaccaccttgccatgttggccaggctggtcttgaactcctgacctctcaggtgatccaacaccttggcctcttaaagtgctgggattacaggcatgagccaccatgcctggccagctgttttttttgttggtttgttttttgttttggtacccatctgtagtgtgatcttggctcactgcaacctctgcctcttgggctcaggcagtcctcccacctcagcctcctgagtagctgggcctcctgtagttgcacaccaccaagcctggctaatttttgcatttttagtagacagggtttcaccatgttgcccaggctggtctcaaattcctgagctgaagtgatctgcccgcctcagtctcccaaagtgtagggattacaggcgtgagccaccatgcctagcctcagcatatagttttttctaaatgtacacatgcccaggcacacatgcacaggcaattcagaataagtttctggtgtttatgtaactttatttgccaaatctggccaactctaaagctgatctcgggagatgaagttggaagtaacattggccatatgggtctctgttctttctgttgatttccttaagtaaataatgctaaactattaaataattattagtatattgttcacatttttatgactgattaaagtgtttggaattaaattacatctgagtataaattttcttggagtcatatctttatctagagttaactctctggtggtagaatgaaaaatagatgttgaactatgcaaagagacatttaatttattgatgtctatgaagtgttgtggttccttaaccacatttctttttttttttttccaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagt

SEQ ID NO: 38694 - DNA, 16487 bp, Homo sapiens
aggtttttgaagatggcggccctcaaggctctggtgtccggctgtgggcggcttctccgtgggctactagcgggcccggcagcgaccagctggtctcggcttccagctcgcgggttcagggaaggtgagtcatgcgtcccagcaacctcctgaaattaagaagagcggcagagactgcttccgccagccccggtgcgctccttcctacctttccttcgtccgattctgaaactttggaggtaccggctccccaggcgtgcttaaaagccccttccacaccctggtgccttatcttgatctcctgccccttgtgagtatcttcacaaggcggaggaggacggagagaaaagcctgcttacttagcaggagcagacactaaacctgtcctagggctcagaaaagttttcggaaagggtttgcatgttaattcttccttccatgttctccgaatcgcagtctcttttattaaagagtctctggatcacgaaggaaggccatctgggtaccctcccagagcctccctttccactttcccttctcaaaatgctgtgatctgatggcggcgttctctgccccgggccgctagtctccctgtgagggggaggccaaagtggaaaggccattgaatagctgagacataggcaaatgcaggatggtagttcagcttttcattaatcttaatctgggaaagcggcctgattcgagcatcaactgagagtttactgaatgccaagtgctatgcttcaagctgtgaaggaattctggagacagaaaatacagccctttttctgaaaagcttaggttctaatgagattatgtatatacacactccaataaatgcaagttagccttttacgtgacgaagtacagggagactcagttactggaaacggcaaacccagttggaagttttcataaagaggatgtgtcttgagcaggctcacaaaaggatggaatctggcggagagtgaaacggtcttttaggacatagccttcctttgtgtactcctggaagcaggaaaggatgagtgatgtgcaaaagaagagatgtggggttttttgaggatctggcatagtattgggcagcatatcctttaacgaaagctgagaagtatccagtggaaaagagtgatcattgttgtcagagggagcagaaaagtctaaaaagggcctaatgaaggggccattggatttgtctcagaagaggtctctttgtagctttcaaacagcaatttcaatagagtggcaaacaaggaatccagtttggagaaatgaaagagatagttgatgaagagatggaaatagtaagtatgtttgaagaatttagcccgtaagggaagtggagcatttgctagaaaaaaaagtctggatattgcctgattaacttatccattagtagacccattaataaagacactaaagaaatcatgcagatgatagagaggacttggatgtttcatttgttcccatgctgcaaaataggcatatctccataccattttggggagtctaccaagtgtcaaacactattggctacaatttgcatattcttatgaaattcaaagttgaggcagattttgctatgcttccagaaaaaaaggcaagaggaatcgttttgttttaacaacaaatatttgaagttagacttaattttttcctttggagagtttgtgaaatgatggactgtaagccaggtacagtggtacatatctttaatcccagcactttggaaggccaaggtgggaggatcacttgagcccagaaattggagtctaacctgggcaacgtagtgagaacgcccacctctttaaaaaaagtaaaaaaggatggactgtaaatcaaatgggtctctgaagtccttcatctaaatgttaggttgaattaatatgattctacatgaaggcactaccatattctatattcttaagaatcacctatcttcaaagcttgtaaatgaaaacattttcttttgctagtctatgcattatgtgtaaggcataaagtattatacatatagctaattttgactagtctcagctggtatatgtgacacccaaacaatattgtacacatagaatttaaagttgtgggaaagaagctggttctcttgctgaaaatattcaggcatcctacttttcaaagtatcagataataatacataattttagtcagctcttgaggactgagcaccaattttcctgtctatgaagactttcagtctaaaacagtgattttcaactggggggcaattttgtcccccagtaacaattggccatgtctgcagacatttttggttgtcacaactggtactactggcatctggggggtagaggcgagggacgctgctaaacataatgcacaagtcagttccccacaacaaagaaccatctggcccaaaatggcagtcctgctgctgttgagaaagcctggtttaaagtttgaccagagagatacacaaagccaaaaaaaggttattatgggaaaagcaagactgaaggaggacgaaaatagaaattgtgacttactgtgcctgcttcaaatactgtgctaggttttccacatacatttattcagtcttctcaaaaacaccttaaaggtagatattaactgtcctcatttttataaatgaggaaatgccgttccaaggggtttaatagcttgcccagcatcacctgtctaataagtgatggagttggaagtagagccagccctcttccctctccaccagtaacatcaccttggtattccatggcagggcctcccttattgttccctccttccctgaaagctcttagcagttaacttgccaaagaccatttagtgccattatggttggcactgccagatttagcaaagactgtgttggatctcattcctcccttatccctcttagagcccttgtgaaggaaatgtatttaaaataaaaaaacaaacatattattatataaattaagacatgatttgtcagacacttagagaaaggtatattgaagtgagtaaaggccaaagggaatttgcttcatctctttcacagtcagttaagaaggccttctggaagacctaacgtttcagacaagggtatgcctggcaggttgggcagtcccatataaaagctttgagagaggagtgagttggagtctttaaagaattcaggggacatagtccagagtaacctgctagtgggaagaaatttttgtgcagcagtaagacgactcattctgaagcatagggcagagggacattccctcaggggtccaagggaaagaaagggggaggtgatgagggaaccagaaactttaatggtagagttaaagatgaactggaggaagcagggcttgaggcaggaaggtgtttgcaaaaagttgtcagtggccagaaatgcaagcacacatcccaaacatggcacacctctccctgaccctacataagactattagggccactgcccagccatcagttactccagtctttcctactctgcttgggccctggtttttacagatcctctccaagagggaccttggtctctgggcacttcagcagtgccctgcactcctcatcttttttcacttcctcttttattaagcagttgagtctttacatggctgcagttcactgtgtctgttcatgtggccatcaaggttttttgcattttctgtgtttgttgttgttgttgttgtttaagagacaaggtcttgctgtgttgcccaggctggcctctaactccttagctcaggtgatcctcctgagtagctgagactataggtgtcaccccatctcctccttttgcattcactgcaatctcaccacaatgtcatttgttccacactgttataattcagttatcttggactccatcctgggcaagtatttactgaagtactcaaaggacctctttacgaggcatggactttattatagtcaagttcccatgcagagtttagttcttttcctcctctagggcaaagactgtggctcctattctactgtaattcacagtaggtagaatgaagctgtatagtccataagtgcccagcaaatgtgttgcctcactggggacagattatttcatgtgtatgagaagtgcttatctggaaagattttggcccttagttccagtttagaaaactgcttcatctcttcccttagcttacttgatactgccatatctcagaacacaagggtgattccatctttttctaaacaagttttctgttactgcctaaatctctcagtccagcttttcttagccacccccacttctcttgaatagggaggcagccaggaacaaaatggatcaggttttgtttggttttgacacgtttttgtatgcaccctgtaaatcaatactattttgattcctatctcctctttcgaggggcttaaaatctactaagggcctcaaggaccaggttccaacagggccttctccccctgcactaagacaccaccctgatcagtgtcagttcaatgtgagttctcaggtcattccttctggtttgacaaattgtctctgttagataagcatctgcctattgttttacccactggcttctagtaagatgattcgctggctcacagttgctgcgtggagggggagtttgtgaacagtggagcttgccatgggctttgatctgttttccaggggccagtgggatgacttcaggatttggtactttgccgggagtgatgtgtgttttgttagacttgtttacctcatggttaggacccaagtgcctccaccaagcagggaaccacatgtttatccacttgtgtttcaaggcattgttcttctgccgactccagtggtaccagaacgtgtctctcctttggttcctttggggattcttagaaactttccccactacttgttgctcagattaggttgtctctcaacttggtttttgcaaattagcaaagttgcagggtgcctggaacccctactggactggggatgtgccctcctcctacctcccttcatttctccccatcctccgtttgtaggttgattctgcagattgacgtattgcagtgaccttccctctgcagctgtgctggcttccagactgaggaccacattgagtctcacccaaatcccattcttgggttggtctgtgttctgtacaagtagatccgtgtgtggggtgacccattttcttttacatggaaaaacctaggttgtctttgaattgattagtaactacagtgttctctggagaaagcctcagggcttttctagccattgttattcctttgtatgtctggagttggacactgagaggctctcaggttggttgttttggagcagtgagtctttatgaatgggttgcccagaagacaaatgagggacaattccaagcagtctgtgtccaattaggtgttggtcacagagctcagtgatcacagatgctgccatgggcctctggttgggttacaattgcctttttagttagatggtcccttctctttttattggtgtttgtttgtttatttgagatggggtctcgctctgtccctcaggctggaatgcagtggcatgatcatggctcgctgcagcctcaacctcctgggctcaagcagtcctcccacatcaccttcccaagtagctgggattacaagtgcatgccaccatgcctggctaattttagtgatttttgtaggattttgccacattgcgcaggctggtctccttaactcctgagctcaagtatttcttcccgcctcagcctcccaaagtgctgggattacaggcgtgagccactgtacccagtctggcttctatctttctaaagaaactgtgtcaacacgggagtatctccaagaactatttgattatattagctgaatgtgggctattggctcattctgcatcttggttaggtaagataggaaatgtattcagcctgacagacgtgtgcaactgattgtcttgccttcagattctcttctgactgcctcacctaaataggcaaagcactgagggtgtccctctctgtttggaatggcagtacttgaaattcttcttggacccagtatcttcatgctccttattcctaccgcatccatcaacactctccagtatagataataaaatgcaaccctgcagggagaagaggatttcactcaagactcccaggatgtgttctaggagtgaacttgtctttttgctcattcactggggtgccactggaatagtgttagttcagtgctatatcttacattgtaaactcttcagagcagaaaccattcttatctgattctctttgtgcaggaacacacaccgcctgcgtacttttgaaggtcttttagataccactaccccaccctcttttattgctagccaccgtaggacaggatctgaccaattcctttggatagaaccaagataaatctttgcatagaaaggcaaaaacagtgcggaactccttaatcccataccagagaggtgatgctacctgggtatcctgggcttgcccccaccccgcctcaagggcatagagccttggcactagtggggtgaaccctgcatgctttctgttctaggtggagaccatgagagagtacagatggaaggctgcttttttccagatgtgtagaatttgagctgttatttgaaactctctgttccttattaaatggctgacctaatgtttccccctttatctccgtagtggtggagacccaagaagggaagacaactatagtaagtatcgttgagttggccatgtataacctctttaacgcttggagctgcctggccgctcctctgagggagggaggggcccaaactggacgcccagctccaggatcagctccctcaatgaccataaatcccacagcctactatttttcaagctgtgtgctatagtgtggttaatcaggaacagttgctgtgcctgggctgaggtatctgctatttgatgaaagtggccttttgtgtagcaaggtctcagaggcctttgctgataagctctttggcgggtgttgaatcattttcccaaaggggaaactaaggcattgttgcacgcctagagagccagagtaagttgacccagagccaagagcctggacctcagttcctttcttttctgcctagaatggctaaactgctccttaaatgatgcatttaaaaagtgacattctcccggccctggcctcactagctggcgccctggtttgtctgttggtaagaaagttggaacaatacttcatctacccactcccccgtttccctccctgggcccatcccacctcccttccttggggagtcatggggcctagattatcctataatccttaaaagacaacaacgctgttttcacatggccttctatgcctccaagaaatcctcagtcactgcacagagctcccagaggcctctgtaacttccatgtcaaccagatatttaaccctttaggtagccagccaagctcaatcctccccaaggcagtcttattcccaggacaagtccattgggtctccccctagaatgctccctctgcctttccactacttagcctcaaaacagttctttttaggggaccccccccaatccccttagggtaccttttaggctccttgattcaaagccaaaacaagcattcactctatcaactccatgctggaggagagaaatacatctgacttttgagtataaagagtgtttttcatgtggggcatgagtctgctgtttgtagaatagatgtggaggcattgtggcctatgagagccctcaggggagggaagagcccatccatgcctttagcggcatggccatggctgactggatattattctctcccctatgaaataagatcagacacctacctcactagattctggaggttaagtgaactaatatatgtgaaccattcttagcactgagccacacatataatggggagtcaataaatgttagctctccccacccccaacccccaacccactgcaacctgcctcccaaggcctaccgtgtacttgcgaattttctctaacatctcagtttctggtatagttgtgattgccatggcagaaggagggtagcagtgccctgcacagccaagtagtacttccagcccctttcccctgtgccacttctcccccaggagacagtgttgcttccctcccaaagcctctcagacccgtcccagcctcactctcataacccacagcctcagtcagccaggctttctaaactcccctcttgcaattggagctaattcccaggtcgttggtttattgcgcttagtaattccaaggctgtatcacaggatacggcagcgatagggaggtcatttcgcacttggcctcagcagggtttaaaaggtggcatccaaaatgataaaagcaaggagcatgacagagaaatgtatcctcccatctgtatcgtgttagttttttctttcttttgtaaagagagaacgagtgcacgcatatctgcttatatggcacagcccgggttttttcagccttgctattcctggcatttggggctgagtaattctttgttgtgagggctgtcctgtgcagtggaggatggttagaacatccctgctagatgcagtagcactccctcccccagtcgtgacaattaaaaatgtctccagacattgccagatgtcccctggggagcaaaatcacctctggttgagacccattggcatagccttagctctgtaagataaagctgggaactgcagtttcccgctaggaggacatgtgggatgggagggaggctttctttggactctatatccctgtgccacttaaaactttttaccatgtgcatgtattactttcccccaaaagccaaggaggggaaaaagtatagtgttctggtgcctttgtttttttcgaggacggaaaggtagcattcaattgatagagcaaacccctctctccctcttgacactggtattaagttcagatggtttccattacccctgtaggccaccaaaccacatccctgtagctatctcaaggcctagcatacggcaactacagaataaacaccacagttcaggcagagaaacctcttagctactcccacaagaacccccaaggtaaactttcaccagcattaccatcattttggggtttgtgcaaagataatgtggctccacgcaggtcctgtctctcacactggctcactttctctgtctcctagattgaaggccgtatcacagcgactcccaaggagagtccaaatcctcctaacccctctggccagtgccccatctgccgttggaacctgaagcacaagtataactatgacgtgagtctgggtacagagacactcggttctgtgtgtcatgaagttctcagattccctggttaactggagcagcatgtccccgctgtagctactgctgcatttcatggaaccaccagagatgggagcattttgtccagttgttctcaaccctggctgcacattagaatcacctggggagcttttaaaaaataatgatgcatgggctccaccaggtcctcccaagccacttcatagatgtggtctcattcaccgcagctctccctctgaagaagacccatcaccatcttcggtagcctaggagactgaggtcacagtgtggaatcagcctcggggggtggggcctgagcattttttcaatgctctcccgtggttctaatgtgcaaccagggttgagagccactgattgagtttgtggtctggtcgtgcctcagaccactagggcccttaactcagctcgccggggttgtactcttgtgggatggaatcatgatctgggtttggctttcctcttttatgatgagggtgtatttgaacaggctcttggttctcactgtgatctgggaacacattaccttgtcgttctgtattggagctataaagatacctgattgctcaagctcttctagtgcagtcgtttccagggaaaaaagacagtagtgaataataacaacagctaacattgagtgcatactctgtcgggcactgagtacttacctgttttaattcacttagttttcacagtaaccctatgaagtaggtactagtttcatcctcattttatagatgaggaaatttgagacatggagacgtttgtgaacttgcctcagatcccccagccagtatcagagctgggatacaaactccagggacgaaagcccaggcagatcccatgctcctaatgactacactacctcctccccagagatggggagggcgtgggactaaggacacagccctggagaaatccttacttgttcttcagagctctcacaggtgacatgaaacaccctatttttgggtttcaggtgattcaggctctgggccagtttgacctgcaggttgtccctgtgcccctttgtggaataggatgactaaaggcagagatcctggtcaggtgataagagcaggagaagccacatgcccatgggatctgaacagagtgacccaactaatctcgtgggctggaagccttggcttgaggccaccctgagggttgggggggttctttctgtcctggggcccttctcctgatggccgcctggagtaacaggaagcaagcacacaggcaaggggcagtgttcccagccgctcaccatgcggaagttagtggggttgtgggcatccttggaacctcagctgctgatagaaaagcaaaccccacacccgcccaaccactgtagggcactcttcctaccagccttttccaggaaacatacttggctctctccagcagaagaaatctaatcccggctgaggtaaaggctaaagttgtttttcctcttacccctttccactcagagcaccattatcctgagctgcacaaagctgttagcttgcttggcagcctagggtggagggctggggcctccagcccagttgattagccctggattaatccaatccaagttcttttcatcagattctgaaaagtacaggggtgggaattgaaggcctgggtccctcaggaactgtccagtgattaaaacaaatctgcagttatgcagcaaggcgcctgccagggcagcaagttggtttgtggaacttgactgctaagattggcatgccaggcccttgcagggaggggaatggtgagttttctttaaccccttaagccattctatgacagcggggtcttgctgtgttgctcaggctggtctcgaactcctgggctcaagcagtctgggaatggtaacattttagacctggcagggaggtggtcccttgtcttgattctggctctgcttatctattcctttgacctgtcccaggcagcctggtgggcatgtgatggtccgaaggaggcccaagaatccactcagatctggtcacagggggcctagatcatgtgagattaaacttcacaaccctggttccttcctccttggcttttatgccttcctcgcacttcagagggaatggcaggaggtggaggggctgtttgcatatactctggcttgtggtatatagactttgaggtctaaaatgttacaggtttttcctcttgtgtggaaacatatggcatgtctcctaaccctatctgagcagacattttgtccaagaaagatgcttcaggtacataaaagattggtgacccttcttgaagagtttctgttctctaacctagtctatcagaagatgatctcaggaggctgggtgtaggggcgcacacctgcaatcccagaactctgggaggccgaggcaggcagattgcttgagcccaggagttcaagaccaacctgggcaacatagcgagaccccatctctacaaaaattagccaggcatggtggcacgcacctatagtcccagctactcaggaggctgaggtgggaggatcacttgagcaagagattgggaggcagagattgcagtgacccgagattgcgccactgcactccagcctgggcaacagagtgagcccttgcctcaaaaaaaaaaaaatctcatagagaagctgggagctcttggggttgataatggggtacagaaaatcttactaagttgggattaacctttgttgggtgaaggtagcagacccatgtgcaaagctctgtgtggaggaagtgatctcagctaggttcccaggagatatcagcctcccctgtagaccatgaagccctagcttcccggcatcaaaagcaagcccagctgaccctcatcccctattttcggtttccactaggatgttctgctgcttagccagttcatccggcctcatggaggcatgctgccccgaaagatcacaggcctatgccaggaagaacaccgcaagatcgaggagtgtgtgaagatggcccaccgagcaggtagaaggccctggggaccaagaggggcagagggctgcaggcactctctccccacccagctgccccatgtttcagcccctcctggaagaaaagtggatatccggagtgttaattatactcaccacccaatgccaaccttcccgctcccttgggctttccctctggccccctcagagctgcagagggagctgcaaagactatcccctcttccccgccactcaggtctattaccaaatcacaggcctcggcttcctgaaggagttgttccgaagagcaaaccccaactcaaccggtaagcaagcctgggtgtgaacaacctgagcgttctgcgctcaggaaaactagggtgcaccttggctgtctgttccattccctgccagcttaagcatccacccccatcagtccacccctgctgcagtcttcgcttcttctgttgccttctttgccaacctcagcctctttcctcccctgtagggcccttagcaaaggcgcaaggagggtagaggcctgctgattgggcattagaatgtgctaatcccccatctatgacatcacactgggtggctatggggatgtcagtactacaaattttcagtatcctagctctctccagcgctggggttattagaggacagaaggccttagaaatgggagggcctcctgggttagtgccactgaatacagctgtgcaggtcgcacactggacaacttcagggcaacatccatgtagactaggtcacaaatagtgctccccagagttgtagttaacaacctacacagcgccatgtggcagcctaggaggcccagagttcatacagagaaggagaggatggcctgcagaccttggaatcactttgtctgccttctagtctaagcaggaccctgtagagtggaagcagattcttgtctaacattcaagcagctgtcccattgcaagttcccttcttccctcctctctggcatcagcacactcacatagtcttagatctctagtatccccttgttgagagtagagccaggtctgtagaattgatttgagggggttcttctccctaccaatggccctttcctcctgtccagctggtggttcccagactggaatgaggaacatattaggttggtgcggaagtaattgcagtttttgtccttttttaatagaattgctctctgtaaggtatcaaagatgactgacgcaaagcaaacacctcagcccccagcagacctcctaggctgatccccaccagaactcaggcatggagggtagggggtgtgggatgtgggaatgcagggcttcttcctggtaccctgcctctctgtccctgggggctaagtcagagctggacctttaccaacaccatgccagcaccctggctgtgtgcccatctctacctgtgccccccacattgctagctcagccatctgccagcagctcttggggagcaggacatgctaacctcttcctatgtcccctaactatgctatggaccatttgggggttgagcccaccccctctggctttttaagagacagcagcaggcctgaggacacaatccatcctgcctcaggcctttgaagctaggccaggcgccctcccatacatccggcatcctttaacgtgacacaggattgatgatgtgtgggggctagtcggttgcaaaaggccacgctgagcgggagggggagttcaggctacgaaggaaatggattcccttgcaggggagtctcgtttaatgctgccatgcatgggcccaggctccgctggggcctggcggagccatgctttgtctgctgctgtgtcgctcctcctgctgccccttcaggagaggtaggaaggggctggtttaggaaagagacttggttcttgctagagctggggtgttcccaaagagctggctggaggccacccggcccaccccctgccagctggccgctccgtgtggcgcaggcatcaggcccaaggccagctaaagcccagcttccctctccaaggcatgggagaaagaacagctttagggcagtagctctggagaacctttccagcttttcctctgcatccccaaatctcaatgagcacccttctggggagcctgctcccataccccatctcttcatgtacccctctgaagcctgggagaggccagcaaaggggccatccctggtcccctccctttaccttactcttctgtcacctagaaccaccgaccatagaaaaagcagtcccctcacacctgtaatcccagcaatttgggaggccgaggcgggcggatcacttgaggtcaggagttcaagaccagcctggccaacatgaggaaaccacgtctctactaaaaatacaaaaattagccatgcattgtggcgggtgcctgtaatccaagctactccagaggctgaggcaggagaattgcttaaacccaggaggcggaagttgcagtgagccgagatcgcgccactgcactccagcttgggcaacagagcaagacttcgcctcaaaaaaaaaaaaaaaaaaagcagtccctataactagcctccttcacagtcatcatcctggccagggcagtgacaattccaggagacacatggaaggccctcccatccctgcccagcacacacttggagtgcaggccagcaactcccgcagcttctgtcaacacagggctggcagcagaagaccaaggtccagcggagctcagttgaactgcataaatcagcaatcattttttcacttcttttatctaagagtttttagctaaggttattgagtttttaaataaaaaagctttttctttgatggtctctagagacagctgggttgagccccaacctagaatggaggcaggggaggattcctggcctttgtcatggctgagctttcagaatgaaggatgggcctttctggacaggatccaagttttattctggacagagtaaaacccaatcctagccggcatgagccacttttctgggaactatcagggccctggccatccccaaaggaggccaaaggtccatgggcggcagccatctttccccacccccctcctatttacaggaaccttcctaggctagggctgcgcccacgggcccttaccccttgattcccatcacaggttgggtgaggggcaggggtcttataccagttatagtaccctggggagttccctgaaggttggggtagctgagtgagccaaatggggaagagcaatgggttcctccagagccttacatcagctcttctcgccccatggctgaggccagagaggaatgatctgctcttcaggcagcctcttcgccaccttttcctcagcaaacacacaccaacattgacatttacaaagatcaagggagcttgtggccctgggctgcctgaacctggccacacaggcttgcggcagcaagagcccagcccatctgtttacaggacgctcagcagttactcccaggaaaatccctgcacttcaggaaagggaaactggtgaaaggatttgcttgcccaaccgtggcctggcctgaggaggtagtgctccactctcccacgtccagcttgggcccccagccctcacaggcacctctttgttctccctccacaggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcatg

SEQ ID NO: 38695 - DNA, 37028 bp, Homo sapiens
ttttattaatatgctgatctgttttatcttctcaggccataaagaatgctgatgggagaaccattttcctaattttcaaattgttgagctgtttgccataatgggtgagttcaaactaaaagcatttttcagcaataattaaaggatagaatggaagtgaaaaaactttctctattatgtgttattataaacctttttataaataaattttatgatatagcagatttatgaaatgttttatatttacttaatagactttgaattaaagtactttttgtgttgctgtagttttagaatgatcattttatgcgtaacagcagggacattcaaaataagctgttaagatgtgttgtgatttgcttaaagtctgatggcaagagagaaatcataaaatttaattttatcattcatagagcagcaaatcattggtgctcagggagaatatgttatacaactcttggtcgtatattgtggtataatgttagtttaaagacactaaagtatgggaatggattgtgtatgttcagtttacatattttgttttcctgtttacctcctttttgttttttccttttctcctttgtgttaagggttccagcatgaggcagggaattagttagacaggaagacactagaaggaaatggagtcacgaatggcccaccctatcctaaatcaagaaaaatggtactgagtagttggatgctaaattttgaaacttagactgatcctgggatttaattctgacatttgcttgccagagtttgcctttatcacacattttctacttcttgcttaacaaaacaaatacacacacacacacacacacacacacacacacaccctcatgaagaacttatatttgcccatgtgatgaaagtgggggctaggacactttcactgtgtgtcattgtagcaagtatgtaagcttagacttcacctccctactttaaaaattgttcttccacttcctcttctgtagtcatgagtagcagtgcccccttgtagcccaaattctccactctagtcagccttactttcagctccaaattggatgtacttttactgaacttctttcaactttttattttgggtgctgtcacttgtactctatgtatcgatcaaatttatttttgtcagcctcaaataatactgctctatagtagggcaacattcattgcttaaaaacatacaaagttagtcacagaacaccatgacagatgtttgaatttttgattgaggatgttcttctgtaattatttttcaaatatcatgaataagcatataaggtatttaattcaacatttctgataaaagatttttgaaaaaattattttccaagtattttttggttttgtgctcaattcagtgtccttccaacatgtgtcagaaacccattgggccgggcgtggtggctcatgcctgtaatcccagcactttgggaggccgagtcgggtggatcacgaggtcaggagattgagaccatcctggctaacacagtgaaaccccatctctactaaaaatacaaaaaattagccaggcatggtggcgtgcgcctgtagtcccagctactcaggaggctgagccaggagaatggcgtgaacccaggaggcggatcttgtagtgagccgagatcacgccactgcactccagcctgggcgacagagcaagactctgtctcaaaaaaaaaaaaaaaaaaaacaacaaaaaaaaacccattgtacttacccataagtacgtaagtgtacttatgggtaaataagtgcccagtagtaattcttcaagcccgccaagtaaggaactcaattaaattgccctttgttttttatgtcaccttcctaatatgggaagttttgttcaactggccccaccattttttacatatataacagaaaacggtacttatttttttttccgttctcatttttcttaataaataagtaggccgggtgcagtggctcacacctgtaatcccagcactttgggaggtcgaggcaggcggatcacgaggccgggagatcgagaccaacctggctaactcggtgaaaccccatctctactaaaaatacaaaaaattagccaggcgtggtggggggtgcctgtagtcccagctactcgggaggctgaggcaggagaatggtgtgaacccgggaagtggagcttgcagtgagccgagatggcgccactgcactccatcctgggcaatagagcgagaatccatctccccttgcttcccccgtcccccccaaaaagaaagaagtatttataaatgtgataattttagccaaaggccctcccccaaggcatttattttgacattgtaatattaagcatataaaattgtttaaattcaaatgtttaggtttcttctaataaaaattagaacaacatagatagatttaagttcccactttgggaggccaaggtgggaggatcgcttgagcccaggagttcaagaccagcctgggcaacatggtgagacccccatctctacaaaaaaataaaaaaagaattagagttcatctatccctagtatagaattaaggatttaccttttttttttttttccttttgggaaacagattcatgctctgttgctcaggctggagtgcagtggtgcaatctcagctcgctgcaacctctgcctcctgggttcaagagattctcctgccttagcctcccaagtagctgggactacaggcacctgccaccatgcctggctaatttttgtatttttagtggagacggggtttcaccatatcggccagacttgtcttgaattcctgaccttatgatctgcccccctcggcctcccaaagtgttgggattacaggcttgagccattgtgcctggccaaggatttaccttcttaaagaaggtcacatcaaatgcttttattccagttgagatcattgtgagcttattgatgggtacatctattgtgattatattgtacctgactgtggcttggttacctatttggctaaactaacattatgataaaactttattttataaaaaatccttggtgaaggattataaaattttttcttaacctggaaatattaataaattaataaaccaataaaaccatggcaaccattacttttaaattttaatatgcaaataatttcactacaaaatagactatattaagtgttattaaaaattagtaaattagagaagtcagctgtttgtgtgtttgagagactattagggctactgaattgttggaatatttttagtgatttcccatacaggatatggcatgttttaatttttactactccaagaacataagttactgctcaccaaaatggttacattttaaaatgtaaagtgtaaagtctcttgattcctttatttatcatttgtgattatcattagtagaattgatttactagtgaaaataaattaagttgtccctgatgtcttctggagagcttataattggcattactggcaggcacatggttttagtctcagaaggaaatctttggtatatttataagagtctaaaagttcatgttcatgatgctttctctcagttttatggacttggtactttttctaaggaaaggaattttcttacattgttgctggccaagatctttaaatagtctgtttttagtcttgtcaaaccttatggtgaagaagtttgaaagagcatttccaaatacagtaggccagtatccacaggtgaagcttttctttgtttctgactcttaagtattgatgaaagaataaaaaaaccttccaaaattaagtctgtactttgaatataaatgctaagtaatgagatttatacaaagttgtttatttttttttccctactttttaaaacattttagataccttgatgttttgtttaggagtcatagaaaagaatttgttataacagggcagttttgaccttattctaggatattaaatcattggaagaatcagaatgacttcatcttgtccattagtgtctcatgtgtggactgatgctagagattaagtctagtgcaattttattttaccaaaagtgtaggcattaaaaatgttctagatgcatttttgcattaatacattctctacatcaaattttattttaaattttgtgtttgatgtctatacatgttgatatatatgtcacaattacaattctatgtatgtgttgtttcaaaactacctagatgatcagcaagctttgaactcaatcatgcaagatttggctgtccttcataaggccagtcgaccagcattatccttgcaggaaaccagaaaagcaaaatcttcatcaccaaaaaaacaggtatttattttaataagtatttttttatgaattactttcctttaatatcctaatcttatggaggacttgtttaatgtgttcagcttttacactttcgaatcaagaattttgttagtgtttgttacacattttcgtgtaagagtgtgtgttcatctattaacagtagcaaagacgtggaatcaacttcagtgtccatcagtggtagactggataaagaaaatgtggtacatatacaccatggaattctgtgcagccataataaataacaaaatcatgtcctttcaggaacatggatggaactggagaccattatccttagcaaactaatgcaggaacagaaaaccaaataccacatgttctcagttataagtggagggtaaataatgagaacacatggagacatagaggggagcaatagacactggggcctgcgagagggtggagggcaggaggagggagaggatcaggaaaaataactaatgggtactaggcctgatacctgagtgactaaataatctacaagcaactccccgtgacgtgagtttacctgtataagaaaactgctcatgtacccctgaacttaaaagttaaaaaaattttttttaagtttgtgttcataaagaattgtagcattctgcagccaacgttgaccccttcccagaaaaaataaggtagcatttcatttaatgtggtaactgttctccaaagctgacatttcatccatttttcaagcacttaagcaaattgtgttttgttttgttcttcaaatagtctactctggatttttagaaatgaggatgtttttgattctgataaatgaaattagttttggatactcagcatgacacataaaaatataatattctgtatttcccataacaggatcagcaaatgtctcatactcctggtaccttcactaatagatcttggtgttctttcctgttgagcccagattcagcaacataattctcaactttttagcagacactatcaattgtttggagctggtacagaacttcaaaattccctcctcgtctggtctattttaaatgaatggctaaaaaacaaaatcatttagaaattgtagaaattttatctaatctctgaatgatctgtctaatctctgaaagactgatttgtcatttcattacagaatgatgtccgagtcaaatttgaacatagaggagaaaaaaggtaaggaaggaaacattacatgttaattaattgatttaatcaaatgtgtattctaattaagcttttgaaaggttcttttcagatttgaatgaagtttcatggtttacaaattgagaatagagtagtccttgggaatgtgtaatgtgcttagacttaagatagataaaatatgtcaaaattcaggttaaatattagaaatgattaatgtctttgcaattttcagagataaataagatcactgtttaatacagcctttacatattttcacttcctttcatttttacttgggggaaattaaatatatttttccttataattgtttcatccctccagatactatatagcatttatatatgtgagcttaacatttacaattctgattattctcaagagacctcagttttatgacatttacgtcattagtaatgttgaggaaagtgaattggactagtggctgcaaattatttagcagagatgtaaacctagtcttctacttggtatctgtatctcagtgcacaaatgatagggtggtagttgacaacaaaattgctaacaagacctaataggaattaaggccgatagaattttttttttttgagatggagtcttactctgtcgcccaggctggagtgcaatggcgtgattttggctcactgcaacctccacctcccgggttcaagcaattctcctgcctcagcctcctgagtagctgggattgcaggcaacagccaccatgcctggctaattttcgtattttttagtcgagatagggtttcaccatgttggccaggctggtctcgaactcctgacctcagatgatccacccgccccggcctcccaaagtgctgggattacaggcgtgacccacgctcccagcctgatgatagaatttcatttctgctattagtgtctcatgaaattaatgtagtgaaaagcctaacagttttaaggattttaaagtggctcacaaatcatataagcatattctacatagaaatatttaaaactggaatatatcagataaaccatggaactatccaatctattttcctatttaagattcttttttggatattttcccaattttttcattcattcagcattatttgttgagtacttagtatatgctaggccctgaaggaataaagggagcaaagcagacacagtctttttccttatggggcttatagtgtggtattggtggtcttcaagctttaggtgcatgctctctaggggcagcacaggccagtctttgggaagtagaaagaaaacactagaattttaatcttgtaaaaatatttattttggaagtatgcctacatgatatatgtacccaaaaatgttgagttgataaggatacagaaatcaaaatttgaatccctggagaacaactttattctttttaacagtttcatttcattctgtcatacagatgtcacatagttaagtttaatcagtttcctgaataaacattttgcattgctctttaacattcatatggtagtttcagtgcaaattaaaaactgcagaaaattttgagaatttcctttttaaaatttgtattaggataaaacagacttcagagtttttgaactttgtgttgaaaatgtgtgcctgtgttaaaaaatgtgctgttgtagtgttaagtaaagtgaatatttacgtaatttttagttaatcttgtatcactctaaaaggaggtaacttttgcaagtttattatttaactttgcctaagaaaataaaatcttaaaattgtgtttatatagaatccttcagttccccagaccagttaaactggaagatctgagatctaaagctaaaattgcctttggacagtctatggatctacattataccaataacgaggtaaacatgtacagtttaactttagtagatcttaccttcaaaagtaatgtgttcgtttaagagactgcttttaagactcgtgtttttatttagggattgataaatatatggtatgtcagaaggataaaacaagtaaattttaactgactaaaatggatttatttcattgtggaaaataatagagggtgctactatgcaaataattgaatgagggtgtattataggggaaaatatatgtattacttggaattttgctgcttatttatggttttgtttttattctgtgtactttattggtgaactgtcttttcctctcatactctacacttggctacagatgacagagctttggtagttaaacaattgagttaaaggattattttagtgttggttagggctcaattagcttattatgtttgggaatcagtatgtatgatctgaagggcttgctctagcagtgaggagctctgcgttgtggagaaacccctttttaatgttctgtaaacttaggattggattcagtgatctctgaagtttcttttagttcttgagattctatgagatatcaggatcttgtgatcttaaaatttataggacaatttagttaataattgggttagtaattaggtgaatttgttttttatattcagaaagtatttattaatttttcaggcataatgctataagttataagttgcagcacctcatggagtatagaccttatagacttgtggtacaagcaaaccattaataaatgagttgtttgaatatacgaagttctttgaaagaaatgcataaagtaggccagacatggttgctcacgcttgtaatcccagtactttgggaggcagaggtgggcagatcacaaggtcaagagaacaagaccattctggccaagtggtaaaaccccatctctactaaaaatacaaaaattagctgagcgtggtgacgtgcacctgtagttccagctacctgggaggctgaggtaggagaatcgcttgaacccgggaggcagaggttgcaatgagctgataccgcgtcactacactccagcctggtgacagagcgagactccgtctcaaaaaaaaaaaaaaatgcataaagtattgtgttgaagaataacgggcagagcacagtggctcatgcctataatcccagcacatcgggggaggccaaggcaggaggatcacctgaggccgggagttcaagactagcctaggcaacatagccagactccatctctacaaaaaagtaaaattatctgagtgtgatggcatacacctgtagtcccagctattcgggaggctgaggcagggggatttaaggtgggaggatagcttgagcccaggaatttgagggtacagtgagctacagttgaaccactgcactccagcctgtgtgacagagctgtctgaacaaaaaagaataaatttttaaaaaatgtcttgaacttgaattattatctcataggatgattataggggagcctagacatatctttttttcttttttctaaaattgtattatggaaaactttcaaatgccaagatacattaagactacaatattgtctttatctacagcctagtaggtctatcaagaaaaatgaggttagcatgacatgatttgtccatattatacctatgtcacctcctaagaattgctggttttttttttagtgacttctcccagtttgctatgtaatttttttctggggttttcttgaggattgacatcaagctaactggtttttgtttttgttttttgtgtgagacgaggtttcactctgtcacccaggttggaatgcagtggcccgatctcacctcactgcaacctttgcctcccaggactcaagcgatcttcccacgtcagcctcctgagtagctgggaccacaggcaggcaccactgctcccggataatttttgtatttttggtagaggcggggtttcaccatgttgcccagactggtctcaaactcctgagctcagatgatccacctgccttggcctcccaaagtgctgggattacaggtatgagccaccgcgcctggcctgatctgtatttttaagaaccttttcccattttctaaaaattggaaaactgctccattttagtttatttttctcatgctttctgaaggatttctgtgagtggttctaccattatattttggtggcctcttggcaggaatgtggtaggggtggcattaggataagattacatttaagatttcttgcaaccctgagattctgtgagtgaaccgtatcctgtttcatatcttgacatattgtcccaaaccaaatgcatgatcttggacactgggggtactaaagaaagtcttactagttttgtggacatgtggtcaggcaaaaaattcatttatactgcatgttattccacttctataaatatttttctagtgtaatattaattcctctgttcaaaatgaactgttactctataaacttctagttggctagaattgaaacgttaaggaaatttaagctggaaatataagctgaggttgtttggatttgttagtttggcttctctttaataaggggtgtgtgtgtgtgtgtgtgtgtgtgtgttatgagggttggttgtggaggtgttcagggtgcatgtgtgtgtgtgtcatgggggttggatgtggaggtgttcaagccaagtaaggattttctaagatcacttccattttagatgagtagagcaggaattttttttttttttttttgagacagcatctcccgctgtcacccaggctgtagtacagaggcacagtcatggcttactggagccttgacctccctggctcaatcaatcctctccccactcagccttctaagtagctgggactacaggcatgcactaccataccttgttaatttttgtattttttctagagatgtggtttcaccatgttgcccaggctggtctcaaactccagggctcaagcgacccgcatacctcagcctcccaaagtgctgagattacaggtgtgagccactgcgtccagcctggagaaccttttaatggctgtcttcatacttcactatgtaaattcaggaagataattcagttctttcagatttcagttctgtttaatggttctcgaactcaattttaagtttcctttctagaaagcatttatatcaacaaacaactgatttatcaaaaataagccagagggtgatagatttcatgaatgagactgaaatgaattcaccaagccagaaaacattatctgatttatttagtgtaatgtagataacctgggacttgttcatgactcttagtcctcattttacggtttgtaataggtaaccttagaacacaggcaggatcacattaggtctgtaggcaagtgcctaagctgctgcaccaggcacccctccaggatgttcacattttacagcagcaaactgaagagcagcagaatcatttatgttcatatttttttctgtcatttgacttagtgttgttttcccccaaaagtagcagtatcttggagaagtaaacaatccagttataaatgaataataaaagtaagtattcagattttcccctcaaatgaaaaatcggcggaacagtcattaccattgctttaaaatgttttccagtgcttgaaaagtaatagactattgaagatagaagcaagatataccaatatgtttcataattggtgggaaatagaaatgtgtttaagtagatcagtagatcaggcttgttctatgataccaaacagttaataattgtattttattagaaaaaaattctcatagagcgaaaagagcccagttagtcggtcccttacagtaatacaaaattagctacaaacagaaattgggaatatattttaacaacagagtaagtaaatgcaagcagattgtctgatggaattcacataaatccttctttatattcgtgtttggcagcctttcttataacaaggacttttttggctgggcatggtggctcacgcctgtaatcccagcactttggaaggcccaggcgggcagataatttgaggtcaggagtttgagaccagcctggtcaacatgttgaaaccctgtctctgctaaaaatacaaaaattagccacgcgtggtggtgcatgcctgtaaacccagctactggggaggctgaggcaggagaatcacttgaaaccaggaggcagattgcagtgagctgagattgccactgtactccagcctgaatgacagtgagactccatttcaaaacaaaaaatcaaaaaccccaaggacttttttcacaaagaagtctgcagaatgaacatacaccatgccagctagtgggtttgggttcagattgagcttttaacactgtgagatttattagacagcatttaccaggttgtctgctctttgctcattgctggtgtagggggtccttgtcttcaaagaatttatactgtagagaccccaaattaattcagccttgcattttaatggctcatatattgtgctgagtagagcaggttaactagtgcagaatatgttcacttgtttttattctgttcctccttcaatgaaatggaatatactttgaagttattgacagagtcttcttaagttactaaattgactttttttttaaaaaaaggacatatttttatttcttaaattgtatgaattacactttttctcatagacctcttaggtgcttttgtcctctataacatctgctgcatgagaagactagtgaaagcagattccacatgcagggtttactatggaatagttaactcattagcttatttgttttagggtatagtggtcaggtcactaggctcagagagaagaactctaggtgggctgtagattgcagatatgttactagtggtacccctccatggcagctgtcctccatggcaggtgctcaggatgttggtatgttgaagagcacaccagctgagagtgcaaatttgtggttactattgaaaaaagaactgagtttcatctatacagaagaaaagtagtacctttatttcatatggtctttgtctgtacttcttcattctttttaggggcgaacatactataacttaaatttagcaatattatggaaatatcctagaaaattaatctttaaatgttattttctagaagaatgtaatgattaataaagaaaaatttaaaaacatacatgttcattctaagattttagtggcggtagaatgaggagggcaaaacaatatacacatacacattcagactttcatcatagtaacaaatcaaagagcaaggtattttgacatttgtaattccttagtagtggagatgctcatggaagaacttgacctggtgagatagctgcatggttccttatgtttgtttttagttggtaattccattaactactcaagatgacttggacaaagctgtggaactgctggatcgtagtattcatatgaagagcctcaagatattacttgtaataaatggaagtacacaggtatgatttgggatatttttttcagtaagaattataggacttaggcttgtaaaagttaacatatgaaacataattatattctataatcattgcaatattttcattatgattaaatgtaaacttacatcctttaattactatactttaatatccttactcctcaaaaaccacagtcatagttataaataagtataatatgttgtacatacgaagctaatagaaactgacaacttagaattatgttagaattaaaatttcaaagagtagaggatttgattaaggctcacaaacaatataaaatgttttgtacttggtaggggagaggattctgtttaaagccccaaggaggaagaatagcattaactgtcttttctcctttgtaggctactaatttagaaccattgccatcactagaagatttggataatacagtatttggagcagagaggaaaaaacggctatctataataggtaagaaactagtgtctgaattatgaaatgaatgatttctcaatttcttctccatcctttaatgtagtgtggcacctaaacatattcctgataaataatattttatttctctacttcctataatttaatttaaatacactctaatatttgacgtcccttggaaattcaagtttacaggattagtaatctccaatttaaattctttatttatatactcagggtattttaatgttaacaaattcaaataaaactttaaagaggttttaggctgggcgcggtagctcatgcctgtaatcccagcactttgggaggccaaggcgggcagatcacaaggtcaagagatcgagaccatcctagccaacatggtgaaaccccatctctactaaaattacaaaaattagctgggcgtggtggtgcatgcctgtagtcccagctactcaggaggctgaggcaagaggattgcttgaacccgggaggcggaggttgcagtgagccgagattgtgccactgcactccagcctggcgacaaagcaagactccatctcaaaaaaaaaggttttaattgtacaaatagaatggaggaaaaaaattaaaagaagtaattataatgtattaaaattaatagagtgtaaattcacaagcctttctctagggttttagtgattgccaagaatgctctcaaaataaagatactaagaatttttatattatgctttattattactttattagtattcattttcatttgccattaatttattgttataattaagattatgatataaagaaataaagatcttgcatgctgtagtttaaggaggctttattcgtgcaacatgagtttgacacaggtactctcaactccccattctgtctgttcttcaatttgtataaaacattgataatctacatttttatttgataaaagcattaacattgtttcaaaaaaccgctggtataaatgttctttgagagagggcagtgagtatggccattaaagatggcatgaaaacatgtatgaggggcggatttaaaagagaaaagttaaagaggaggaaaaacaaatgtggttgggaatctaaaaaagattggtaacagaagaggattgttgataatcaaagaaaaaattgaattggcatgtggaccatcaaaaaaatagacattattcatgttctcttttggtccccagaagaagctattttatgaccattctcttcgaagtgtctgtcttaaataagtcctactttgggtttcaggaatgcagaaatgcgagcagcagaggtgatacacaagcaaaatacaaatggcttgtcttttgcattcagatatatttcgatatagttttaaaatttggtgaaagaacatttgaaacacccaaattcaaattccagctctctgatgaacctgagaccagtaaatgtgtcttcatctttaaatcatgggattgttgtagcattaaattgagagaacacttgtacattttacttttcaaactagaaagcttattgtacatttatacattttgtacattgtacaaagctcagatgttcattgtacatttctttctttatccccatttcttatcacattacggtacttgtcattttttaaaaaattgctaattcactttattttatttattttttgagacagagtctcactccgtcacccaggctggagtacagtggcgcggtctcagctaactgtaaccgctgcctcctgggttcaagtgattctcctgcctcagcctcctgaataactgagattacaggcgcccgccaccatgcctggctaatttttatatttttagtagagatggggtttcagcctgttagccagattggtctcgaactcctgacctcatgtgatccacccaccttggcctcccagagtgctgggattacaggcgtgagccacagtgcccagctctaattcactttagttgcattagacaaaacaagctaaatgtactagttaaattgacattttaaatatattttgaattaaaattacactgaatacctcagtcttattctaataaatattcttgtttgacgtcagtgccagcataagaagaaattggaaatcataaagtatagaattagtggtcttttattggcactgctttaaacttggaatggctttgctagatatgaccattatctatttttcttatatgttggcagttattctttttaattgtttttataaaagggagatggaggaaaaactcctttaggttaggagtgtatgctgataaacaggtctcaaccaagagtgcgttggcatacgcattactgtgaaaaagggttgtcaaataaggagacaaaattttcatagcttttttttttttttggtcctatctccttttagtaattgactatattgatcttttgtaagcacgggtatatggaaggaataaaaatattagggaccagtattattgtggctacagttgttatgaagcctaaatcaatcctgactcaaattgagctcctaatcattttacagacaagtgtagacagtactctcttttatgcacatgtcttggtaataattttgctttctttttcctccctgtctcactaacaaatgcttgcatatactcacaatgactcctttacataaggctaaaatgttttttgctttaaattggaccagaacttaaatgctcacatagtttaatttcaaaaaactatgaggaaaggtgagacactgtactaataaatatagcatcatttccacagaaccaagtaaaatagagtgggttattgtctcataagaaatgtgattacttaaataaactgtcttaatgccagaaatctatattgtattatcatcctatcagcagtcagaataccatcctacctagtgagtataaatgaatattatggtgaggttaataattatgatagggtgggaatttacaaaggttataaagccatttgaagatttacaaatgaatgttctgataagttttaataaaaattgaattttcttttgctgaaattattaatgatataattcagaaatatagcctatttaaaacaaaacttgattcccttgcctataattataaattacattatttttcttccttgaggtcctactagtagagatagaagttctcctcccccaggttacattccagatgaattacaccaggttgcccggaatgggtcattcactagtatcaacagtgaaggagagttcattccagagagcatggaccaagtaagcaaaagtttgattttttaaatttaatttaaagagatgttgtcagggtcagtgtgatttggcacgtaactgggtgtgtgtgtgtattatctcttctctaattacatatcttcttaactgaacaaaatagaaaaaatataggaaaatgcccattaatttacatgtgcctgtataaagaaagctggaatacagctggttttatattgctcaataagtgaatgaatgagagtgagtgaatgataatgcatttgctttgtaatttaacagccagattttttttttaaacatttgaaagatagaatgaaactacaaatatttacctttgtgaaactgaggtttgtgaactttctgaaacatttaaaaaatacttcaattttatagtattaaaatgttttcatggagttgctgttattcccttaacattgcattgcatcgcattatatgttcacactattatagtagtttacattttctaataatgtaatagtcatagtgtcattagtctcagtttgggtggggccattgttcagttttcagtaagcaaaatagtgtgaaatattgtagcttttaattatttagtcaatagtctatagagaaagaatatttttctcttaggaaattttgaagtcgtggcttgcttacaagggacatttgaaaatgagtaactctggagagtgaccactattgagtatggaattgttctaaaattgtgagtgagggttgcacaactctcagtattctaaaagccttgacttgtatactttaaatgggtgaattttatgttacatgaagtatgtctaattaaggcaggtttttttaataagcaacttttggttatatcaaattgaatcatggtggaactcctttttttcctagatgctggatccattatctttaagcagccctgaaaattctggctcaggaagttgtccatcacttgatagtcctttggatgggtaatgtttatcgtagtttttggagggtttatttgtttatttgagacagagttttgctgtcacccaggctggagcgcagtggcgtgaatgcggcttactgcagccttgacctccttggctccatcagtcctcccacctctgacccccgaggaactaggaccaaaggcatttgctattaataccacatctggctattttgtttgtattatttgtagagatgggggtctcactttgttacccaggctgatcttgaactcctgggctcaagcgaacctcctgccttggtctcctaaagcgctgggattacacacatgagccaccatgctcagcttactgtagttttcttttttaatagatatgagtaaatattcatacagatagaatgttgaattatcagtaacttttttgtgctacattcagaggaatagaattggtacttgtgtatgatgacggcagatgaatttttgcacagtgtggataaatccctttacctcatgggactcagtatctttgttagttaaaaggaaatctgattataatagtttgagtattcctgcttgtcaaaattgtgtgtttgaaggcaaatcaaatttagaatttatgtacatttacttttaaaactgtgtttatgaaaagtgctatcaacttttacattaatatgtttggttttggaaatttcctgagttatttcacctgttcaggattatgttcattctggcaccagattagaaataatttaaattcttggaaattgtagcccactgtgtcacattggtacatgtaggcaaaaatttaagtacttttgtgaaaaagctgttcaggaatatgagcaggataaagttgcaaaatgtgaattttttgttacacgtgctccccctcctggtctcaataggacagtattcttggtaatcctctctggaattgctttatgaaagcaaattctgaaaaaaataactaatattgcgtgggaatgcacatttaagtttcttttatccatgtatatgaaatttctgtctgtgtcaatgtctatcttaaggtagacatttaagaaattcagggaagtagtaacgagaaagctatatatttgagtacttaccatttgcaaaacactatcctggataccttacttatgtacacttgaatagttggaaattatcttttttgttgatgcagaagggtgatttgccaaggttacatagttaagtggcagagcttggattgaaacacagtgcttagaaacacctaatgattccaaaatacgtcattcttccactgtactgtaaggttaattttaagtcatgctctttgcctacatgtaccaagtaagtgtagtttttcttttttaggtatgctaacctttcaaagtgagctcctttacacaaacacatacagagaggcacagatagatatagatattgctcaaagattttctttttaatgtcttacgttctttctgtaaacttaatgtgatgttttttctttatagagagagctatccaaaatcacgaatgcctagggctcagagctacccagataatcatcaggaattttcaggttagactttataaattctaaatgtttaaatgtttatgtcattggataatgttttggctgggagggagaggggggatttttgaaaagtcaaataaagatttataaatgtgcttttcatcattagaaatatttaacttttttttttaaataaaagataaccatcttatatgtcttaacagactatgataaccctatctttgagaaatttggaaaaggaggaacatatccaagaaggtatcatgtttcatatcatcatcaagagtataatgatggtaagtttctagcaattagaccacaagaatagttaaaaaatctcaacaacaaaaataaatacaaaaattttttaaaacctcatatttgtgttaataccattagaaaaatatgaggaattgtgttataacaaaagtataatgggcattttggctttatgacaacttataagacttggttatcccttaaaagaaaatgaataattttttgttttaagagacaaggttttgttgcccaggcgggagtgctgtggcatgatcttagctcactgtaactttaaattcctgggctcaagtgatcttcctgccttggcttcctgagttcaggtgtgtgccattacaggcatttgccatcacacccagctaattaaaaaattttttttgtagagacagtgtcccaccatgttgcccaggctggtcttgaagtcttgggctcaagcggtcctcctgcctcagcctcccaaagtgctgggattacaggtgtgagccactgcacttggccaagaaggagtaattttctttctttcttttttttttttcccctgagacagagtctcactctgttctgtcacccaggctggagtgcagtggcatgatctctgctcactgcaccctccacctcctgggttcaagcgattctcacctggctaatttttgtatttttagtagagatggggttttgccatgttggccaggctggtctcaaaactcctgatctccagtgatccacttgccttggcctcccaaagtgctaggattacaggcgtgagccaccgtgcccggcctaatttttgtatttttagtagagatggggttttgccatgttgcccaggctggtctcgaactcctgggctcaagtgatctgcctgccttggcctcccaaagtgctgggattacaggcatgagccactgcacccatccaaaaggagtaacttttaaatgatattagaaaattactctttgatgatgagattgatacttacatcatccctttaagaaaaaaaattactggccaggtgcggtggctcatgcctgtaatcccagcactttgggaggccgaggcgggtggatcacctgaggtcaggagtatgagaccagcctggccaacgtgatgaaaccccgtctctactaaaaatacaaaaaattagctgggcatggtggtgggcgcctgtaatcccagctacttgggaggctgagacaggagaatcgcttgaaccctggaggcggaggttgcagtgagccgagattgtaccactgcactccagcctgggcaacaagagtgaaactccatctcaaaaagaaaagaaaaaaattactacctgtgaacttctgcatctttgttttagattttaaaatcattattggaaatgagagtaaatttttttcctcctttttatccagaagtgaggaggttcctttttaagatgtgtgtgtgtatgtttctgtgtgcacactcatacatgttttatcataagagattatttgaatttgtattcagatcctgtttattttttcccacccaatcattcctatttgagtttcttagcctagtcacaggacaaatttctattctctacattacaaattttaaatactttaaaagtataacatattaataaaaggtataaggtcattctcttttcattttttaggtcgtaaaacttttccaagagctagaaggacccaggggaccagcttacggtctcctgtgagtttcagtcctactgatcattccttaagcactagtagtggaagcagtatctttaccccagagtatgatgatagtcgaataagaagaaggggaagtgacatagacaatcctactttgaccgtaatggacatcagcccacccagccgttgtaagtaatagaacttggtatagtgaaatgtagagcagaatctttgcagaattttatattattaaaaggaataaatactaagtgagtttttggggtcagatgaactactcaaaaaaggtaataatggtgtttctaaaggtggttggaatgtcaggtataagcatggtatcactgctaattactttagataattctgttcttcacttgtattaggaaaattattaccaactagtcattctttatccatgcattccacatatccttgttgaatgcctaccactgagatttcaaacataatctccaagacataatctaatgggatagatgatacatggagaaataattattgtatagcatttaaatgtgagtagaaatcaccagctgaggagataatgtgcaagaggccataacatcatctaaaaatggggaatagttcaatttttggctgatgtgggagtatcttacttgaaatagtgggaataggcctacagtggtaactcaggctggattgcaaagcattcagaccttactgtgtaagcagtgcatacaaagattcatgttcaaagatgtttattgcagcactatttgcatactctgaattcctttttgtgtgctagtgtgtcatagtttacttttatatccatattgaccccatgctatattgctgttatttttgctttagacagctatcttttgaagtgattaaaaataagagaaaaatgtcttttatatatatcttcagtctattcatttttatagatctttgtatatatccaaaatctgtataaacaaagacagatccaagatctattgggtatcaaattccttctgcctgaaaaactgcattttaacctttcttgtaatataggcatgctggtactgagttcattctgcttttgtttgtttgaaaaaagtctatttctccttcatttttgaaacaggatctcactctgtcactcaggctgtggtgcaatctcaactcattgcaacctctgccttctgggctcaagcaatcctcccacttcaaactcccaagtatctggcactacaggcatgcaccaccatgcccagataatttttgtattttttgtagagagtgggttttgctgtgttgcccaggctggtcttgaactcttgggcttaagctgattcacctgcctcaacctcccaaagtgctgggattacaggtgtgagccactgcacctggcctttctagcactttaaagctattgtcccattgtcttctggcttatatacttcctgaagagaaatctgctataattcttatctttgttcctccatatgtaatatgctttcttcccccacagctgccccagctgctttcaagattttgtctttgattttctacagtgtgaatatgacgtgtctaggtatatttgtgtagggttcccagctggtgttctttcagtttattatatttatagtttgtctgtgaaaagttctcagttgttacctctccaagtattttttctgtctcattcttcctttttcttttgggattcctattacctatacactagactatttgatactgtctcatacctctgttgtctctctctctccctccctctccctttctccctgtctccctctctcccccaccattgatctattttcaggttcactgattctttcctcagccttgttgcatctatttatgatcctgttgaaggaattcttaacttctgtcattgtttttcatttcatgcattttcatgtgactcattcctgtagtttccatcgctctgttcaccatctgttcatgcatgttgtctaccttttccattagaacctttaacatgttagtcatagttattttaaatttcccttctgaacctcctgagtctggttgtattaattgctttctcttttgattttttttggaagggttgcttttttgtgtcttatcattttacattgaatgccagatatcatgtataggataagggaggaggtaaatagaatgtatgcctggaaataggcacagctcttcttctgctaggccgttactgtgaggagctaagtcaatcagtctagttaggagttgagctgggtttggattttgttgttgtcatggtctctgtgcaccactgactttaaattcttctaattaccttgtgctggtttcctaaagggattttctcaatggtcctgctccatcagcttttttttttttttttaatttgagatggagtttcactcttgttgcccaggttggagtgcagtggcgcgatctcagctcaccgcaacctccccttcccgggttcaagcgattctcccgcatcagcctcccgagtagctgggattgcgggcatctgccaccacacctggctatttttctttttcttttttttttttttttttttttttttttgtatttttagtagagatggggtttcaccacattggccaggctggtcttgaactcctgacctcaggtgatctgtccgcctcggcctcccaaagtgctgggattacaggtgagccactgcgcccagccttggcctttcttttgtgcctacttctcagagagggaggatctctccatggccttgtcatgctctcagtaagtggattgctgttacttgccagcctaggagaggggaggcagactagagggttctgtgttgtcctatccagcttcagtcttaggcaggctttatctcctcagttctcagagatgggcttgcccaccttccgggagtaggagtgctctaatgatcagggtcacagaaggtttccagcctcagcctctctctcaggggtagggtttttttttttttttttttcttttgcattcccctagcctcagtgggtctttaactgtaatgcaggggtgacagggtttgctgctttctccagcggctgaaggctctcgtttcttaggggaaaagggtttggaaggactttctgcgtttcccacaacagtgggccattccccttttccaggccttgaccaccaagggaggctttccctggtgtctcctgctcctatgagtgcatggtagaggtccacagaaaagacttagagcaggtgtgagctcacctgtgtctagatctcccaagggttcaatactctcatgccagcccacatttgtttaaaatggaggtgaattcttccttgcttgtgtgggtctttgtctgtgctttgccacaagtgagccagtgcttctgttctgtctctccttggaggtaccactttttccttagatttcaggttagttggttgccctgcaatcttagttttttgatatgtgttcaacaaaagttaaattttgtagattacccagatttctcttgttgtttggatgggaatgatactctttccagctttctacattgtaggtggaggctgaaaaactaagtacaaatattactgcagtgaagaatagaaatggtgcatcttacagtctttggaatgttagattgagtgaaagaaagatgctgtcacatgtgtaattaggaaaacaatttcagaaaaaaatgagtcttgggatatgaatctctttttgatttaggatttgtagaaaattgacgaaagagaaaaatttgaaagacggtaactgtgaatttggataatcataatttttccttatatccaagtacattcaatgaaggatgtcactaatgcagtatgctcatttagttattaaccatttatttgtgtgctgtttgatatttcactttaagaaagtgttctttttcagcacctcgagctccgaccaactggagattgggcaaactgcttggccaaggagcctttggaagggtctacctctgttatgatgttgatacaggaagagaattggctgttaagcaagttcaatttgaccccgatagtcctgagaccagcaaggtaaaaatcactgcacaaattactttgtcacattataagaaactttattcattattattttttaacattaagccccttccattctaaataagaagcattttttttcaaaaaaaaaaaaaagcagttttctttagtataaattatttgtaaaacagattagatatgtttgtctattttttaatatggatttttcttttttagtacttcagttataatcctaatctgagtcagtgttgctttagcatatcatcaaggactgtttaaaaagttattggttagagactttcagatgtttattacttgggaactaaaattttcagaatgaaatcaccttgatggtccatgaagttagaattttttgcttttactgacattgttgaagacttaacaatgaattctctctttcaggaagtaaatgcacttgagtgtgaaattcagttgctgaaaaacttgctacatgagcgaattgttcagtattatggctgtttgagggatccccaggaaaaaacactttccatatttatggaatatatgccaggggtaagttagtacatctttttgaaaatacacattctatttaaaattttagttaataaaagaaaaacaacaaaaacgtagattataaaatgttaaccctagttaaggacattttggaagagttttaaattagagctgagtagtattttctatcctcttcctctgtctttgtattttttaactcattaatgataaaagtattctcaagtaggttacagacatcttagcagcccatcttcagatttccttaaatgccctaaaatgccctttatagctgatatattcacaccaagttccagtctatacatacatttaattgttatgccccttaattatctctctcttcttaaacaattttttataattcttaaaaagaagtagagacaaggtctcactctgttacctaggctggtttcaaactcctgagcccaagtgattcttctgccttagcctcccaaagtgctaggattactatctagagcagtcaatttgtacatgatatagatttgacaaagagaagaggatagcctgttaagagtcttcactctcaggatctggaagaatttgaaaaaaaaaaaaaaaaattctcatggatttctctagtagcattcttgtggattttgtttttttgttttaaattttttataattttagttatatggaatgctttacaaatttgcgtgtcatccttgcacaggggccgtgctaatcttctctgtatcgttctaattttagtatatgtgctgccgaaatgagcatgcggattttaatttgtttctttatcccttttttactataaactccaagttagatctgaggtctaaattagattcacattcagccttttttatctgatacgtcatagatgaagctgtgtactttatgttgcatcctatcaggagccaatttctggttattccactgtagcaatgcaaagagctaccattagatgaggatgattgacatattgagtcctgcattgtaaagttttgttttttcctgcacaccagaaagtaatatgaggtatagcagtggcacataggaatagcctgttccttttcagccatccacctaatgtttttagcactgattgatagtcatcactagagtctataatttcattaggagttataaaatgtgatttgtgacatctgtcattatatagagtacatctagtattaatgattttcaaggtggtgattaatatgtttacttatttaaaaatacatgcatttccataatttttatttgtttaattttgagatggagtttcgctcttgttgcccaggctgagcaatggcacgatctcagctcactgcaacctccgtctcctgggttcaagcaattctcctgcctcagcctcccgtgtagctgggattacaggtgcatgccaccacacccagctaattcttgtatttttagtagagacgaggtttcaccatgttggccaggctggtctcaaactcctgacctcaggtgatcccgcctgcctcgacctcccaatgtcgtgggattgcaggcatgagccattgctcctggctacaatttttattttttgagaaggagtcttgttttgttgcctagactggagtgcagtggtgcgatctcggctcactgcaacttccacctcctgaattaaatcaattctcctgcctcagcctcctgagtagctaggttacaggcacctgccaccatgcccagctaattttttatatttttagtagagacggggttggctaggctggtctcgaactcctgacctcaggtgatctgcccgcctcagcctcccaaagtgatggtattacaagcgtgagccaccacgcccagccgatgcctggctaattcttgtatttttagtagagatggggtttcaccctgttggccaggctggtcttgaactcctgacctcaggtgatctgccttcctcactcagcctcccaaagtgctgggattacaggtgtgagccactgtgcctggcctattctgtataatactacaagtagagacacagtagactgaacaaacaagccgtgctgaactgtaggtgtgagtagttgactggccacacttgccgctttccatatgtgtgtttgcaaatttgggtccacagaattgcaaaatgctctccctccaaggatggctcataaacagtggaaaggacaaatggttaaatctgtaaaatccaaggatttactttcatatgacagagtacaccgtttaccaaaattcaaggaaaagcagaaacatttggatgtattttcctgtcaaaaaagagatttgtccctcaggaagcattttatttctgtcttttaaagggattattaatcaaacttatacattggaatcactagggaagttttcaaaattcaaatacctattcctcacttcagactgattcagctttctcagagatggcaccttatcctgccctaaaaaacacttaagaaaatctattctccttttgtgtatgttctcatgtttcgaacttgagtgttgagtatataaagaaaaaaactttaaaatctctgtgttctttctagttacacccattcctttttctgagaaaatcagcagatgtcaataaaatactttaaaaacagaataagaacaaaataagtaaaattcaagtaggacatgcttagacgagtgagatgagaattcctgccctctttactgataaagatttaatagcagttttcatttcaaaccatatacagtagtttttatttttgttttcttttctcctagggttcaattaaggaccaattaaaagcatatggcgctcttactgagaatgtgactaggaaatacacccgtcagattctggagggtgtccattatttgcacagtaatatgattgtccatagagatatcaaaggtaagtaatgaggtattttctattttaagtacacagttcttagtgaatgtgaatgaaacaagtgatgtgggtaagacatttaacattaattcatctgtctctgaaatactacagggaaacagttctcttgctttcttatggactctgtcagtgttctatcacaccagtcctgtctccacaaatgggtagctctactgtgggggctcacagaaccagtaaagtttaagagaccatacaagtgagatcatgttttcatacatattgcataggtattaggatagattggctaagagtaggatccctgctgccagatggcctgattcaaatttgggcttttatccacaccgtgtggccttggacaagttactcagtctctcagttcctcattcttaaatgatggagataatagtatccagctcataggattcttgtaaggagtaaatgagttaatgcatgcaatatgctttaatttaaactcggaggaatgggtgtcactaccgagggaaagaatgaagagaagcgaagaaaagagccccaaactgagctttgatgaaccccaactatgtcaaactgactttaaaactcaaaaactcagctgtttgcagggataaaggatgtaggtaaatgcataaagtcacacaaaagcaagtggtggggataggtgcaatttaagaatgcttcaaaatctatactacaaaacatacctggaggtttagtcctgtaaaggtaggttgtggccccaaatttagacatcactttataaatcaatcaataaaaataatgaatagcagcatgatggtgcatgactgtagtcccagctacctgggaggctgaggcaggaggatcgcttgaacccaggagttcaagtccagcctgggtaatgtagcgagaccccatctgttaataaataaacagtcatgtgccacataatgatgattccacgtcattatggaccacatttacaacagtggctatactatatagactaggtgtgtagtaggctataccatttaggtttgtgtaaatacactctatgatgtttgcataatgacaaaattgcctaaaaatgcatttttcagaatgcatctccatcattaagcaatgtattactgtaaatgtgtatgtgtacacgtttgtatttgcatgtataaagatattactcattggtcttgctggggactcttacgagctcccaggctttcacttcccctttgaggtgtggcacgtcctaattatggccatattcagaccaacaagaacattcctaaccagttcctggtgatagagtagaatgcagaatgcctaagccagatcacctgtactagagtgggacttagagtaagtctgaaaagatggggacattgctcatgatctacgcatcttaggcagacctcccttgttaagtacgaaacctgatagcttgaagaacctcatagagaagttattcagttaggaataatgtccattcaagccagcttctcgttagccctcataatgaggcaaggcaaaggaactgagggagctacccgccgagtggatcttcttcaaactttgccagaagtgatgagccatcctggtcaaaagagaaggctggaagtaagctgattttaaagcatagggcaaatatattgataagagaataaatgtaaaatataaaattggatgtgcaatatgatcttaagtttgtaaaattcaagtatgacctagaaggaaaatttccatatgattgatggtggttatcatcaagtggcaggatgagtgatggtcgtttttattttttttttttttaagagagattcactcttgttgcccagggctggagtgcaatggggagatctcggctcaccacaacctccgcccccaccctgggttcaagtgattctcctgcctcatcttccctaggagctgggactaccagcatgtgccatcacacccggctaattttgtatttttagtagagacggggtttctccatgttggtcaggctggtctcgaactcgcaacctcaggtgatccacctgcctcggcctctcaaagcgctgggattacaggcgtgagctaccgtgcccggcctttgtttgtttttttattttgagtcagggtcaccctctgtcacccaggctagagtacagtggtgctgtcatggctcactgaagcctcaacctcttgagctcaagcagtcctttcacctcagcctcctgagtagctgagactacaggcacacaccaccatgcccagttaattaaatttttttttgtagagatagggtattgctatgttgccaagctcctatatactttttctgtatttctcaaatttccatgagcaacttttaaatcgtaagagaaaaggaagatagttgattggttttcaatttagacccgtgaagtcataatgaaacctaggatgaaaattaattgattatattgctagggaaccaactcattatttcaagaactagttgctcttctgcctttgtttttgttccgtttgttttacaaactagaccactgaagatgaaattaatggatgaaaggaaacttatcttcatagaagtattttggctaacaagcggagaaagaataatgaacagatattgcattaaacattaatagctgctgatatcacttaaatagagactgtctagaatacagcatcatctatctagttttgttcctcagtcccccagaaattgaacctgaatctgatcacgcctccaaattcggttacagaattatgtaatatacatataggacagatgagcatgttaaaatgattctttgggacgcagtcagcaaaatctagaccatgagaaagctataggcaaacaacttagtttcttcataagttgcaaagaaaaaagaaaaggagattggagggaactttaggaaagacttagaagatttatcagtgactcccaatgtatggacttcatttggattctagttttttttaatgtaacaaattgaacaccgactatatatttgataatattaacaatttattgttcatcctcttgggtgtgataagagtccttatctttgaaagatatgtactgaaccatttgttgatcatgacatcttgaatttgcttcaaatcctagagaggggagggggagtggttggcagtatggctggggcaggattgtccagatggatgttgaggctgggtgatggctgcgcatgctgctctacctttgtgtatgtctgaaaagtctccttaataacttatttttaacatgtccaaaataagtttttagaaacttctgttggagcctggctacccgttttctcctccgcccttcttgtggataagcattggttcaatattggtgattccgccccagagacagcttcccctgtctgtgacctgccttggactgttccttcccctatcagagccctgcttgtagccagtaaaaaatgggctttgttgtccttccactggttaagtattctagagacggtggcttttttgacattccttcttaaagtactggatggtaggaaatgttagacagtgctctttcagaagatcactaatgtcatggcatgtttacacttaaggtgtgcagagaatggaccctggactctcctctggagagaggctttagggaaccatcattgactagactggggaatttgctggtagaacagaaagacaggtacagaagccccgtgataggggtggggtctctttatcctctccagtctgtaaggtagcttttctccactattcagtctccttcttagagaccgttttttaagaaaagggtaagagaaccaagaaaatgaatctttgtaatataaaatatggttaaggttatggaagagttaaaaataagaattgaagtaaaattttaaaattagataataaaataaatggcttatttaagaataggtaaagaaaaagttaaaaatgagaaggtccaaagtaatgagggctatgtggaaaaaaatgagaagagaaatgatttataaaagacggaaactagatttataatcccagaaaaaatagagtttttaaaatgataagagtgaaaatagagaataaaaaacaagtgagcctagtgcccaagcttggttttttgtttttgtttttttgagacagggtctcactttatcacccaggcgggagtgcagtggcatgatctcagttcaccgcagccttggccctctgggcttaagcgatccttcagcctcagcccccaagtagctgggactgcaggcacatgctaccatgcccagctaatttttttgtatttttttgtagagatggtgtctcaccacgttgcctaggctggccttgaattcctgagctcaagcgatccacccacctttgcctcccaaagtgctaggagtacaggtgtgtgccactgcacctggccaatatcttgtttttttaataccattctccactaaaaggaaccaggcctccttgagaaatggctgattctagcactggtgcaggaaatatacaagatgagcctggagcatcttcaaatgccagaaagcaagaaagtgctccaaaacaaaagccaaggatacaatgatgggggtatggcaaagggacacagagtcagtggaaagaactccagtggctgaaactgataaatagcaggcaaataaagtagtactggattataacccagtgtataaaacaaatatccatgttcatagtgatgcaaatgaatgatttaataaatatgtgggagaggggagacaaatctcttctgcagcataactccaaataatttatgtagctactcagcctggagcataactctttactccttaattgtgggctgtgcgtggcgaatttcttccaaagtacggaaagggtgggggagaatgactttacagtggagaacctgacaaacactatcttaagccaggtgatcaaggtcagcatcaacaatgatgttgacactatgtgcctttaatatcgtatgatgagaatggcagtttagctgcggtcttcctccaaaaaacttacaacccccgttatgagaacatgagacaaatcctaattgaggggcattctacaaaaacctgaccccagtactcctcagaaatgtcatggtcatcaaaaacaaggaaaatttgagaaagtatcccacctaagaggagcctcaggggacacgatgactaaatatggtgtgggatcctggttaggatcctggatccagaaaaatgatattagggaaaaactgaggaaatctaagcaaagtatgaacttggttaataatatttcagtattggtttattaattgtggcaaatgtaccatactaagatattagtaatagagaagctgggtgtgggggtatatgggaactctctatactgtctttgcaataattctgtaaatctgaagctatctaaaaagtttattataaaagctaatgaaattttaaatgaaaagctcaaagcctgcctatgagacatttaaaatattagaaattgggaagtaaaattaatataaagcaagattcaatattaagaaaactctaaaatgtaaggtaactaaatttaagtaatagagggggaaaatgcttttgttctgaaggtccctaaggaagtttctgagaaaaggctgacttctcagggaaataagcttcatccatgggcttcttgctttatgatagagaaactgggggctttcttggtccttcactgagcttcattcttagcccttttcccctttctcctcctcttcacccccacctccaacctgcaccagtccttttcaatagaaacgtcctaggtcctaaacacacagctgacctaaaaatgtagtgttcttgcagcaaatccttaatgagcaccacctgtgtgactagcattatgccagctactgccagaggatgaaaagcagcctaactttggggacaaatcaaagagtctatgaagtaattctctgccattgttcttttatgctatattcgagactgccaataaaattaatgaaatgaggcaatgtcttatttttaggcgcaaatatcctgcgagattcaacaggcaacgtcaaactaggagattttggggccagcaaacggcttcagaccatctgtctctcagggacaggaatgaagtctgtcacgggcacaccatactggatgagccctgaagtcatcagtggagaaggctatggaagaaaagcagacatctggtaggttttgatacgaagtttgcttgaaaaccacctgccgcctatgtatttccacctgggattgaattactgaggcagatgtaaataatcttttgtacttccaaaataggacgtaagaattgcgaagattaacactatattaattgtgccttattgaggcttataattgactaaatagttagaatccttgaacctgtcctccattctttaggaaggattttgtcgtgagcaaacctcagcattaaaaagctttttgctattacagaagtaaataaatagttactttgtttgtctaaagacctttaaaagtacttcatctttgttgtcagtgtcttataattcatttaatctttaattcttttataattttaagttagaacatgaaatggccattttctacttcccacccagaaaagactttaatagacattcattttaggcacctgaaggcaattgatttctaatgcttatattctttgtaagataaagacaaaaattatttttaaaatcaggttagaaattatataaaacaaaaataataagatgaataatgttctttgcccaaccgtttgaattaagtgatagtcattaaatttattttaattgatttttatgtttaaattagttttacgaaattagaactttttaatgaaactttgaacttgaaattaagtcatatttaaatatatatggacttaatgcctgtttctcattttctagctaactagctttctttcatgttgttgtttgtgtaatgtatttctttttgtttcttttcaggagtgttgcatgtactgtggtagaaatgctaactgaaaagccgccttgggctgaatttgaagcaatggctgccatctttaaaatcgccactcagccaacaaacccaaagctgccacctcatgtctcagactatactcgagatttcctcaaacggatttttgtagaggccaaactgagaccttcagctgatgaactcttaaggcacatgtttgtgcattatcactagcagccagtaacctctcctgtgcctctacctagctcccatctattcattcaccttctctctgactgcacttttcttttttataaaaaaagagagatgggggagaaaaaagacaagagggaaagtatttctcttgattcttggttaaatttgtttaataataataatatcctaaattttttatatttaatctttttttcccttacaagaacttgaagtttttttttttaatttttataatgtactgatgtggttcagagagataaagcactttagtacatagtcactctttttagtacaaacaaatcatttggaatacctaaagattgtagagtcattccctctatcactgacacatcagtgacgatgggaagacatggaaaacaaggagaagaaaatgatgtataatttgtagtttttagtgatagtatttaaaatatatcctcatttgtggggttgagccctaaactttagtttagggtaggtactcaacttaaagaatataggtttcttcttatatctgtattctttagatcctaacctctgtctaccaacctttttgctcagtaggagtcttgatagaagatatgaatctctgagaggtatgtttatttgttaatcctaaccagtataataagcaaatacactataatagatccacgttactggaatctgtaaaccttgagggatagctttctgcttaaaaacacacacacacacacacacacacacacggaaaacctttattttaaagtcaagttgtgagcaaatagaaataaaagacaaaaggacatcactcttatcaaatgtgtgagcagtagaagagaccacatttacagtcaatagaaataatgaaaaaaaattaggtgtttagtgtattttaaacagttttgttttgttttacttgagggggacgtcccaaaattaaaggaatggagaaataatcaaaatcatgtataccatcttctatttccagctcctgattccccataggtaacatcccttaggagcgaagagttcaattagtaatgtttatgtgttatgtcaggagatgaaacccttgttcttaggatcacagaatactaaagcacctcaaaaaaacaggtatcatgtgaaacagtggttgccaaaagtggagcgaggatgatttcactaggcatttggcaattcttagagacatttccggttgtcacaattggagggatactagtaacatgaattgggtagaggccagggatgttgctaaatagattataatacacaaggaaagcagcctcaaagaattacccctcccaaaatgtcagaagtgctgaggctgagaaaccctgatgtaaagatcagtcccagttataaactgaaaacagctatttacaaagcagt

SEQ ID NO: 38696 - DNA, 368716 bp, Homo sapiens
gaagcgcctgtgctctgccgagactgccgtgcccattgctcgcctcggtcgccgccgctttagccgcctccgggggagcggccgcctattgtctttctccgcggcgaaggtgaagagttgtcccagctcggcccgcgggggagccccgggagccgcacggtgagagcgcaacttagttggcggagttgggggaagttttgtgatttgtgggtcggggcgcggagcgcggccagtcccctgcggttgctcggtggggcgggccccggaggaggggcgggggctgcgggggtttcgggggcgggctggacagacgggtcgccgggcggcgccgggacctcaggtctgcggacccctcctccctgcgcatcgcccttctcccgcattgtctgcttggggctcggcgcgcctcccactccgcagcccaacttagaggccgtcgccgctttccgggtggggggcgcgcccggccgccgatgctacctcaggcgctccgcccccagcgaggccccgaatccttgccccgggtccccgggtcggcgccgccggggcgggctcactcctcccctggggcgggcggccgcggtgtggagtccccgccgtggagtccgcgccgtgaacaagtgctgcgggcgcgagggagcggctccccggggtcgacgcggacggtaaacacgtcgggccgcgcctgcctgtcggtgcctctccgcggcttctcgggggtgcggcccagctgacccgcgcgggtcgcaggcgagcggcccaggagacccgtgcggtccccacgcgctctgggacccgtgcagccagccggctcagcttgcagctatactttgataccaaacaaaacttttttttttttttttggtaaatacggtttactgctttttttttttttttttttttgcaaagccacgaagtatgtgaagttgaaaaaaggaaaaaccctaaaactttttaaaaaaaaatcaagaaagggggtagataggtttgttttgttttggaaatagttcttatagcagagtgataccgtcccatttaattttctagatcccggaattcacaatgaaaattggattgagcggtattttggtgttcattctttgctaatgacactccttaatgaagttatttggagagtttattgcttcagtacagtaaaaaccagtgtgcctttttttttgttagtagtcccccccacaacaagtgttttatttttagaagaagcattttcttcagtttttctgaactgttggattgcgcagatgaggacaaacggtgcagttcttgaaaggtcattattggcaagtttgtgaagaagctaagatcagttgagataaatcattgttactattcttgtattctgtcgtggactcttggggatttgcaggctgcattaagtacaagttttgtcaagtttgggtgcacatattacacttaatttggtttgtgtggcttattatatgaacatgattctgtttcagttccccagatggaactagcttaaatgtctgtcattcatagtggagcaaaatggccagagtgtcatttattgttaacttcagttgtattcctttaccatctgctaaatgaaaaagaaaaatttgagaaatactgtgtgtgtcagtttgctcagagtgatttctcgtgctaagtgagtcctgtggagaagcgttcctgggcttttctggtttggtgggccttgtgttataaaaccaattttcttcacctgatgaagctaaagacaaattttcttcaggtacagccattgcacttttaaattacagagccgcttttaggattcacagtactcgctccatggcttcccttcctggttgtgtggttttgtgtgtgtgattgtggggaaggaggttgacagaggttggaagggattgtcagggagggacataatgtaagcaagtactacttacaacatgacgtgacgagtgcactagttgctttccttctctgggcggtgatggcatgttatactgtaggtactattgttttaggatttctcacacttcttttgccttgactaaatggtaactgcacacatactatactataaatggactcctcctctagtcctttaactccttgagggctgtgatagaccttatttagctttttaccctctttgccggtagtcttaacatagtgcaggcacggtacgtgtttgaattgggtaaattatttttactgcctagtggtagctagcgtacacaggagagagccactaactggggacctgtccagaatgacagttcacttgcagatctgtgatgacatttactttaaaaggatttctaacctttttttaatctgtcaattattttttgaaaagaagtgggtttaactagcgctctaaggatttcaacaagaggttccaatttagaaatcagcccccccctttttgtgaaattattattgtttttttttagagtcggaatcttcactgttgcccagttgtctctaactcctggacccaagccatcctcccacctcagcctcccacagtgttggaattacagacgtgagccactccacccagccagtgaaattattaaaattgttggacaaatctagtcacaactctccctccattgtgaaattggaaaaaaattagaaattttagaaaaaagtacaccctttggaactaggtagcgttcagatctccacacttccattgactagttgcatagcctctcagagcttcagtttcctactccataagcgttagtaacagtgttcttaggaatcagtgaaactatgtgaggtacttaactacagtatctaacatggagtaggcagctattacctagtagctgtaatgataataattttggtacatttttacatgacttaagcattcttaaaagtctgatgcttctgagtgtagaggtttagctatttctttcataaagaaggggccttgagacttgtgagtcttatcgaagtctatttcttcaaaggtgccagatgaactgaaggataatggaaacaatagcgagtttatcttctcagtcacctgtgagtcttcctttgagagtgggacttgcagagtggcttggtagggtagagctctttgtgactatgctatttgggcaacagtgagagatggattgttttcagtacatcagtcataagaggatatgagttccaactttattttaccttagtcttggcaaataagtgtggattgtgtctgtatttctcaaacttgtttaaggtagagctggactgggtgttaacagtgttagttcagtacagagacatgagcaaatcactcacttcctcttcaagataacactttaaaggtgacaccatttacagaagaaggcagtgatttaaatcagttatactagcatagtttagaatacttacactacctagatggagtagatacattctagaaatatttacctgttaaggacatttctttagattttattccatctttccattagttttctgatgaagagattatagtaaacctttaaaaattatatttgatcaaacttacagattgaggataaacctttaaaaattacagttggtcacacttacagattgagggtaaaaacattcctgacaaagctaggcgaagaaagttggacttttgatgttcccttcttttaaagttaacatctggcacttgaatagacttggttattactgatggggacaggcatccatttggaagtagcttccctctctctttcccaggttaggctgtcttactgctgtaaatggggagagacgagaaagctgtgggtggaagaaagtttgtttcatagcctggcgcagtggctcacgcctgtaatcccagcactttgggaggctgaggcgggcggatcacttgaggtcaggagttcaagaccagcctggccaacatggtgaaaccacatctctactaaaaatacaaaaactagcccggcagggtggcaggtgcctgtaatcccagctacttgggaggctgaggcaggagaatcgcttgaacccgggaggtggaggttgcaatgagccgagatcatgccactgtgctccagtctgggcgacagagcgagactccgtctgaaaaaaaaaaaaaaaaaggtttgtttcatgcatctgtcctcactggtcagtggaagaaagtttgtttcctgcgtttgtcctcatatttatagttttctcgtccacctacaagttgattgtgacgttatgaatagaagatgaatggataatgtgtttttgtcagaccttgctgtaaggatggacctggtactgaaataccgtgattgtatgaacatttgtgtggggcaatgctgtgttcagtgcctggggaatgtggatatcagtgtgtttgtatgatatgggtgctagtatgggagagaaggaaaacgtgtgaggtttttgaccatttatgtcactctgtaagctcttctctggctactttggtgctatagtagcagagttgagtagttacaacagagaccatgtgatctgcaaagcagaaaatatttactatctgggcttttacagaagtttgctgaccctttttctacataaccaactgcagttattcacaacaagaaagattaacgttaattctataatattattcaatacctattcaactttctctatttgtctcccaaatatcttttatagttgattaagaaaaattttggacagagtaaaattaaagttcactcagcacatcattatgtctctttagtctctattttttcattctttaattattcatatgtatagtttacattcactaaaattccgccattttagtgtaacattctctgagttttgacaggtgtatacattcatatatccactgctgcaaacaggacagtcccttcatcctccagaattcttctgagcccttttgtactcaaccggttctctacccccagactctggaaattgctgatctgttttctgtctccatggttttttgccttttcaagaatgttgtaaaaatggaatcacacggaatgtagcctttttattcatttgcccaatgactaatgatattaagtatcttttcatctgattatttgtcattctttgatgtcaattcaaaatcttttgcttaaaaaatgagtttttgtatatactttggaatcaaatacatgatttgcagatattttctcctagtctgtttttacttgtcttaataatgtctttttttgtttgtttgtttcgagatggagtttggctctgtcacctaggctggagtacagtggtgagatcttggctcactgcaacgtctgcctcctgggttcaagtgattctcctgccttaacctcccgagtagctgggattacaggcacacaccaccacacccagctaatttttgtattttagtagagatggggcttttccatgttggccaggctgatcttgaactcctaacctcaagtgatctgcctgcctcggcctcccaaagtgctgggattacaggcgcgagccactgtgtctggccttcttgtcttaataatgtcttttgaagagcagaagttcttaatttttatgatatccagtgtttttttgtttttttgttttttccctgagtggatcatgcttttggtataatagtttagaaatctttgcctaacttaagagctcaaagactttcccctatatttcctcctacaagttattatttttttttttagagatggagtctcactctgtcatccaggctggcgtgagtgagatcttgttcactggaatctccgcctcccgggttcaagtgattctcctgcctcagcctcctgagtagctgggattacaggcacccaccaccatgcctaatttttgtatttttactagtgatggggtttcaccatgttgaccagggtggtctgaactcctgacctcaagtgagccacccaccgcagcctcccaaagtgctgggattacaggcgtgagctattgtgcccggctcgcctagaagttttatcatttaaaattttatatttacatttattatctgctttgatttaattttcctaaatggtgcaaggtatgcattgagtttatttttttgtggatggatttacaatttttccagcaacagtttttgaaaagactgtcctttctctgttgattacctttgtgcctttttttttttgcaagttgatcataaatgtgtggttttgtttctggattctctctcctattccattgatctgtgtctttcatttctctatcacctcactgttgattactgtcaccttagagtaagttttaaaatcaggtagtgtgagttatcttattatttttcagaattgttttttgggtattttagttgcattgccttttgtgcatattttagattcatcttgctgttatccacaagtcctgctgggtttttctttttcttttttttcttttttaagatgaggtctcagccgggtgtggtggctcacgcctgtaatcctagcactttggaggctgaggcgggtggatcacctgagatcaggagttcgagaccagcctggctgacatggcaaaaccccgtctctactaaaaaatacaaaaaatagctgggcgtggtggtgggcgcctgtaatcccagctacttgggaggctgagacaggagaattgctttagcccgggagatggaggttacagtgagccgacattgcgccactttactccagcctgggtgatagaacgagagtccgtcttaaaaaaacaaaaaaagatagggtctcactcagttgtccagtgtggaatgcagtggtaggataaccactcactgcagccttgatctcctgggcccaagcgattctcccacgtcagcctcccaagtagttgggatcacagtcatgcactacctggctaatttttttatttttgtagagacagagtctctctatgttgcccaggctggcctcaaactcccgggatgaagtgatcctcccactgtggcctcccaaagtgtagggattacaggcatgacccaccatgcccagcctgctgtggtttttgattggcattgtgttgaagctggaaatcagttagggggcaattgacattttaataatgagccatgaacatggtatatctatttagaccttagatttttgattagtgttttgtagtttttagcaattggatcttgcatgtgttttgtaatcttatacatgtatttcatgtattctggtgttgttgtgaatgatacttctcaatttccagttgctcattgctggtatatagaaagatcattttatattatttgctgaccttggatcctacacccttgctaaactcatttttagtaatagaagctttttttgtagatttttggaattttctgcatagacattattgtcattggcaaataagggcagtttgatttcttcgttttcactttgtatactttcatttcctttttttttttttgagatagagactcgctctgtcacccaggctggagtgcagtggtgcgatctcagctcactgcaacctgtggccccccaggttcaagtgattctcgtgcctcagcctcctaagtagctgggattacaggtgcatgttgtcatgcccggctaatttttgtatttttttttttttaagtggagactgggtttcaccatgttggccaggctggtctcaaactcctgaccacaagtgatccgccagcctcagcctcccaaagtgctaggattacaggcgtgagctacagcgctgggcgtgatttctttttgttactttgctgaactatctaggaccctcagtgtaatgtgtaataggagttttacaagtggacatcctttcctttttcctgatgttagaggggaaaacactgagtgtttgaccattaatatgatggtagccataggtgtttgtttttgtagatgtcttttatcaagttgaggaaattgtcttctatgtttagtttgctgagagtttttatcatgaatagatattgaatgttgtcaaaggtttttctgtatttattgacataatcatatgttttttcttctttagtctggtgtaatacgttgaaatagctttgcattcttgtgataatactcatttagtcgtgatgtattattttttacatgtctttgggttccatttgctactgaatctttttttatttcttccatttgtttcccgttatgttcattttaaaaataggttcttgatcatatgtataatattcatgatagttgttgagtccttatctgttaaatgtcagatgtctccttgggggtaaagttatttcaaacacaagaaccattgctttaaagagtatcatactttgttttggcaagttaagttgccaaacttatgtgtgtaagttgcttgttacaccccattactaaggcatgaagctcctgtagttttcattgaagaattgggctctccttgaggactctattctggcagttgagaacacaaatgtctcccagccctgtgtgaactttggagatcatttagcttacagttcctgggtgattctttgcatgccctcatgtatttttacaatatgcatgcttggcttactactgggtgtgagactcatggggcctctatgctgatttctggagctcctttttcatacagctccctcctcttctctcgtactctgcaattttcaaactccttagccttcccaagctatgtttgttttctaaacttgacaaggctgtcatgttgtgcttgatcctcctcattgcaccatggtctagaaggtacctccagccagaaagctggggcgattttagggcttatctcatttgttcccttctctttgggactgcagttctgtgctacctgttgttcaggctctaaaggatgctgcctcatgcattttgtccacttttctagtagttagggaggatgccaggataaatctggatccagttactccgtcatggttagcagctgaagtcctttgggtgagtatgctttgttggtggttcttaaaatttcattacaggattctcaaaatctttgggggtataaataacaaagaagtatttgttgactatcttctgacagtagctcagccattgctttgtgggaaatacaaaacaatgtaggtatcttttagttgaagaggcacatggtacatacctaagattaatcaaagaaatgaattgctatggtgatgaacagaaagagaaggatcactataatctattattttctgtccccccgtgggggagtcttccagtgaaaagcagaaaacctgctagacagattctaaaagatctgtaacacttgtgatctggtgttttcatgtagaaatgcttgcttttgcgtttttgtttcttagcatatatgctttatgtcgcaagttgtagtgagtcagtgggtagagtgctggctctttcaggtgcatttgctatttatttactatgcagctttaggtaagttatttgtctctgaaatctaatcttctcttttctcttggcaaatggttatatgacataccttgtagggttgtttgttaattttttcaagtatcttttgtttgtcaggcacggttctaggtaatgggaattcagtgacatctgtagttgctgccgttaatctatatcctattgagggaagtagaaaataaacgagtgaacaaacaattgcagtcatgtctggtggtgatgattctaggaaggatatgaagagtattagcagagattggggaggtcagacaaggccttactgaggaggtgagatttgaacagacctgaagaaagtcaagggagcaagtcacatgaagattcagaggaagtatggaaggaacatcaagtgcaaaggacctgagatgggagaatgaacagggagcctggtgtggctggaatgggtgagaaagagcgtgaggagataaggtttgtatgtgtagccagagaccagatcaaataggctcttaggtatggtgggaaacagctgaaggatttgagcaaggcatgacaaggttgatttaggctttaaaaactttactcttggcatagggagcagtagtggaaacggagagactagttaagagatttgcagtcgttcaggctagagaagatggtggcttggattagggtggtagcagcgaaagtggtgagaagcggtttgaatccatatacgctgaaaatagaactataggattacttacagattggaaaaaggttctaaaggaaagaaagaaattaaggaggattcctaggtgttttacctgaacaactgggtaaatggggaagatgtggaatcagtttgctgagaggttgaaattgtgatttccctgttgacatgctaagtttgagatctgtgaaatttttaagtgaaggtatcagtaagcatttggatatacagttctggagttcagtgatggtctggactgggtgtatgaattagagaattgtagatagagaagggagagtgggaggttttagtgggaattagggatatataaagctccataataggggctcatggcatagtagttaataatcatgacagtcataaaacaaccaccactatgtatagtaactaaaggaaggctagatatgaatgaaggaagatggtagtgacctaaaacaattatcttgcatattatatcagaattagttaggattctaaacatgctgaaaacttttcttctctaagcatgataaaaatattagtgaactctattttccatttgtagtctgtaaggatattggtgatagtggaaagataatgacgtttttatgtgatgctagtgtattatttgaatgtacttcacatacacatatacgaagatagtctggaaggaggctactgcaaagtagatgagggtaacttttgatcttttgattttctgcagagtgtatatttgtctttattcttttcttttcttttttttttttttttaagacagggtctcactcctttgaccaggctggagtgcagtggcgcgatctcggctcactgcaacctctcccttctgggctcaagtgagtctcccaccttagcctccccagcagctgggaccaccggtgtgcaccaccacgtccagctaatttttgtactttttgtagaggtggtgttttgccaggttgtccaggctgttcctgaactcttagactcaagcgatccacccaccttggcctcccaaagtgctgggatcataggtgtgagctattgcacctggcctccttattctttttttttgagacagagtcttgctttgtcacccaggctggagtgcagcggtgcgatctcggctcactgcaacctccgtctcccaggttcaagcaattctcctgcctcagcctcccgagtagctgggactgtaggcatgtgccaccatacctggctaatttttgtatttttagtagagatgaggtttcaccatgttggccaggctgttcttgaactcctgacctcgtgatccacccacctccgcttcccaaagtgctgggattacaggcgtgagtcaccatgcccggctctattcttattcttaataaaaggagttaataatattttttgaggttgggctcagttggtgagtttctagggtagtgggtttcatttgtttgtggttgctgatattacttattccatttttttttttactatgtatagtctattgtcttaaaaatgtgagcccttaataatttttttttttttttttttttgagatggagtctcgctctgtcgccaaggctggagtgcagtggcgctatctcggctcactgcaacctctgcctcccaggttcaagtgattctcctgcctcagcctcctgagtagctgggactacaggcgtgcaccaccacgcccggctaatttttgtatttttagtagagacagggtttcaccatgttggccagtatggtcttgatctcctgaccttgcgatccacccgccttggcctcccaaagtgctgggattacagaataatcttaatcgtaaatgggaatcagttaagagtattttctttcttttttttgttaagaaatgaggttttgccgtgttgcctaggctggacttgaactcttgggtttaagtggtcctcccactccagccttcctagttgctgtgactataggcacacgccactgcacctggctctgggtggttttgaaatgagtccataacagttcctggaaaaattgttagcacatactcttcccaccaggctaatcgtggcaccattttgttgaaagggtactttatgttgcactgtggtgggcagatctcttcagaataattgaactgagcatgaagttgttttgttttaaaatctgaattacaccatcagcattaacttagatttttagaagtatcctttttcccaggtgatagctgtcctaaaggtggtggatatgacaggggcttttgacaaatttggcattttcagtaattcatgaatcacttctaaaaacatactcagtgatttgggtggtatctgtaaattaatctatcatccttgtcttggcatttgagttctgccttgtctaagtgggtgtgtttctggagtgggagaagggaggtccgttgtgacattgcatggaaataatttcttttacctttaacaagctggaagaaaatggtttttggatgctttgtacacagagtgtacatcctcttggatgctttgtacacagagcggctgggctcagaatagaaaggaactatagatgagactttgcagtttgggagttatttggggaaaaaatacggtaacaagagttgggaagtagagttctaagtgttcatttgatcacatgaagccttgggggctggctgaggtgcttcctctcttcagggattaaaggcatgcatgggtcagtgggcagtaatagccaaagcttttgcttgggcattcctgccaaaatagtgctgtgtgtatgtttagagcatagaatagtgtgtatgtccagtctagagaggttttttgaggtcattttctataaggtgtttttgaaaaagtaaagttactataaagggaagaagaaacttttgtgtgtttacctacgtgttatgttatctacattctcttaattccttacagtaatcctataagacagatattattctttctcccttttttgatgaaaaaactagggtttagagatttaagtttgcttctctcaagtcaatgaactacaattttgatctgggacattgtgactacaaacataactctagttttattatatatgccataagtcacatttttttcactttgatgtaattatatccaaagtagctagtttaaaattccatcttgttcttggtgtaaatagaaaatcattgattgtggtctgctcttaaagttttcctagaattcttaaaaacatgctaggcttccatgtttgtgccttgaaagtagcagaaacttgccaatagaattgtggaactgtattttccttcacatacagaagctttgtggatggacattaataattaacatttacacatttgttcacatcttcaaagtgttttacaaacatttaattagttcatgtgtaaactatataggaagttgaaaaaccagttttttaggttcattttagtagtactgaagtgttagggggagaaggagtaagcaagccctcagtaagaaaaatacaggtatgcaccatgaagttctaaacatcttttcttacctgcctagctttcagcccagtttggctcatatcaaacatgttttttgggtgtatatcttctctgtaatacaggggagtggattatgtggacccaacagaagacagggtggaatggttggggaaagacctgggtcatgtaatgcaactttctcttccgtagtcccttaaatgtgaattgtccttgattcatccctttgagcattttgaaggccaggatgttgttggagcagagactctggcaaatgaatggagcatgcatgttaatttctagggaaaaaatcttttatttttcactcttgatttaggaaataatagctctataactagatactttgctagtttcctcacaactgcttgtcacctgattccatctcctctcctcccaccccctggtaaaatggctttaacttggcaaggtttgtagttggaaggagacagtagtcccaatttagctgggttctgtcacataattgactgtgtgaccttgagcaggtaggttactgctcttttgcctttgagttcttttgttctgtgaaatggtatttgctgactcacctttcactgagtcctagaaggatggccagagaaagatataaaacttagactcttggacatgaaatgggacagaggttattttcacattagtgaggattcttcagagttgcaacgactcctttctactttgcttggagtaactaattttcttactattcttgtcaacctcattactataaacactttttctaatacagtacagtaaatagaattatttgataaatagtgtgtctgggtaatttcctaagacaggacatgcaagttccttttaatcagtgcttatagcccattgttcagaggaaccgttcattgttcagaagaatctttgtgtagataaccttgccagagaaaccttacttagtatgtgatctcagaaaggagaagaattctgatagcttggcatgtatatttaattaaatttttataatgaatgagaatctgttcttttaatggggctgtataagaatggccctgaacttttgcctctatccaatagtgttgtttttcaagtctttctttttttctccatccctttccttctcttcttgaaatctgaaaatttaaaggtgggatgagttggctgtggctgttgaacctctttgtaacatgaaatacacccaggtttaaacttatctttctgttctgccaagatttatggtaacttggaaggaatattttacagccggacattgagtaatactatatatgaattatgaataattgagattggcttagttaagcggttaaagttactcttttatttgaaaggatatctgaaggcagtgtttatttatctttttgaaaagggagacttttcgataggacagattgtatgtataagacaagatagaagttttcttttggaaacctagctggtttccaaacaatccaataaatgattgtttttcctatttagattagggatttgagttgtactgtttttggttacctctttgatttttccgtattgtctttgcccagtgttcatttcctttccccggttaatctagtaggatgtactgtcagattgcccactgaatagatggggtaatgtaatatcacatgtctatctttcctcccagattataaacttcttgagggcaaattttatctgctttgtttattgctgtatccccagcaacaatggcacataatagttgcttctcaagaaatatatgggttgatggaaggatgaatgaatttttgactatacatacatacacacacacacacacacacacatacatatgcacacataacatacatgtatatattaaacttaataaaatctatcctgttgcgaataaatgaacagatgtttattttttcttttctagcatcagttttagtttgattttggtcagtttaaagcattccttttggggaaagagaagacatcatgttaaatggaagtttggtattgaccaagtttggtggtaaaatctatacagctcttgcctgatggttgtgcttggtccacgtagggctctgtcactttccgttttaacctcttcagcaacttcatcattggcatatggatggttgacctaagaatgtggtgcgtgatggctggcttaattaaaaaacaaaattatgattgtaaaacatgttcacagtagaacggtagaattgactcatatactcattacccagattctagcaagattttgctattctctacatgcattattttaaaaaaagctttgttttgatataattcatataccataaaattcacccatgctttactataatatgtttgtcctagttgtcctgaaagtcactacgaactattctttttagtgatttttaaatggtatttttactccaatgtataatactgtaaaccatgaaatgcctctgtaaaacaaggcacgataggtttccaggatatgaaacagacaactttaactcaaagcaaatgagtgctgagtagcctgttttcctttcagcagagtaattgcagaaataggactgcaaaccttttattaagcacttttatatgaaatttgaggtttctgtcaaattagacatggaaaattaaagctgcacaaattactgatctgtgcagtttttttgagtcctctcgtatgttagactttttttttttttttttttttaagataactgtttctcttaagtaccagcacaggaatgctatgatttatacataattatttttgttttcacgtcagtagtcttttgttccccccattgaatttggtgattcccccccgccccccgaggattattttttaaataatgcattcccaagtattttgacttttgtgaaagaaaatactttttaaggtaattgaatacctccataaatcttgtatttccttaataatttatttggcaatgtatttaaaaacagtgttgatatcttaaaagctttcatttgaaggcccaaaaacaactgatacattgtttttcatagcactttttgtaaatattatgtcctaagtgcatagattctttgaaatactcctctttcaccccctctgtggtaaagaattattttggctgctttgccaaaagtgcttgtggcagtctaaagatgatcactttattagttagctcactgggatatgtgcccataaatggagagttttctttcccgagctcaaataaaggtaatggttcatctgtgagatacctcgggactcaaatactaattcagaagaaaaattatatttattctctcccctcagccttgatgcatgttgaaatctgcggggacaagttcactaatataatagctgtcacttattgggaaccattattgatctattggtagctattcatctaagtgtcttatataggtcaggtcttatctctgcaaggaaggtatttttatgattttaccagaaaaggaaattgaagctcagagaaattaatagctaattttatatatacttcattcagcattttatttaaggcctgttgtatgtcaggcacactactgggcaccagggattgaggaataaacaaaataagatgtagtcactgcccttaaagcactcatgattttgtttcttgattgataggcagtaacaataatagtgataattgccatcatttattattactttccatttgccaagtgtagtagtaagtactctacaaacccttgtctcattttaatcctcataattctaatcctcacaaaatgtggaagtatccatattttatggatgaggagacagaggcccagagaggctggacttgctcagggtcacacagttagtatgtggctgagttcatacttgaacatggatcttactctagaacttatactctgctcagcattcctcattctggcgagagttgaaacgagtaatgatgtgaaagggacatcattgtgagctattattttggcagaactttatgtaactttgactttgccagtagatttatttttatggttaatctcttattctaggagtcatcagatcgttttcatgatttatgaaagacatttttaataagtcttatttttattacaacagtaatgtacagttcctctagaaatttaggaactatagtcccccaaaagtacacataaatgacactacctagagaaaattgttgggtataatttttctttccaaacttgaaaacttgtagagagagagtgtgtgtatgtacatatatacagcccatatgtggactagccatatgtggcgtattttatgtactcttgagcataaacaggttataaaacatttcatcaatgtacctttatatgatttcttttttgttgttgttgagacagagtctcactctgtcgcccaggccagagtgcagtggcgcaatctctactcagtgcaacctctgcctcccaggttcaagcaactctcctgcctcagcctcccgagtagctgggattacaggcacatgccaccacgcccggctaatttttggatttttagtagagatggggtttcaccatgttggccaggctggtcttgaactcctgacctcaagtgatccacgtgtttccgccagccacctttatatgatttcaagtaactgacatagttattttaatggctatatagtatttccttgtatgaacttaagtttatcttcagttcatttcctattatttgaataggttgtgtatcttttttccccatcacccttcctcctgcctctttcctctatgctattataaacattgctttgaaggacagccttatacatacatctgtgtgtccttgtttactttgttagagaaatggaattgttagggcaaatggtgtacatttcagcagctgttcatagatattgtcaagttgtctacagaaagcttttgtcatttatacttctactggcagaatatgacagttcctatttactatttccccataacttttagaaaacacgtttttaaagttttagatgcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaataaaaaaataaaaaaataaataaataaataaataaagttttagatgccataagataattactcatagaattactggattactggcaaccaaagaaaaaatgaaagaactctgtatttctaaaaggatatgaagaaactcacgaagcatcgttactgtcctcttaggtgctaaacgttaatctgagttctcaatattaaaagacagatggaggaaactttcaaataaagtcactgatatcatgttcctttggcttgttcttagttgtcggttcagattaactccagcaataaaacagggaagtatttgagataagatttagagatgctgaggagtaaggtcctcttctacacaaagagccctgtgaaagatgatctgtggccattctgttgcttatctaaatgcatgttagaattaatataacttatttatttatttatttcattattattttttctagagatggtgtctcgctgtgttgaccaggctggtctcctcaaactcttggcctcaagtgatcctcccacctgggcttcccaaagtgctgggattacaggcatgagccactgcgcctgactgttaaagcttttagttctgggccaggctcagtggctcacacttataatctcagcattttgagaggttgaggtgggaggatagcttgaagtcaggaggccaggagttcaggaccagcctgggcaacatagtgagagcctgtctctacaaaataaaaattaaaaaattagctgggtggtgatgcatgcctatagttgtagctacctgagaggctgaggcggaaggatcacttgagtccatgagttagaggttacagtgagctatgatcacactgcctttactccagcctgggtgacaaagcaagatcctgtctctaaaaaaaaaattaaaaaacaaaatttagttctgaaagtacaaatacgtataatccacatatgttcctcaaatcacagttacatattgacatcatggtttagataatcaagaaaacaagcaaattaaacattgaaactgtgttcttgactttaatgtaggcaaacctttttctctgagccaaagattagtcaactggtctcagctataataatgattttcaatcataatatttgtgaaggttttctgtattataagtaggaagaactagttgtataggaagttgtaagtcaggtagctgtgtaaggtgatctcttggcactgttgatacaccagcttgtctctgttttgttgaccattcttaggagtatcttgttgatattcagcctatttctggttacagagaaatagctgattaatcataatttagtagccatatatatatatatgtatatatatatatatattttttttttttaaacagagtatgttgctcaggctggggtgcagtggcacaatcttggcttactgcaacctccgcctcccggattcaagcgattctcctgcctcaacctcccaagtagctgggatcacatgtgtgtgtcaccatgcctggcttattttcatatttttattggagattgggttttaccatgttcgtcaagctgatctcaaactcctgacctcaggtgatccacctgccttggcctctcaaagtgctgggattatagacacgagccactgtgcccggcatattatatcactagatgtagaaatttaatttatgatggttctataataaagtcttggaacatgtagatagttaattcagatgtgggagggcttctgtggtcttgaaaccacccagttttttatgtagtatacctgattattgaactgttagtttcgttatgaagtctagatgttacttggttttggtaaggaaccctatgtagaattttgaggacgtctcctctgccaacctgaattgatcagaatttttatagacctcccaaaggacctctgttttggaaatcttttggggcaaggccagctttgatttgttttctctgttacaacagcattatttgggcttaaatctcagaagtgtgccattctgcttttttactgtttcctccccctggtaacttgagctattataaactgtttaccaaagaagctagtcatttttgtctcagtattctcttaaactgtccctttgaggttgtaaaaaagagagtaataacaattagcaggtcaaccaacaaataggaccttggtatctcacatttcagaggattcttccttaggtctccctactttctttcctgtcttagggatctgggataaacaattagcttggtaaatcagtggtaggaattaaatgtttctgtgcagtttttctgggacataggacaataataatggggaacaaaataataagagaatgagtaacaagacagtagtaataagaatgccagattaaaaataggaagatggaaactcactgactggtagaaatgtaaaggataaattctgatgtaaaacattctgtagctgagaaaaacttgttagtgaacagacactggattaggattcaataaatttggtttagtttgctgccaacaaccttgggcaagttgcttagcccactccacctcaattctcccatcaaaaatgaaacggttaaactgtatcaggtttttgtttggttctttgttgtgttttccccaaaaagtatcctcaagtcctggagatccttggaattacatcaagggcccaagtgagattggggagggcatgaaaaagagagcaagtggtgctacacagagtagttccactttcctctagtttatttttgtgtttcctgtaatgtttccttcgaagacacttccatggccaaaaaatcagtttggaaacatctggactgaaatatgttgaaagtgccttctggtgcctaggatttggtgtttatgaatctccatctgttggctggatgtctttgttcttggtataagtctttcatggttagggaaattttactggctgaatcatgaaggaactgtataatacaatgggggatcgtggtatctgactgctaggctgtgctctgatgttaactgcccatgagatagttctcaactaagcaattagaaattaaaatactttttagctctccgggagcttgggaaatcctgataaaaagatgcaaagaatcatactccttgcttatcaaaacctatttatgctagctgccattttttttttcgagcacttactttgtagcattttatctgtatgtctcacttaaccctggggtggtcttgtgaagtagctggagttagctctgccgtaaatggtagttgaggcttactaagattgtgtagcttggctaaactcccacagccagaagtgcaagagctggggattgaaactaggattgtgtttctaaaatgtgtgcattctttattatgttcacctgcctttcttaaagttacaggagttttgtagctgtgagacgtttttaatagcaccgctgttactcatgtttttcattaatgaaatctggtaataaaagtgattagcaacgttcattgttcttaactgcttgttatgccaaggactcttaatagtagggcagaaatgatttgattatattgtatataccattccttatctgttaggtcctcataaataaggaaaaaatgagaaatttgtaagattagagcagaatgaaataagctatgttttctttaatggttggaaattattcctaaaagaataatagatatgaaaaaaatctaaaataggtgatgctaaattctttagagtcagtgaacatacagagattagattgttttatgatcagtgtggtgctaactttgatgccctaagaatggatttaccatggtggtacctaatgcaaggaaattgggcatttttttcttcacaacataatttattgctggacactgtaaaaatatcaaaacgtggtgggcattagtgccactcactacaatttctagttctcctttttgcatgtggaatatcacatttcccagcctatttcaagatggcatggtcttgtgacttgctgtgtcccatggaaatgtgtcgcttttggctagaagcatttaaaagctgatgtgaggtcgggcgcagtggctcatgcctgtaatcccagccctttgggaagctgaggtgggtggatcacctgaggtcaggagttcgagatcagcctgatcaacatagtgaaaccttgtctttactaaaaatacaaaaattagccgggcgtggtggcgcatgtctgtaatcccagctacttggaaggctgaggcaggagaatcgcttgaacccgggaggtggttcaagcgattctcagtgagcctagaccacaccatcgcatgccatcctgggcaacaagagcaaaactcctctcaaaaaaaaaaaaaaaaaatctgacgtgaaatgctctctctctttccttgcttttgggacctggaagcacaagtagctatgacagtaccacatgatgaaatcaggttggaatactgccctgaggcttgaaggattgctgccccagagagttgcctggagccatagtgatctttgagtgagtgaggagtaaacttcattgtgttaacttctgataccttctggttgttgttaccatagtataatctagcttatcctgactttactacacacatcatcagaaatcattagtgtaaaagatttttaaggagagggactgaccaagattgaagcataattacctcagatgcagataaggtcaatagcatagttaagggcaggttttctcttttagctgtcacctgttttatgttttgtcagtttattcttcttttagctcagttttggtcgtatcactgccccatttaaaaatagtagttcctcattgcccaccgaataaaatctgagtaaggcctgccacagtttggttctgcaacaacacgctttaaaaactgttctctcactgtggtgaagtatttatttatcatcatgtgcctttgcccattcatgcatttgagaaacatatattgattactttgtgtgccaatgtggaggctagaccctagggacacacaaaatgttccttcccatctgttcatgtccaattctgccttagcttttcaagctaagtcttgaaggatgtttcctacataaaccctgcttcattctcacagttggttataagctgtctttctgacctctcaagcatttctggcacactgtttcctatcctggttgtaaagttgtacttgtatatctcattccctttactgggctagtgtcacacctttgtatctttagtacctagctcccagcttatggtaggggctcagtaatctttactgaatgaatggctgttagattgtggctgtgttgaaaagccaatgattaatttgcctttgtttgacaaattgttactatctttaaagttattttgccttcgttgcttgcacttacctccttctagctattatcattgtgtgtgttcattcttagtactcagtagggccttatgtagcagtggttgtgtttttttctttttttataagctatctggaatgctgtatcctagcacattctggtgagctttccttaccattgtttaaagtctgttttgtgttttaaagatccattgtgaagtttcttaatgtgacttctaagtctagagcttatgaatagatgagtcatgtgttttaatcgattcagacttagttttgtcttggtgtcttgttgtttctactgatgttttcctgaaagatttgtgcctttgaatctgtgttctgaacttatactctggtttctcttcgtatggtgttagtctttccccttttactaaagagctttgaactgggtagtttaaaagacccagattctagtttagtttggcttctagctcactttgttaactttggttgtgaagtttgtatccacgaaacaaatgagtttgacaaaaatccatgattcacatactgattttactatggaccgggtaagttatttgaattctaatcttgtgtggatacaaaaattggagacaaaattctggtagggttggcaaaggttgaaggaaactttatttatttattgagtgcttactatgtgctagatgctgtttatttgccttattcactaacctgtgaagattttatctctgtgttttagttacagaaatatgagatacaaagaagctaggatacttattgagctagtaagggcaggatccagaacttcggccaaagtcaatttcattccaaagccagtgttctttttgttgcagtttgcaagccgttccagacttctctaacggagtagcctttaggacaaatgataggtgttgtatgtgtctcttgaagaaagtactctctgttgcatgtcatactactggtagaatacctgccctcaccccccaccctcttttttttgagacagagtcttgccccatcgccaaggctgttagagtacactggtgatcacagctcaccacaaccttgaactcctgggctcaagcagacctgctgcttcagcttcttgagtagctgcatctacaggcatgtgccaccatgcccaactaactttgtaatttttattttgtagagacagggtctcactatgttgcccaggctggtttcaaactcctggcctcaagcgatcctcctgccttggcgtcccaaagtgctgggattataggtgtaagccactgagccagaccaaaatgctcttaagatacaaaaactagagtggataaataaactatttctctggatctttgattaagactgcacaccccacggtagtgcagttatttccattgtgcctgtaagtgtgctttaccatcctgagtgaagagtgaagggaccatgattaaaattcccatgacattgtatggttttatgattgtggtttcaagtcttgctctctctcaactaatttttgtgaccttagactagaaaatagtttttttttttgttttttttttggagctgcagttccactgtgtgtaagatgggaaaaacagtacctattttatataccatattgctcgttgctggacacatatgtgtccagcaagcatttattttttgtctgtggttgtacctataattggggagaattttttttctttaagtgtagatcaattatggtataggacattggaaggtagaagaagaggtactatatacagcagttactgacctttccagtctgaattcctatttagaaataaactacttatgttatttgtgttactgttttaggagacatgaattggctaataagttgtttgcagtgttgtttctttgctaatttttgtaaatgtaattagatttcataacattttgtgttaggagaacatagacactttgagagaaaaatgcataataaaagctaatttgatggtttctaggggtagttctattttgaaattcctttcagcagacaatatgagacagcatattatgggctaggccctgaaagaaccaagggagagtaaagcacagtcctaggccacaaagagtatgtctctggaggataagatctctggattttttgtcctacttacaaaacagaaataatatattttatgctagttacaagtagtataagctcattgaagaaatatttaagcagaaggaatgtgcaccagccactaggaatgcaaagataattggggtatagtgagagatatggaaatttgttgtgtaacaatgttagagtaccaactttgtggtatacaggcttctaaggaacacagatgagggatgagggatgggacgggtgtgctgggtctttttttttttttttgggacggagtcttgctctgtcacccaggctggaatgcagtggtgcgatctgggctcactgcaacctccgcctcctgggttcaagagattctcctgtttcagcttcccgagtggctgagactacaggcatgcgctgccatgcctggctaatttttttaaaattttttttatttttagtagagacagggtttcaccatgttggccaggctgttcttcaactcctgacctcaggtgatctgtctgccttggcctcccaaagtgctgggattataggcatgagccatcgtgcccggcctgtgctgggtcttaaagcatgagtaggaatttgccaggcctgggttgaggagagaaagaatggaatgatggttctgctgtgatacactgtgtgcaaagaaacagacgtcaaagagcttggtgtgtttgaactcagtgagcagtgaggtgtagaattatttcgtgtggatagggtgtggtcaccgaattaggttagaaagtcaaaatggggtgggtggaagcgtcttttagtttgtcctcttgaagcaaaagggaggatagtctggttttgttttggatacctcattctgtgagcagtagaggatagtggcttggcagagggagaagggagcattgcctctcagacaagttagaggaggccattaccatagttttggacagattgtgagggcttgaatgcagtgaggttggaagggagccagcagatctaatggacattttgaaagttgaatggatgaaacttgttgagtagatggtgggaattaggaggtggtagttgtccagaataactgggaatttctagcacaggctgctgggtgaatgagagtgcactgaggggcatgattcattctggcatgggagaggagttggcttcctggaagtggtaatgtttacatttggcttagattacctcattcaaagtggttcttgattttgcccacaatctattttagagtccatttattcatctagaaagtaccaactgcttactgcatgccagtaattgatattttaagaatattaaaaaatgttaattgtggtaaacacacataccataaaatttaccatcttaaccatttaccgtcttaatcatttttaagtgcagaggcagtggcatttagctctttcacattgtcgtgcagtcatcaccactgtccatttccatgactcttttcatgttgcggaacggaaattttgtacccatgaaacaataactttctatttctctctcctccgtgtccctggcaaatacttttctacttcctgtttctatggatttgactattctgggtactatatgtaaatgataccacacagtctgcgttcttgtgactggcttacttcacttagcacaatgtcattagaattcatccatgtggtagcatgtgtcagaatgtatttcctttttaaggcagaataatattccattgtatgtatataccacattttgtttatccattcatccaccaatggacactagagttgtttccacatatgggttattgtgaataatgttgctttgaccatgggtgtacagacatctttcgaagtccctgctttcagttctttggcgtatgtacccagaggtggacttgctggatcatatggtaattctatttttaattttttgaggagctgccatactgttttccatagtggctgtaccattttacatttctaacagcagtgcacaagtgttccagtttctctgtaccctcaccaacacttgttattttctgtttttgtgacagtagtcatcttatagtgtgtgaagtgatatctcattgtggttttgatttgcatttttctagtagttagtgatgtgagcatctttttatgtggttattggctatttgtatatcttttttggagaaatatttgttcaaatcctttgcctgtttttcatttttattttattttaatttaattatttttttgagatggagtttcactcgtcgcctagcctggagtgcataggcacgatctctgctcactggaacctctgcctcccaggttcaagcgattctcctgcctcagcctcctgagtagctgggatgaaagagtgcaccaccacacccagctaattttttgtatttttagtggagacagggtttcatcatgttgtctaggctggtctcgaactcttgacctcaggtgatctgcctgcctcggcctcccaaagtgctgggattacaggtatgagccaccctatcaggtccattaccctttttttaaattggttgtaggaattatttatgtattctaaatattaatctcttattaaataagagttgctagaattttctcccattctgtgggttgccttttcactctgttgattatattctttgatgcagctagtagtagttttttttttttttttttgagacagagtctcgctttgtctgtcgcccaggctggagtgcagcggtgcgatctcggctcactgcaagctccgcctcctgggtacacgccattctcctgcgtcagcctcccgagtagctgggactgcaggcgcccaccaccacaccctgctaattttcttgtatttttagtagagacggggtttcaccgtgttagccaggatggtctctatatcctgacctcatgatccgtccgcctcggcctcccaaagtgctgggattacaggcgtgagacaccgcgcctggcctgatgcagctagtagttttttaatgaaccttaaattataagggaggttgttgcttttatagtaactttactgagctcaaatgaagaaattagtttcctccattttcctttagaggagtatgatataattttataatttgaaaaagggttggtattcactttttctggaattttcctttctaggtatgatttatgacctagtatcttttgagtaatgtctccttcctttctttttcatggccctcaggtgtggttattagaataagcatcatgaccatgacttccccgggctggtcgctcatcaccagctgtccagttagaagcaagtctggtcatacctgcttttgtgtaccatgtcttacagtagtagttgtcttggggctgtctccctactcatgcccttcttgtcgactttcacctgggtcatgagaatggcttcaaaataggtcttctgcttcagatttctcttaattttcctgtacactgtttggactggcctttccaaaacacctttcaggggctttgtgatgctttcaggatcaagttcagacactaagcttggcagtccaactccttctaccttgaccttaacccccctttgcagttattttcttccctggtcattagtatattggcagtgtcagtcaaggcattttatcttccttggactggggtaagatgcttgataggtgggccatttctcttctgcgactctcagatttaccatctgtcacctggacgtgcttgtgctgtgctctctgcttggaatgctgtcacctcttcaccttgcctggtttttcagggcctaactcaaatccctttcctccttgaatccttctctagctggtccagcccatagagatcattttccgttctcagaatgattatggcatttattttctgtgctgtttcattgggcaattgattgtaaatggctctgtattgtgttagctttttgtgtgtttttaagaaaatgttctgtcccctttagttccttgtagtagtaatcatgacttgtactctatacaggttctacacacgtaggtaattgatggatcttcattgatcctataacattggttctccaagtgtagtcagtagaccattgaacattcctgagactctttcagtgagtctgtgaggtcaacacatgaaaacattatttacctttttatagtgtgcagacatttgacctgatagtgcatagtgcaaaagcaacaatgggtgaagctgccgatgccttagaatcaatcacgacagtgaactaaactgagctccagtagtcacggtattcattacagtcatgtactgtgagtgagaaataatgccagttccacttaatgtctgtgatgaagtagtgaacattattacttttattaaatctcaacctttgagcacacatttaaaaatgtgggaagaaaagggaaatatgcgcaaaggagttctgcacgtggaagtattgtggttatcttgaggtaaagctctcgtgtgatggacattaaggtgaactaactgcttttttttttgagatggagtcttgctccgtcccccaggctggagtgtagtggcacgatctcggctcactgcaagctccgcttcccgggttcacgccattctcctgcctcagcctcctgagtagctgggactacaggcgcccaccaccacgcccggctaattttttgtatctttcgtagagacagggtttcaccgtgttacccagggtggtctcgatctcttgacctcgtgatccgcctgcctcggcctcctgaagtgctgggattacaggcgtgagccaccgcgcccggccaactaactgcttttttaaatgaaactccatttttatttgaagggaggactttgataagctgtggttatccagaaattggttatttggcagataccttcttgaaaataaagcaagcctttacttcaaggaagtagtggagtctttgttgccagtgataaaatttgagtttgcaagtgaaaatcagaagtttggaaaatatgtattcgccaccatgagcttgacagcttttcagtatttaaaagctttatgagtaaagtaatgatattaacaaatgtgatttttgatattgtataatgaaatgtatctacatttggaagatctgcataactcaaggaaccagtattttcacaaatgatcaatgtatgatgttacagcaaaaatcatgcttgggtaaacgattcattcaaagtgaaagaccagtcacttttaatgtaacagagtacaaaacggtcattgatacagtttcagatttcacattgtgactaactctttaagaagctaccacttgtcaagttttggtgtaacatggaaaaagaatattaacaactatcccaaaagactattaaaatactactcctttttcaaattgggtatctatttgaggcaaaattttaaaaatgtacttccccaaacagtgtaaccgtttgaatgcagaagcagataggagaatccagctgtcttctattaagccagacattaaagagatttgccaaaatgtaaaacagtgccacgttcttatttttgttttgttttggaaaacatagttatttttcataaaagtatgtttatttgtaatgagttcatggaattttaaaatgaagtaatattttataaatttttcagttttaatttctaatacaataaagtaccaataaatataacccacataacaaaagctctttgggattctcagtttttaagagtaaaaaggagggagctcaggcaaccaagaactttcaaaccactgattatagcttacaatggattgaaataagctgatcctcatgaaatactttagtttcttatttgaaaatctttatagaaacaacacagaggaaaataattagtatctgctttcataatgctgagttatatttattgggcacttaatatgtgcctgacactgcactgaacaccgtacctatattatctcctctaacctttatcttatcctgcaacgtatatattaccttagttttacaaatcagggggctaaggcactggcgggtcaagtaattggcccaagcttatttaagaggtaagtagtagagctaagttttagacttagtttaagttgaaattgaaagcctgcgcttttcatcaggatgttctgctgcctcacagaaaagtttgtaagtcggcactgtgtccgcactgctaattgatccttagggaaaagtgcagaatgctgttgtctgaagattgttgatgcaaggttgagcagtggctgaagatcctgcgcatgttttctttttatcccaggtcacgtagtcttgtactgttttgtggagctggatctttagaaggtggttctttcagaacttcagaacagaccgtaactggaagactgtgggcttagtttcttatggttactagtagttagtatgtgaatctagctcaaggttggagagatttttcaggatggctgtagttcagttgtcgttgcttatgctagttctttcatttcattcaggggtatagaaactttagattgtctgaaaatgttattttcaggagttttcccattgggagacaaggaagtggggatggagttgaagtcaggtgaaggtgaagagaatagcaccattgccctgacccctggcttttgggttattgtgctgcaagcatcaggtgactgaaaaagcaaacatgaaagtagagattcagagaggggaagtgactcaacccaggcaccctgcacaggaacatgtgtcatcacggtttcagctccggacggtgagatcgcagtgtgttctcaggcccttgttaggattcttagcacaatagttgtttctgcttggtgggtttgttgattgagagcgcctcagaagcatttatattcacagtatcccacgtgccctactaactcaactttatattacatagacagctactttaaaattgtcttggtacatgtattttgaaatttatatgaacagctttatttacattatccattatactcctctattaaagaatatatgtatattttaattatacttttttatactcattcaactttcattgttttctccaaccttttttaccacctcagtggaaatggaaatgagagtacctgttatagcctgaaaagcagaggaaaaaaggtgtaactctttttaaggtttttcgtcatgtttaacttatgtgttattcccagatttttctccgatgttcatactgtctcttgaaaccagtcttcctttttttcagcactattgtggcctgtgtataattggtacttgtctttcagatttgtattctgtaaacaggctttgacggggcaaatttaaactgttgtaaagattgcctattcatttctaatacatgttttgtggtagaattgaattgctgattgtgtgaagggtttttgaaaatgagggacaaacaaaatgagaacttatgaatagtagcacagtaaaaaaaaatccaagaggaataagaccaccgtgctttcttttttcacttctgaactagtcaatagctttgtattctggtgataattaacaaggtttctatacatacacaaaaatgaggggtagtgagatttagatgatgatatagagaatgaagatgggaaaaaatcctcttggtattaatacatatggtataggtacagagtgttcctttatgtgtataatttgaaaagggtgagggagctccaaaataagataaggaagttggtagactacatgttttgttaattcttatgttagagtgccttctcctggtgtggatgcatttctaagatgaatagttaatttgttcttgtttctttttcaaagtctctttgagcaaatgacaaattgagatgtcctagctttaaggagagaccattgacatttgcctaatgccttctcttgtcttaggctttgccttgtattaaagaagtatatgactggatgtgactaaaatggtctgggaggagggttagtattctgttttctaaaatggattctgggattgttatatgcaattggtgctttaggatgggagaaaatcacctaagtgtaacttcagaatgtgagaaagtgtgacctgtcaactgttttggttgggttttctatgttggagtggtttgtttcttaaattttgctctcaggtttggggtggtagtgaagttactctgaaaattcataatttttctataattagtaacagcatcccaggagtttcagagggaaatacctttaaaaaaaaatgagatgtgacagcacgctgccacgccgacgcagaccccgctctgcacgccagctcgcccgcacccctcatggccacagttcagcagctggaaggaagatggcgcctggtggacagcagaggctttgatgaatatgtgaaggagctaggagtgggaatagctttgcgaaaaatggacacaatagccaagccagattgtatcatcacttgtgatggcaaaaacctcaccataaaaaccgagagcactttgaaaacaacacagttttcttgtaccctgggagagaagtttgaagaaaccacagctgatggcagaaaaactcagactgtgtgcaactttacagatggtgcattggttcaacatcaggagtgggatgggaaggaaaacacaataagaagaaaattgaaagatgggaaattagtggtggactgtgtcatgaacagtgtcacctgtactcggatctatgaaaaagtagaataaaaattccatcatcactttggacaggagttaactaagagaatgaccaagctcagttcaatgagcaaatctccataccgtttctttttttttttttttcattactgtgttcaattatctttatcccaaacattttacatacagctatttcaaagtgtgttggattaattaggatcatccctttggttaataaataaatgtgtttgtgctaataaaaaaaatgagatgtgtatattgatgattatcttttaaaaaataatgggaggtttatgagagagctggtgcacttaaagcctggtggttcagtacgcataacccctagagctcagttttcatggatcaaggcagatttgtaaatagaagaataatgagtcagtatggtaaatgtcaatgggaagattcgaatgaagtgagatgggagcacagaaggatggagcaactatatttgctttgaggagtcaaggagggaaggacattctaaaattttgagagcattaaagaataggttactcttttataattgtagagtttattgtactatgtatttgcataaatggacacataatatttagttaaatacctctattcattgtgcagtttatgtttagcactgtgccaggttcttggggaaggagttaaaaaataaaagatgtcctgtttcagtactttcttgggagtggggctactatgtgaacagcttgagtaacattttgttcaagactcagttgtgggtagccaggtactgtggtggactggtgcttttgttaagtctggtttttttcctccctgctggtaagccactttagaaatgatcagtttcattaatgtaaagtcatattttatacctctacgcactaattcccgtggacatgactggtagctacgataatttttgggactccagtggtcaatgagtatgtctcaggtacttaatttcttccatggctaactagtttttagtgggcaaaaggaaatttgagagaagctgcataatttgctttaacttgcagggtgtgttaagtattgaatcacatctattatgattatggaattttggtgtgtgtttgaatgtcagagatagtgttaaggtcagaattctgctgaaaactgacccatctgaaaaccagtatgttcactccattccactcttcagcaaggccatagtttccctatcatggttcatttctccttttccctgcccattaaaggtagcaaattttggaggttcttacacatttggggttcttaaaattgttctgtaatgtgtaagctcggctgtccacaaatgattataggattgacatttgttatttggtggagtttgatatattagagtaatataaatgtgttatgcttcaaaatgaaatacgggatttttattcactagtttgtctttgtttcattcctttccaaaagaaaattaatgcttaacttgaacagctgattttttgcattgtttcccttaaaagcttgctagcataggaacaaaaggtaacttttttctttgccttttattgttttctgattgtttgatattaagttttggattgatattagaaatattaatagtttatcctaggcaggagccagctttctttaatatgtgccagatgagcttccagtagtttttagactttgagattttagaaacctcattttcagggatgggtgacttcactgctttttctttgtcttaatttaaaattggtatgtatgaccaaaggaatctttctgatactcactggtcctttttggtggaatcgaaatagcgtatgagcaatgggcgtttaagttagaaaatattcgtttatgtaaaaattaaccagaaattactggaatgtagtattggtcaaggttgtagagtcaagttaatcagtatgattaatgggtattaggaatggaaatgttgcaatgtaatgacaagtcatgaattgttaaaagaacaatctgttgttagcccattgataaactttgtgagatacttatttgagagcaaagtttgaaatctttcttttgccgattaaacatgactgtcattttgccattttctgctgtattccaaccattacgttctaagtgctcatttatcctcaccaggagccagtgaagaaggcgacattattctagttttacagatggagaaatgcagcttatgtattaagcagctgatcaggcagcacaaaaccaaggaagttattagtactggtaattgaacctagatttgtctggctccagtccagtactgtccagtagaagtataatatcagccactaggtaatttaaaatttcctagttgctacattaaaggagaagtttattttaatattttaattcaatatataaaagttcattttgacgtaattataaaattgagatattttacatttttacattctttttgtaccatcttcattatttattattattattattatcattattattattattattattattctgagatagggtctgtccctgttgcccaggctggagtgcagtggcaggatcataggtcactgcagtctcaatctcctgggctcaagggaccctcctgcctcagcctcccgagtagctgggactacaggcgtgcgccaccatgcctgtctaattattttatattttgttttgtatagacagggtctcactttgttgcccaggcaggtctctaactcctgggcttcagacgatcttcccatcttggcctcccaaagtgctgggattacaggggtgagccaccatgcctggccttttgtaccatcttcaaagtcagtgtgtgtattttagatgtatagcacatctcagttcaggctggccacatttcttcaagttgaaatgtggctaacccaaattgagatgtggctggtggctctataatgggattgtgtagccctgatacctgtgcagtggccagtactataagcggtaaagaaaccaagacttcggttttgcatgttgttgaattatttaagcttgtagcatataattatagccactagtttaataaaatcagtcatgacaaaaagtgataaagtagccttgtcataatgcaaatatttggttgtctttcccatatttacaatttttacttctctgaacaggagatgatgtaggttaaaataaaatatttaagtagcatttaaaaggcaaataattgcatttagtctagagataaggaatcaatcgcatagttatcattaataataaagaccacaagtggctaagaccactttaaccacaaaaaggagacagttgaaatattgtacatgggtttaagtatagataattaaattcagcagtctgcttatagtacctgctgtgtgctgggcattgtttagatgttcagatgttaaaataagaaatggattctgtgctcaaggatgccacccttaagggtttaattagagccattatttccagaaccattaattagaaccattatttccagaaaaatttggtggtgatgggaagagtctttgtatatttttgaacattccacagtggacactgtttgctttaagtataatctttgtatcatatcatcataggatttgtaaaattttcaaacttctttgcaagtactttgcaaacttctttgtatgcattaaaagaatgcgtggttctgagagatttaattatggcagcctcagggccactttataaaatgctctccttttgatactctgtgagttgccattatgttgccccatttctattcctggtaaagactcaccgatcatactgatgaacttgatctgcattttggactgagcttagtcatacaagtaacgtggccgctgatacattgtgtatcattctggaaaacaattgtatgtcactgttgacccggatatttttatgtataggattgcttagttgcaagatagatgaaaatatagttgcctaatcatttaagagtgaaagattcttggtattctagtttttgggttgaggagggagaataaaaaattttccaagtttagtgagtttttttgttgggggatggagagggaatgtagagagatggttaaccagtatttatgtctcatttcaaaataatgacagctttttttaaaaagcttgaaagatagtatatgccttttgtcagtaatcaacatatgtatgtaatctattctgttgataaatgtcaatatctaaggataagtagggcacagagaagggaaattgtgtacctcattttctctgtaaggctgtaaagagtgaagagggtgagagaaagaaggcacacctttcatattcatctgtcatttctagaaggcttaagtgtctgaatctgactcttgttttttttttttttttttttttttgagacggagtctcgctctgttgcccaggctggagtgcagtggcgggatctcagctcactgcaagctccgcctcccgggttcacaccattctcctgcctcagcctcccaagtagctgggactacaggcgcccgccactacgcccggctaattttttgtatttttagtagagacggggtttcaccgctttagccgggatggtctcgatctcctgacctcgtgatccgcccgcctcggcctcccaaagtgctgggattacaggcgtgagccaccgcgcccggcctttttttttttaatctgactcttttaacagtattctgatagagcagcgatggcttcaagacgtagactgttgtcacttcttttgtctgctgagctgcaaaacagcttcttgggatatctggcccatgactttggataggattgatggcttccctagcccagtctgttcattcatctttggagttgatttcttatctttcctgcttgaaaagaatggatgcagggtatggtatgattctgattatgtttttattcaatatgaagcaattagttgaccataccatgagacagaaaagacaaatactcattgaaagttgatacttaaaactcttaccctaattgggattaggaggaagagtactttatttcaccagagaataatgccagaaaattttgctaagggtaaaagtgtggggaccattttcgaaggaggtcaagagctagctattttatgtaagggaaattatctgaatgggatggaattataaggaaaggaagctgaaatattgaaagagaatttcccccaatattttcttaaatgtgggctattactttttcattggaaaaaatttaaaaggactacattaaaaatgagaatacttaacaggctgaagtaggaggattgcttaagtccaggagtttgaggccagactgggcaacatggcaagaccgtgtctctctaaaaaaaaaatcggaattctgcattttaaggagtgtggttcattcctagttatagattaggacagttgaattatgtgaaggtctgagaactatttccaatatatagacttttattaaacaaaggtatagatggatgatgacttagaaatgcaggcggtgattttgtttcatgcctagtttctcaagttttagaaaatggtgacagtctcagagaaaacaagcaactattttgtgaaatctccaggtgtcaaaacagtccaaggcacatataattagaataaattaagggagaatgttgctttagagttcttgtggtgcactagtcattcttaaagggtgagcaaggcaaaaactaaaaatagatggaagcttatctgcacatttgaacttgtggaacagctggagtgggtctcttactcccttactcttcctaactgaataattctccctctctggttatttgctgtattgagaaagtcttcactggctctcctggcgtttttgagaaggatattaaaggggcttgaattagagcacaggaagtggaataaatggcaggaaacatttgatcatttctgtcactgtcagaatgaaagcccaatatttgatttgagaggttgcaggacagtagcaaatgttttgatgggtttgtgtgtgcgcgtgtgcgcgcgcgcctgtgcacactctcaactttgtatctttttttttctttgcccttctctctaatattcactcttgtccagattttcataatataattggaagaagcaaaggcccttcctcctctgttaatgagttacaatctttcacaggtccaagaaaggcgacagaagggactttctactttgtagacttattattgtttttcattttctactaaaagtttattttcccatgtgctgtttttcggtgtgtatgcattgttaactgcatttccaccatgttgcataaggaacatttgcaatttggtttataatgtcaccattcgtgctccataagggaggtctatactctatctctcatatatccagtacctaaaactcactgcctggcacttaagtaggtgcttcagtatatgtcagcattccaaaggtctttgttactgtaaatagagcattgatgtgaatagtacagatgatggtgggctctatcatgatctctcttggcagggatttatccagagtcatttgaataattaccatgtaccaactagtatgtctggtcctgggtatgtacgtatttaggacctttagagagcttatatgttggtaggagaggacatactaggaaaccaacaattacagtatgggggtgctgttacgagatttgaggtgtgcattagagagcagagaggaaggctacctgacccagtttagagtgagttgagagaattaggggattgtttcatgaaggagatgatggttacatgatcatgttctgtaagatgaggaagagttagcagggaaaaggggaggaaaggcttggagccctgagaaaactttgtccttatgttggggaagtactctgttcagttttcaagttatgcaccattttgactaatctttaaggaagtaatgtaattggttagtttggacttttctcataatttgaacagaggttttttgttttgttttaataatggagcagtttaagaaagaacttaccttgtttaccctaccctaaccaaaccaaaccaaatgaggtgttgcatccttctctgtgcatacctgcatatgattttaaattaggaaagaaaaaccaatccaactctcttgtgaataggagttgctgttagtgtacagtttcttattttggcagcaaacccatctcagcaatgcagatgttctgcagtaaaataggtgacttattaatatgatattttctggttgtgaaaaacagttgcatggccagtatagaagtgacctatttgaatatagtacaatattaatctgcaggcatgcttcagagatattgtgggtttggtttcagactactggaataaagtgaacattgcgataaagcaagtcacacatgttttttgtttcccggtgcatatgttttgtttatactatgctgtagtctagtaagtgtgtgatagcattgcatctaaaactgtacatcccttaattgaaaaatattgctaaaaaatgctaacaatcatgtgaaccttcaacaagtcgtgatctttttgctggatggtcttgccttgatgtggatggctgctaactgatcaggtggtggttgctgaggattggagcagcttaggcaatttcttaaaataagacaacagtgaagtttgctgcattgattgactctccttgacaaaagatttctttgtaacatgtgatgctgttggatagcattttgcccacagtagaaactcatttcaaaattggagtcactcctctccaaccctgctgctagttgatcaactaactttatgtaatactgtaaatcctttgttgtcatttcaacaatgcacagcatctgcaccaagagtagattccatgtctagaagccactttctttgctcattccttaagaagcaacctgccatctgttcaagttttatcatgagattgcaggaattcagtcatatcttcaggctccacttccaattctaattctcttgctgtttccaccacatgtccagtgacttctcccattgaagtctggaacccctccaagtcatccatcagggctggaatcagcttcttccaaaactcctgttaatgttgatattttgatgttctcccctgaattgtgaatgttcttaatggcatctagaatggtgaatcctttgcagaaggttttcagttggctttgcccagattcatcagaggatggatggcaggtctaggattatgaaattagtttcttaaatcataagacttgaaagtcaaacttacttctgggtcagtgggctgaagaaagcaagtgtgttagcaggcatgaaaacaacattaacctccttgttcatctccatcatagctcttgggtgacccaggtgcattgtgagtgagcaggagtcttttttttctgggcagtaggtcacaacagtgaccttaaaatattaaaccatgctataaacagatgttctgtccaggctttgttctagttacggaaacacagagtagacttagcataattcttatgggctctagaatttttagaatggtaagtgagcattggcttcaacttaaagtcatcagctgcattagcccctaacaagagagtcagcttgtcctttgaggttttgaagccaggctttgactttccctctctagctatggaagtcctagatggtgtcttcttccagtataaggctgttttgtctacattgaaaatctgttgtttagtgtagctactttcatcatttgtctagattgtctggataacttcctgcagcttctgtgtcagcacttgcttgtttgtagtgcacttttatgttatggagatagcttcttgtccttaaacctcatgaaccaatgctctgctagcttgctagcttttcttctgcagcttcttcacctgtctcagccttcatagaactgaagagattatttagggccttactctggattggcctttggtttaagggaacgttgtggctggcttgatcttctatccagaccactcaagctttcatattgttaatttgttaatagtaataaggctattgtgctttcttattatttatgtgctcactggaataacacttgtaatttcccgcaagaactgttcctttgcattcacaacttggctgtttgttgcaagaggcctagctttctgcctgtctcagcttttgacatgccttccttgctaaccttaattatttctagcttttgagttaaagtgagagatgtgtgattcttcctttcacttgaacacttagaagccatcatggggttattcattggtctcatttcaatattactgtgtctcagggaatagggagactcaagaagagggagagagatggggtagcagcaagttggtggagcagttagaacatacacaacatttatttagtttgctgtcttctgtgggcacagttggtggtgccctaaaacaattacaatagtaaaataaaaaacataaaagatcaatgatcacagattaccataacagatataataatgaagatgttcgaaatattgtgagcattaccaaaacgtgacacagaggcatgaagtgagccacatgtgttttggaaaaatggtgctgatagacttgcttgatgtagggttgccacagaccttcaatttgttaaaaatctctatctttgaagtgtaataaagtgaaatgcattaaaatgagatatgcctgtattcaggtttattatttatttttattgagattacctttttgttatgtataaaaagcctggttttaaattacagttttctaggtgtgtttatataagataaagccttttggttcttggaaaacagttttgggaatgtcaaactaattttttcattttaagattcctctaagaacttatactagaggctggtcctggtggctcacacctgtaatcccagcactttgggaggccaaggtgggcagatcacttgaggtcaggagttcaagactagcctggccaacatggtgaaacctcttctctaccaaaaatataaaaaatcagccgatgtggtggcacgtgcctgtaatcccatctactcgggaggctgaggcaggagaatcacttgaacccaggaggtggacattgcagtgagttgagattgtgccactgcactccagcctgggcgacagagtgagactctgtctcaaaaaaaaaaaaaaaaaagaacttacctcagttaggacttaattatcctctttgcattactgtgggagttagggcaagacttttttgaaagtactgttgttaattgtggggtagataaatttccttgagcagatgaggtttttggtttttaaaaatagcccaaaagatactcagaaacaagatcggtttaaaaaaaaaaagagtcattatcagattgcgaagtatttgttttatgtgaagagagaaaataagagacatctataaagtaatgcctttctaatgctatttttgaagattcttgtgaaaaagaagctccaaaaatacttgagcaatggcagtattggtgaaggactaattcatccagacgaactttgtataggataatccttggttcattctataatatccagttttggctcttaatcaggattcatgttatggaaatcttctttaaaatattttatattggtttagtcattaatactaatgggtccctcacttagtctaaatgtaaggtgtcactgtattacgagaccttgaattaataagccaagtgctaattaggaaagttgacaaagaagcagtgttcagccactggggcaagaactcagtcatctcccattgtgcgagtgagcctttactgtttagtgggctctgtgattactgtctaggatcatctaaaacaaaaataggtagaaatctaagagaatgagtttgtgtgtatgcagattcacctgaatattgaggtagcacagtctgtggataagtttttgtttttttgtttttttttgggttataactgacaattgcgcatatttaaagtgtattttcacatgtggtcttataaagaaaaccaaatgatcataaaaatgtaaatgagagaaaatattcttagttctcagtgtcattcaggaaaaacttgttggaagatggtatgtgatagttgttgaggtttatttgtctagcacagtttctactcagttactttgtcatttaagatcctaagtacagagagattctagccactaccctatctctctgtctgcaatgttttttaaaagacagtgcagtgcaatgtattttctgatgatatcctttccttcataaacatctctaaagaattatttccatgtaattcttgtggccatcattggtatgtagttgtgttgactagagattttaagttgtatgtgtctgaagtactgtttccacacaacctccttagtattgttttgttttgtttttttttttttttttggggacggagtctcacactgtcaccggggctggagtgcagtggcgccatctcggctcactgcaaactctacctcctgggttcacgccattctcctgcctcagcctcccgaatagctgggactacaggcgcccaccaccacgcccggctaattttttgtatttttagtagagacggggtttcaccgtgttagctaggacggtctcgatctcatgtccttgtgatccgcccgcctcggcctcccaaagtgctgggattacaagcgtgagccaccgcgcccggccttagtattgttttctggtttataagaattgaaaccttgctcttaatttgtccaggtcttctgcctgtattctgctttcatgggaataaacaacactagttactagaaattttgagatttttttttctccttccttctcctagtacatgatgttttgagaggcctgtgtaatcctaaacgcttgatagagcacttttatgatgggagtatgagtagtatgcaagtctatcgactcctctaggcaagtttgtagttgtgtgtgtgtgcgcacacacacgctttaaaagtaaaacattaaccatgtatgtttggtaaatgctagactgtagttttaaaactggaagaaaccgttgaaagtatcttgtcaaatttgttcattttattgatgaggaatttgagggccaaagaggcaactctgatgaggccaattatagaattaattctaaggacctgcatttgggtctacaaaaccagttatggaaatatagatgaaggaagtcttggtttaagtggagcttttagttgaccataataagcttatgttagtcataagtgacatggctgtcagagttgctaagttgatcttgaattacaataataaaagtatgtcaaaacaaggagaaaggggtagcctgttagagaaggcaacaacagcagaatatttgaagtatcaaatgtggttagtcctggatcaccagttttcagaggaacattgatgaactggagcttactgtccaacttacactcctgagaactatttgaaaccagaatctcccaccaggttctccaggtactcactgtacctgacttcaagtgttcttcctggccacatgaacaagtctggttttttgcctgtttttcttaatgtaattctcttgcttttcctcctgtataaagatcacagtgacacctttactttcctaggcatgatcaggccatggtacctttattgactgattgattgagacagagttttgctcttgttgcccaggctggagtgcaatggtgcgatcttggctcaccgcaacctccgcctcctgggttcaagtgattctcctgcctcagcctcccaagcagctgggattacaggcatgcgccaccacacctggctaattttgtatttttaatagaggtggggtttctccatgttggtcaggctggtctcaaaccctccaccttaggtgatctgcctgcctcggcctcccaaagtgctgggattacaggcatgagccacctcgcctggccttacccttatttaaagctgtgaaggctggaagctgtttcccagacttcttgccaagtttggcctgaagcctcagaatacattttctccttgtttttcaaagtggctgggggtttaaatgatcatttgtgggtttgtacccatgctactaatgtcttgtttctaacaaggacatataaaatttcttggccttacactcacgtttggctttctggtgatcttgcatatcagagatggtagctgtcggtagtgctgtgggttgtctacaggaaaaacaaaaatacccctgagaaagcacacagttaaaaatggtattggaatgaccatccactacttttctaccagataatcattattttcattatcttaccttctgagtttccacctggagaggaagggaactaatctttattgaacacttaagatgtgccagacaatgaacaagtgctttacaatgtagattttgtttttccttaccttatagtggtgttcttaccccacttacagatgaagaaactgtggtacatgcataaagtaatgttatatagctagtgaagctggaattcgaattcaaaatcttgactgaaaagatcttgtttgacttttatgaccacaaaagacaaatgatattactctcttatttagaatggcctaactactaccatttttctacctaattatttacttttacacctcttgggccccctatctgttttccctggcatattttcttgagttcttaattatcttgagttcctaatttggaatcatgtattacttctagcagttttctcagataatctcctttcatttctctcgtgcaagactaatggtccatctgggagctgtttttcagggtagggaagagtcagagagaggcctgactacctctgtgcagcaagggaagcgattccctaaactatttcttaaaattctatcttgattggactaattttctgtattagttgaatatctactatagtactctttgttgacatgatttggtcctaggtgcctaagaaaatagtaacctccctctggccttcaggaaatttaggattcggtttgggagttaaagtgtgcacataattggtgagtatgataagtgccacaaggccatagttcaaccagccaaccaaccagccaaccaaaaaccaaaccattggctgttcagagtggggaagagagcacaaatctgcatagttataacagggaggctattctcagtcctggctctggatgagaatatcctggcgagattttaattcagtaggtgtagggtggcgcaggaatctgtgatgctgatatgcactgggatttatgctatcaaggataatcttttatttctttagttctccaaagcatgtttgtttttatcttttgaatattcccttgcattttcccctgcactttactctgaagtgggaataatggaacttgggtgcctgttggctgattcaccatgtttagttagtagatctgtgaatgtaatctttaatggatttaggcagaatgtccaatgtggaagtaaattcagtctgtcttggaattaattgtagaatgtagtaaagtagccttcatttatttgcatatcttttggactaaacttctgtatttaatagaatgcctcgtcatattctgtaaagtctcattaatatggagcctgtaatttaaatctgtattttggaggcacactgaggtaaagtttacccttaataagggcaccattgtttactataatgggctaattacatgtcttaatcattgtagcaggttgaatacaacctcttcttggcagtgttttactggctcctactttcaagttattttctgccttatagtagtaaaaatttagttagttaacttgtctttcctaagcatttagaaattagttgaagttgtaaacactgttagctgaatagaaataagctgacactttctcttcaattgtagagagagattatgtgacttaatcttcccatcagggggatgtgagtgattggaatgctagtggctggcggtgggtttgtttcttaaaggctatatgttgtacttcactgaaccacctgtacagctaagctgtcttgaagttttagtcattcctactcttgtggttggagtgatactgtgggtcttggtagcgtttctgccttttgttctaacatgtcagacagttactctttggccttcttcattcttatcctaattgtgtataacaactagcatttgaatacctaccatatacggggcgtcatgcttgctggccttatgtacattggcctaatatttataatacctgtgtgagtagtgctgttgttatccacattttgcaggtgaaaaagcaaggctttgagggtttaaatacttgtactaggtcaaagagctaacaaatgaaaagatcccacattcaaatccacacatgcttttagaacctgtgtttttagcttttatctgttgccccaggaccaggccagatcatcatcatcacttttctcttttccttatcaagttggtaagcggctgtaggttgttctggtgataatgagagataaaggtcatagttagtgcataatcagttagcattttaaaaataatcgctgctgcattgtgattccagagaatggaataaccataaatgtattacttctcagacattcacagtgatggtgtacaggatcatgctcactctagggcaagcaacattataacattgtttagaagcctgatttgctataaattgaggaacaaggtgtatcaggaaaatctaaaatatccctttgattatcccagtacagtgattacgaacttaaggctgggagctgaactctttacattcataccttagctcttccagctctgtaactctaggcaaattatttatgctccccacacctcagttttctcatgtgtaaaacaagggtagtggtagtacattctttaaagagattttataaggatgaattaagacaatgtgaagaacttagcagagtgtcttatatataccaagcttcaaatattgctttactatcttgagttaataggaaaatcaaagaggtattaaatggagagtggatataaaagctttgaggtgaaggagtggtcaggtgatgaggtgctggttaccttgccccttagtgtttagctgatttgtgttggtggtcctaaagtcaactcttcccagcttttaggtagtaacttcaagatgtaagtaaaaatcctaaattctgaaatattttaaaacattttaaagtggtttacattttacaatattcttgcttgtaggcaatatgaaactcaattagatggtaaaaaaatgattaccagattctttagcagatcaactctacgatataatctgaaagatagagttgtgtgcttacgtgtttttatttatttggagaggttcaggcgaaagaaatgtcaacagtggtacagttacgtacccaaatgaagagttgctgtagttgtgcagatctgggatttggtgtatgaaaaagatgcctaatttcattgggaggctgtttagatgagaggcactttccaacactgggattctatttttttgggtgttgaatgttacataccagattagttctcatttctttttttttagaagaatacgtattttagtctaagaacaatggaaaatagctttctcttttagctatttcaactcaattctaacctcattcctaacttagcctaactctatagtttattttggctgcaaaatcctgcccactttatcttctataaaaatgtatttttccttcaatgaggggaaaaatgcaagctaacatatttattttggattatctttttaccccattattttcctaatgagctctgttcatgcctctctgcaaatcttaaaaaaaaaaaagtcgattcagtttgaggatagctgaaacattttttatgcagaaagtggtttgtaaaatacgggagaattctactgaattccctcttagagcatcattcagtagtagcttactggtgataaagattactattgatgtctttactattctgggaaagttttaaagtttacaaggagaatgttagaattcagtatataaaccaggaaaaactttactttgttatctgaaaaagacctaagtggatataaggcctcattataccactcaattttcattcacttcgcaaaattgacttttatgaagctaatataatacaaggtgaaaaaaatggtccatgatcctggcagtgttgctatggactaatttccatcactttgagtcatattactataaaagggcagaaaacactgggggaggctcttagcagatttctaactactttgtttactttggttgatagggagtttgctgtcatatttttgaaaggtggtggtggtgggattgtctgctatctcctttctctgccacctcccaggtatataggtgatggttacaatttggaaaatatagaaagaaaaaaaaatatacaccccattaccttgagatacttaacattttagttttcttcttgcttttttctctttcttacatggttttaaaaatagtttttaaaatattaaatcatataccattattttctcctttttcccccctttaacactgtgttcccttctgtacagttttttttttttttttttttttttggagtactgtttttaagggatagcatcattttgttctttggagctatcccatttaaccagttctctgttgttagacagcaacgtcccccctccaaaacaacttttcctctcaattccaacattatttccttatgataaagtaaaattactggattaaagtttgaacgttttcaagtatcttcatatataaatgtgttaaattttatccaaaatgcttgtgaccacttcttatttcattcccatcatctaagtatgggagcacttgtttctccacgtctttgtcggtagtgggcattttcgctttcctacactttttcttcgatttctaggtggaagatgataccacctcacattcagtgatacttagaaatgctgtgaatgcctagtcagtccacaaactccttagcctttgttttttggtttaaacccaattctggggacttcctgatcatcccttcttggtattagctaagcttcctaaacacatggatgtttgtgtaagattagtatggtttcattaaaaccaggttgtcagccagatgtggtggctcacgcttgtaatcccagcactttgggaggctgaagtgggtggatcaccgagaccagcctgaccaacatggtgaaacccctctctactaaaaatataaaaattagttgggcatggtggcgcgtgcctgtaatcccagctactcgggaggctgaggcaggagaatcacttgaacccgggagttggaggttgcggtgagccgagattgtgccattgcactccagcctgggtgacagagcgagactctgtctcaaaaaataaaaaaataaaaaatagggaggagccaagatggccgaataggaacagctccggtctacagctcccagcgtgagcgacgcagaagacgggtgatttctgcatttccatctgaggtaccaggtttatctcactagggagtgccagacggcgcaggccagtgggtgcgcgcaccgtgcgcgagccgaagcagggcgaggcattgcctcacttgggaagtgcaaggggtcagggagttccctttccgagtcaaagaaaggggtgacggacgcacctggaaaatcgggtcactcccacccgaatattgcgcttttcagaccggcttaaaaaacggcgaaccacgagattatatcccacacctggctcggagggtcctacgcccacggaatctcgctgactgctagcacagcagtctgaaatcaaactgcaaggcggcagcgaggctgggggaggggcgcccgccattgcccaggcttgattaggtaaacaaagcagccgggaagctcgaactgggtggagcccaccacagctcaagaaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaaccggcagactgcctcctcaagtgggtccctgacccctgacccccgagcagcctaactgggaggtaccccccagcaggggcacactgacacctcacacggcagggtattctaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacggaacaaagctggatggagaatgactttgacgagctgagagaagaaggcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaatgaaatgaagcgagaagggaagtttagagaaaaaagaataaaaagaaatgagcaaagcctccaagaaatatgggactatgtgaaaagaccaaatctacgtctgattggtgtacctgaaagtgaaggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatacttcacagacaagcaaatgctgagagattttgtcaccaccaggcctgccctaaaagagctcctgaaggaagcgctaaacgtggaaaggaacaactggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgcttcaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcagcgagacagaaagtcaacaaggatacccaggaattgaactcagctctgcaccaagcggacctaatagacatctacagaactctccaccccaaatcaacagaatatacatttttttcagcaccacaccccacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaaaatgttctttgaaaccaacgagaacgaagacacaacataccagaatctctgggacgcattcaaagcagtgtgtagagggaaatttatagcactaaatgcccacaagagaaagcaggaaagatccaaaattgacaccctaacatcacaattaaaagaactagagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcaacacatacactctcccaagactaaaccaggaagaagttgaatctctgaatagaccaataacaggagctgaaattatggcaataatcaatagtttaccaaccaaaaagagtccaggaccagatggattcacagctgaattctaccagagacacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccgccatgatcaagtgggcttcatcccgggatgcaaggctggttcaatatacgcaaatcaataaatgtaatccagcatataaacagagccaaagacaaaaaccacatggttatctcaatagatgcagaaaaagcctttggcaaaattcaacccttcatgctaaaaactctcaataaattaggtattgatgggatgtatttcaaaataataagagctatctatgacagacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttaaaagggatgtgaaggacctcttcaaggagaactacaaaccactgctcaaggaaataaaagaggatacaaacaaatggaagaacattccatgctcatgggtaggaagaatcaatatcgtgaaaatggccatacttcccaaggtaatttacagattcaactccatccccataaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatatacaactatctgatctttgacaaacctgagaaaaacaagcaatggggaaaggattccctatttaataaatggtgctgggaaaactggctagccatatgtagaaagctgaaattgaatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaataaacagctccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggatgtcagtgtggcgattcctcaaggatctagaactagaaataccatttgacccagccatcccattactgggtatatacccaaatgactataaatcatgctgctgtaaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacagtgagatcacatggacccaggaaggggaatatcacactctggggactgtggtggggtggggggaggggggagggatagcattaggagatatacctaatgctagatgacgagttagtgggtgcagcgcacgagcatggcacatgtatacatatgtaactaacctgcacaatatgcacatgtaccctaaaacttaaagtataataaaaaataataataataataataataaataaaaaccaggttgtcactgaaaagttaaggaagcatttggaaattactgtaaaggaaaaagaacacctaacaaagctttcagtgttggcagtgttctgtgcccaccctttatgtatttagcaattactttagctgaaccagtttgttcatatagaagaaccagtcagaatgtctctgcccttcccttcctctaagcacacacaatggtcatctcctccctttgccttttcttttgaccatgactagcaggtcctcagctagcttacttgttatagacttgttcacacaactttatagctctgtttctgtcaggcatatttctgttttatagatgaaaactttttcttaatttaaatttcccttttcctggaatttattcatgtgttctgaaatgctgctgttattgtaacttactgactgtattgtaaattcatggattttatctgggaggatcttgactttgatactgaagagctgatgcaaaatcttaaacaggccgatgaaaaagagcttgtcaaatagataaaggagctttcttctttctatattcatcagtaaaaaatgttctgtctaggatttgcatagatgactcttttcaaaatcagttttcacctgaggtcattcaggtacctaaaagggaggggagtatctaaacagtgacaaagttgtcaacagggcgttgcatcaagttctcttacacactttcctttttgctatgaaagctgctttctcagagccatccagttactcttgtcatatatgcagtttgaagaagtttacttctgcctcttttttctcacctctaccaaggtaatgatgaccatttagaagccaaggattaattttgggaatggcttagtgtggtggaaatttttaaaaaaattctgcagtggcttaaatagtgcaagtagatttcactgtagggactgatatagcagttataagagcccacggtttgaaagcaagagaaactctaaaaaaacaaaacaaaacaaactgatgtcattggtgtcattcgaaggtttacacatttctgttcacttgaggtcttttttgtaattatgttttcacatatgtagatacctaggagtggaattgctgggtaacactgttttccaaagtggctatacattttacagttcctccagcaatatatgagggcttcagttttccacacattttgccaatacttggtatttttaatcttttttttaatggccgttctggtgggtgtgtattgataatgaccaataatgttaagcttttttttactgttcatatttgccatttgtttattttctttggtcaagtgtctgttcaaaccttttgcctattaaaaaaatttactgtttttgtattgagttataagagttctttatatatcctggatataggccctttattagtttatataattggtaaatattttttcctagtctctgacgtagagtcttgtcttttaattttcttgatggtgtcttttgaagaggaaaagtttttaattttgatgaaatctagtgtatcatgttttcttttatggatcatacatttgttgtcatatatctaagggatctttgccttagccaagatcacaaagattttctcttatgttttcttgtagatatttcatagtttattttgtaagtttgtatctgtgatccatatttgggtttatttttgtgtatggtgtaagctagggtataagttcattttttgcatgtggatatttgcttgttctggtgccatttattgacaagtctcttaaaagttttttttttctgttaaactgtattactgcagtaaatagtcttacatatgctgtgaacacacgccttcattttctgactgaattgggagaagagggaggaaaggagtttgtcttgggtcttggccttattgtagggagcttttctatcatagttcactttgctttattctgccctttaagaagatattcacagtctttgggaacaacgaatagagttctggtcaatttggctttagttaagaaggtgactctgttatcctctccctagggatgattatgaaatcttattttgcacagttagggctgggtaagcctaggatagtacaagctattggacagaacatttgttaaaaatatttttaggctgggcgcggtggctcatgcctgtaatcccagcgctttgggaggctgaggtgggcggatcacgaggtcaggagttcgagaccagcctggccagcatggtgaaaccccgtctctactaaaaatacaaaaattagctgggcatggtggcaggtgcctgtaatcccagctactcaggaggctgaggcaggagaattgcttgaacccaggaggcggaggttgcagtgagccgagatcgtgccactgcactccagcctgggtgatagagcaagattctgtctcaaaaaaaaaaaaaaatatatatatatataatataaaatatacatatataatatacataatatatattatataatatatataatatatattatattatatataatatatattatattatatataatatatattatatatatatttatttctagcatgagaatgatgaaactcttcttaaaacattttattttctttttccaaatagttgtttctaactataaaactaaaacatgtttattacagaaacgtttggaaattaccacaagtatgaagaaaaaactttcttcccctatcattgccatcctgattttggctcagcaacacttttaattttgtgcaattgaaatagggactctggaccacttagtttcttggaataatttttggatctactgaaggattcaggccttttaaaaaatatttctcttgagaagggaaaaggatgggaactcacatttgatgagcatctattgtgagctaggccttgtatcccagaaagctctgtgaagcattaaaattacattaaaatagcatgaaaaatttgtttcctctcttcatcctccctaactccctgctttttttaggcttgggttaaataatttgcccagtgtcactcagctagtatgtggtaggtttgaaaagttggggaaaacttaagtatcattcagttaaaattgttaacctgtgtcttatttcatggtttaagaaagatagttctccccccaccccccaacacagttttctggcttctgtggtcttccttttattttctatcagatttagaagtcccaagatccccttatgtcctactcaaattaagacttgtttctcttctcctttctgtattgtgctttcaactctgaggccctgttttagctttggtgtttattagctgaataaaaagataaagtgagagagcttagagttttaatagggaacatttcttgaattggattgatttcatcatcaattttactttcttaagtattaactaattactagctgtggattcccaggcaagtccactcactttcttcatctgtaaaatgaactacctactcagcaaggatccttctgtggtgtatcagcattccttattattattatttgtttttgttagtagaaccatgaaataaatttctggcgatatgggcacagagtatttgcagttgtaacacaatggtaagtatctatatctaaacatagaaaaggtacagtataaatacagcattataatcttatgtgaccgactgctgtcttatatgcggttcgtggttgactggaaagtcattttgtggtacatgactgtatttgcatttgtgtcagtgggtaaaaagcactggtttcatgtaaaaaaaaaaaagtgtgtgtgtgtgtgtgtgtgtgtagggtatttgtgattctggagcctgatttttccttcttcatttaggaggtatttatgactgtcaaggctacttgactgccagaacttgccattgatgtgctcacttcatcaaatggcatagcttattctaatctgttgtttattttgttgccatagtaacctttttgaaaacagaaaggtggttgatatgtttgtacaggaattcagggcctttcccctgattgacatctgctggcaggaatttttatcctagtgattcgggctaaggcttggggctataatgagtacaaagggaggtgggatatttggacagtttgaagcagacttctttatattaatccactctattaattgctaaattattttatttagtgatttagggctttccactcgagccagctacttgttatatgaattatatttattcctgacaggtgttatgcttgggttcaacatttagaactcaggctagagtggagcacgttgctgctacctcaggcttattcagacagacaaaatagaaaacaatgaaaggtggccccttccagatttcaccttagtacatttggactagtgaactaggatgagcaataaaaggtagttgaggaggtgtggaaatgaaatcctaaaggcaataaaaagtaaaatgttttcacatctcttattctagtgccagtgaacctttgacttggttgcagaacgaatctacatgggagcaagcagttgtttagagtaaaatctttgcacagatgtcttttcccttttcacatgttagaaaaattgggaagaaaatctgtaagtgaaatgccaaaaaactcaatgtaatctttttagaatgtctaagatggactacagaatcagtcttaatctttttcagaagacatggccacagaggcttttgtgggaaggggattgtaatttagttaaaatttagtgaagtcaacaccaggactctagcagcccttcctggtgaattaattttgttctttgtgtccttaagctttcctttttggacctcttacttcctggaggctttctctcctagcccctttgcctttgggtattctgttaccacaaaaggagttaactcttcatatggtacaatcatcatagctgttttgaaatctgttttttagctgagggaattaaggcggaaagaagttgcaaaggggtcatgcatgttgcttttccatttactgtattctcttaaagtatataatactttaaatgaactgttcccttcttttccctcaccttccatatgcttattcagtcaaaaagcccttatcctctgatctctgataagtactgggaaactatctgatcaaaaaaacctatgatcaaaacagttctttggaatgaatgtccttatctgtgtttaaaagatgctggataactcttgtgaacattcagttagtacagtttgtgggcattgttttgaggcccctacaataccaaagaaaatggtcagcaacttggcaccttaccactgaaaggggcttcatctctgaatttgcatttcgagagctcacagtgggagttacaggctttgatggtatcactggtagcccagagaaaactgactgatatgttctaattcttgagacaggaaagaaaacccatacatcttaggattttttgtaatcattgatgcataaataatttaggcaggaaatttagttatttaggatgttttgtttcctgaaatgttatttaattgtatttttctacccacttgtcatattatggaagtagtttatatgacagcgtgctcttatgagcagtcatttaattacatcttcctttggactttcatagcactgtgacttacctttattatagtacttacttacaaacttggagagaaagatgccaactgtctgtgaaaaaaatcagtctgtatttaattaaggcacaaacagagctaaaaattaaggcacaaacagagagagctaaaaattattcatatttttctccttgtaatggcactgtacttgatgcttctatttatttttaattcttaaggtaattttatttttaatttctatggatacataattgtacatttttatggggtacatgtgatatttaatacaatctacaatgtgtactgatcaaatcagggtaattgggatatccatcacctcaagcatttaacatttgtgttgggaacattctaaatccccccctttgtttaaaaatatacacttttttctatttattttgatttagttgtagaagtgccatggttggtgagcaacttggtattgctagagttgtgatggcagcaggaaataaaggtatagatagtgatttgggactagggagtttggctttaatgtgaagaaagcaagaagtccttggaaagatttgaccagagaattgacacatactatattgaagttgtggggcagttgaaccttgtgataacgtggaagatagttatgcttagaggcaaagacaacagcagggaataggtccaggagtgaggacaacgacttgggcagcaggggtggataaggagacagtgtggaggtaaacgaaataggatttgttgggaggcaatgtaggcagtgaaggagaaggaaatggttttatgagagcttgaggtgagaccgttaatgaggataaaggacaacgaatgagcatgtagaagatggattcagtgcagaacatccaaggggactaggatgtctagcaggcacttggcaattaggttatggagcttagaaaagactttagggctagagactcaaagttgagagtggtttgcctataagcaatagttgaaactgagagaatgggatggaaagatatttgttggatgcgaggacaatctggaattagctggtctggccaagtaaacatgccttttcgtcttccccgctttgcccagcccttctttttctttttcttttttttttttttttttgagacagagtctcgctgtgttgtccaggctttccagcccttcttaaagctctagtccaggctctgatgaagaggattgaatttaaaattcatcacacattgttaaacattatataaataaatggtgtgctcttaaaggcagcataaatatctgggtttcaccaaggaaggaatgggaaaatgggttaaacttaaaaaagtgaatgtgtagtcagaaaatgacagagctactgatttgctttttaaaataataaatttaggccgggtgtggcggctcacacctgtaatcccggcactttgggaggccgaggccaggagatcacaaggtcaagagattgagaccatcctggccaacatgatgaaactccatctctaccaaaaatacaaaaattagctgggcgtggtggtgcgcacctgtaatcccagctacttgggaggctgaggcaggagaatctcttgaaccggggaggtggaggttgtagtgagctgagattgcaccagtgcattccagcctggtgacagagtgagattccatctcaaaataaataaataaataaatctgttattattattattttaaaataagagttcttcagcaaaatggataggatatggacctggatttgatttttaactccttttttaaaaaaaaattttattttaggtttggggatacatgttaaggtttgctacacagataaacacatgtcacgggtgtttgttttacatattattacatcacccaggtattaagttcagtacataatagttatcttttctgctcctctccctcctcccccacccccaaatagaccccagtgtctgttgtttccttctttgtgttagtaagttcttatcatttagcttccacttacaagtgagaacatggcagtatttgattttctgttcttgtgttaatttgctgaggataatagcctccagcttcatccatgttcccagagaagacatgatctcattctttttaatggctatgtaatatttcaagatgtatatgtaccacattttctttatccagtctgtcattgatgggcatttatgttgattccttgtctttgctgttgtgaacagtgctgcagtgagcatttgtgtgcatgtgtctttatggtagaatgatttataatcctctgggtatatactcaataatgggattgctgggttgaatggtagttctgcttttagctctttgaggaatcgctatactgctttccacaatggttgaactaatttaccaactcaccagcagtgtataagggttccttttccctgcaaccttgccagcatctgctgtttttttgactttttaataatagccattctgagttgtgtgagttgatgtcttattgtggttttgatttgcatttctctaatgatcactgatattgagcttttttttcatatgcttgttggctacatgtatgtcttcttttgagaagtgtatgttcatgtcatttgctcactttttaatagggttgtttgtttttcttttgtaatttaagttccttgtagatgctggatattagacctttgtcacatgcatagtttgcaaatattttctcccattctgtagattgtctactctgttgacagtttgttttgctgtgcagaagttcttaagcttaattagatcccatttatcaatttttcctttttttcgtgattgcttttggtgtctttgtcatgaaatctttgcccgttcctaagtccaggatgatatcacctaggttatcttccagggtttttatagatttgggttttacatttaagtctttaatccatcttgagttaatttttatacagaatgtaaggaaggggtccagcttcaaacttgtacatatggttagcctgttatcccagcaccatttattgaatagggagtcttttccctattgcttgtttttgtcacctttgtcaaagatcagatggtcgtagatgtgtgaccttatttctgggctctctattttgttccattggtttgtgtgcctgttttgtaccagtaccatgctgttttggtcactgtagcctttagtatagtttgaaattgagtaacgtgattcttccagctttgttctttttgctaaggattgccttggctattcaggctttttttttttttttctgaaaagaaaaaagaaaacttttttcctcaggttccatataattaaaaaaatttttttttctagttctgtgaagaatgtcgttggtagtttaatagaaataacattggatctgtaaattgctttgggcagtatacccattttaatgatattgattcttcctatccatgagcatggatgtttttccatttgtttgtgtcttgtctgatttctttgagcagtattttataattcttcttgtatagatctttcacctccctggttagctgtattcctaggtattttattttatgttattttatgttgttttattttatttatggcagttgtgaatgggattgcctttctgatttggctctcgatttggttgctgttggtatataggaatgctagtgatttttgtacattgatttttatatcctgcaactttgctgaagttgtttatcagctgaaggagcttttgggccaagactatggggttttgtagatacagaatcatgtcatctgcaaatagagatagtttgacttcctttcttcctacttgggtgccctttacttctttctcttgcctgattgctctggctaggatttccaatactatgttgaatagaagtggtgagagagggcgtctttgtcttgtaccggttttcaagggggaatgcttttgcccattcagtatgatgttggctgtggatttgtcataggtggctcttactattttgaggtatgttccttcaatacctagtttattgagagtttttaacctaaagcgatgttgagttttatcaaaagccttttctgtatctattgagataatcatgtggtttttattagtctgtttatgtgatgaatcacattgattgatttttgtatgttgaaccaacttgcaactggggatgaagcttacttgatcatggtggattagctttttgatgtgctgttggatttgttttgcaagtattttattgaggatttttgcactgatattcatcaaggatattggcctgaagttttctctttttttgtagtatttctgctaggttttggtatcaagatgatgctggcctcatagagtgagttgggagaagtccttcctcctcaattttttgtaatagtttctgtaagaatggtaccagctcttctttgtacatctagtagaattaggctgtgaatccatcaggtcctaggccttttttggttggtatgcttttattactgattcaattttggagctcattattggtctgtttagggaataaatttattccttgctcagtctgggtgggggtgtatgtgtccaggaatttatccatctcttctagtttttctagtttgtgtgggtagaggtgtttgtagtagtttctcatgattgtttttatttctatggagtcagtagtaacattccctgcgtcacttctaattgtgtttatttggatcttctctcttttcttcttaattagtttagcgatcttttgaatgatttttcatgtcttgatttccttcagttcagctctgatttttgttatttctcttcttctgctagctttggggttgatttgttcttctctaattctttcagttgtgagattaggttgttaatttgagatctttctttttcgtgtgggcatttggtgctatgaattttcctcttaacaccaccttagctgtgtcccagagattctgttatgttgtatctttgttctcattattttcaaataacttctggatttctgccttaatttcattatttacctaaaagtcattcaggagcatgttcttattttccatgtaattggatggttttgagtgattttcattgtgttgactcctattttcattgcgctgtggtctgagtgtgtgtttggtatgatttggtttcttttacttttgtgaggattgttttatgtccaattatatggttgattttagagtatgtgccatgtcgtgatgagaagaatgtatattctgttgcttttggttggagacttctgtaaaaggtctgtcagatccatttggttcaacgctaagtttaggtcctgaatatctttgtttattttctggctcagtctgtctaatactgtcagtggagtgttgaagtctcccactattattgtgtggggagtccatgtctctttgtaggtctctaagaacttgctttatgactctgggtgctcctctgttgggtgcatatatatttaagatagttaggtcttcttgttgaattgaaccctttaccattatcccatgcccttccttgtcttttttgatccttgttggtttggagtctgttttgtttgaaattaggattgcaaccttttttgtgtttcccattgcttggtagattgtgtttcccatttgcttggtagatttttctccatccctttattttgagcctaggagtttcactatgagtgagatgggtctcttgaagacagcataccattgggtcttgcttttttatccttgccactttgtgccttttaagtgggggcatttagcctgtttacattcaagattagtaatggtgtgtctggatttgatcctgtcattgtgctgttagctggttattatgttggcttgtttgtgtggttgatttacagtgatactggtgtctgtgtttaagtgtgtttttgtattaactggtagcggtctttcttttgtatatttagtgctcctttcaagatatcttttaagggcaggtctggtggtaatgaagtctctcgacatttgctttcctgaaaaggatcttatttctcttttgcttcggaagtttagtttggctggatatgaaattcttgaagatttttttaaagaatgttgaatataggcccccagtctcttctggcttgtagggtttctgctgagagatccactgttagcctgatggggatccctttgcaggtgacctgctctttttccctaactgcctttaacatttattctttaattttcatcttggaaaatctgacaattatgtgtcttgaggataatcttcatgtgtagaatattgcaggagttctttgtattttctggatttgactgttggcctctctagcaaagttgggaaagtttttgtggatgataccctgaaacatattttctaagttgttggcgttctccccttgcctttgagggatgccagtgatttgtagttttgtcctctttacataatttctcggaggttttgttcattcctttttattcttttgtctttatttccgtctgtcttatttcagaaaacaagtcttcaagttctgaaattctttccttagctttggtttattctgctgttaattcttgtgattgtattgtgaaattcttgtagtgtgatattcagctctgtcagatcccttagggtttttttttttttttaaatactggttatttcatccttcagctcctgtatcactttattatgattcttattttccttgggttgggttttgtcatcatcccgaatctcaatgatctttgttcctatccatattcagaattatatttctgtcattgcagcccatttggcctggttaagaactgttgttggagaactggtacagtcatttgaaggacatatgacactctggccatttgagttactagagttcttgtgttggttatttctcgtcagtgtgtgtgggtattactttaactgcagtgtagattgagtatggtcaatagacttctttactgcatgttttcactgagttgaggttttgtgtagggtgtttatttgaagctgacttcttgtttctggtttcagaggggagggtatgtcaggtatctttggtgttaaagctttggggtatgatccagcaggtggctcttaggcttattggacagctggtggactaaacagttgttcagttgtgtggctcccctatgtttcctcacagttgtagccatgttccctctcagtgtcctgaaagtatgggtttctctgccccttgagtgctggctgtagttcatgacatccagtacagctctggggagatctcagtatttatgttcctcccccagcttacaggctgcagagggagagatcttattagtggttttggccaagggttgtttgcttgattcctgggggctccacctcagagagatgcaggtgagcagttgcttagtgcagtcagcccaggatggagggtcagtgctgcgggcccaagccaggggttggttccctgtctggtgatgagccgtcagaggtgtgtgggacctgtgggagatggactggcctcctctccttgagtttactgcagcttgttggagtgtggataaagcacttaatgtctttgctccttcatcagaccgagggtggcaagggcagttccacagtagagtcagtggccgagaggcttttagttgccactagaggctctgtccagggagttgctgagttggtgctagctgagtagctctggttgggggtggctggagccccaggcttggaggacctgccctgtgaggagatatgggatcagccacccacgtaacagtggggccacttttccctagggctgctgtggtatacttgaggcctgcagcagtccctggtcacctcagattttccagaatctggaggtgttaccagtgaagactgtgaaacagcaaagatggctgcctgtccttccctctgggaactttgtcccagggaggaatgacctgttgctggtccaaaggcacctataggaagtggctggagactccagttgggaggtcccccagtgaggaggagcaggatcaggactgcttaaaaaagcagtctggccacattttggtagagcatgtgtgctgtgctgggggtccacttcagccctcggttgcctcagacactctgaagctctaaggctggaacagctgagtcacccaaacagcaaagatggtagccaccccttcctccggaagctttgttccaggggaacttcagatctctgttggctggagagcttgggtgggggtggctggaggcccaggttgggaggtcctacccagtgaagaggaatgggattgggcacctgcttaaagcaacagcctggccacgtttgggtagagcagctgtgctgtgctgtgctggggcatcccttctgttctgggtcagcacagattctccaaagcacaaaggctggaatggcaaagatggtggcccacctcttcccctaggagctccttcttagggaggtgcagtgccactactggcagctggctagaattccaagccagtgggtcttatcttgtgggctgccatggaagtgggtcctgtgggctcttgctggtcagtcccctggattcagcctctttcctaggggtatttacaggagtctaacctcccaccctgctggaggtacagctacttttgccagaaagcccaagtatctaaggctccagggtcttcacgcatgccaagactccacatggctctgttggtcagactgaagactgcaggccctggtggagtgggttcacaaggcgatctcttaacctgaagtttgcaaaggtctgtgggagaagcatagtttctggggatcgctcattcactcactgcttccctgagtcggggaggaacccctggctccgtgttgctcccaggtgcgctgttttcctgccttgcttttctctgttctctgtgggtcaagttgtttccttgattaatcccaatgagagtacctggatgtttcagttgaaggtgttgtatttactcaccctttctgttcctctctgtgagagtcacacacactagctgcctctagtcggctctgttggccactccctagccgtttaaactgtttaaaaaaaaatcttatcgtgatgtaattcacatgctatataacttacccatttaaagtgtacagttattttagtatatccagagagttgttcaactgtcactgtgatcaattttgaatcttttcatcaccccagaacgagactttgcacaccttagttgttatcttgacccaaatttcgtaactgttttgagttactcactgaagatcatttggtctcttaacaggcagcaagaaattgatccagattatctcctttctcgatctgtcgtcttactgacagatttttaggcaccaaaaatcacaattcctttctgtgtatgctactttaagatagatttcttgtcttctgtgagttcatttgggagtttcagtgaaggacctgggtgttttgatggaagtacatggtttatgtgtatccatattaaatttcatcttggtgtattgggcctctcatgtctgtccttggtacatccttttagccttttaggacttctggatcttcagtctgccttttaatgtattaatgttcttagtgaacctaatatggtctgtatatttgatcatttgatcattagattttttttttaagtcattggcaaatgtgttaattagaattaggcagagtgggagtggggaagagttggcgttgcctgtacaaaatctcgtttcttgtagatatttatgaattactcattttgctttgtttacagaaccattatagggttgaggatggcaacagtgggacacgaggcatattctccccctcccacagtgcttctctaaattcctagatttcacctagaagcacagacaaaagcatgagcggcgggaggggaattttagtcacactctttatacttatagccaccatgacgtctcaactcacatttcttcagtttgttcacagcaataacataggggatttgggcataggttttactcaaattcagacacagtgtttttagttttccttagtctctgttaccaatcccttggatgataaaatttattttaaaaaaagaactgtggtgtgtcttcttgaaggtatatgctgagcttttagattattgcttccctttcaaaggcgcacagtccatccctttaacaatttgtgtctgacaccgagataaaactcaatagattacagattgttgaatctagcttcttactgcaaactactgtaatccctttgtaatcttccatctgttttattcttaaataatcttcttctgggacttaggatgtatctctttctagcctgggactaactcctttaagtcagatagtgtgacttatttattctatgttatgtaccctgaagttcattctcattgattgaaaaggaggacataaaatagaaaaagcactcttttatatactttcacacatcaccactctgagccttaagtcttagatcttccttatttgtcttgctgcaaacataattagaaaatcagaaaagctcttttttgtagtccatggcatttttccaaggtacagttcagttttggagtaaagaatcataccctttctggctttccactctaaacttctgcaaattcattcttcttcttgtaagcaaaatcagaggtgtttaattgtttagtcacttggatatatacactgaacatttttagttaaacagacctttctgctttgaattgaggatgactgttaataaggtgttagaaatgaaaatcaatcctgacttcttcttcttaatcagaatccaaataataaggactgcactgctgcagtctctatggggacacccactgctctcacttttctgttttcttctttttaaaaaattttattttttaatttaattttatttttttactgttccttgcagagcagggctaccccaaaggcagtgttcccagagtagcccactttctgtttttttttttttttttgagacagagtcttgctctgtcgcccgggctggagtgcagtggcgcaatcttggctcactgcaaactgtggcctcccgggttcacaccattcttctgcctcagcctcccgagtagctgggactacaggcgcccgccaccacgcttggctaattttttatatttttagtagagatggggtttcaccgtgttagccaggatggtcttgatccactttctatttccttatagctcatgttgacagcttttctctccaacatgggtctactcatctcatgtaaaattattactatacgttcttgttgagatcatgaaccttctctaaaaatttcatgaggttgtggatttggagaagtattcctcagtccattcaatacaataacagtaatgactatagtttattatctactgtgagtcaggcaccaactgtagcgagacattctagttacgttttcttgtatacttccccacagtgttacaaagaggacatgatccccttttttctgatcagtaacttgaacctgtaaagtgaaggttgaatgaattgccccagacctcatagaaataatatattctgcatttgtatttttaaatcagtttttaaaaagtaacacatctaaaatagtaagaggcatgtctaaaattctagtgtaggtctgtttaacaccacagtgagtgctgcttttttttggtgattgagggcctaccgtaatatatcattgtggcagcttctttggaagataagaaattatccaccagaaataaagaggacacattctcttttaaggaaaacaccatctcggcttttaaacacttttcttttttaaagggtgaaggaagccatggagatttcttaagaagagagacacttcctacctttcttttgggaagcactgtactgattctgttcagcagtgtacagaattggagccatagtagaaggaggtggagattggagagcgcctagctcagcacccttggcgactagttgtagccctgactccttggagtgatctgtatgtcactctgtatttggacacagctgtttcctcgggttgcatggtaacaaaccaaataatttgcctttaggctcttttgcttactatgtctgtcatcttttacacaactgaagcctttggtggagaaggattttgagttgactacattgcttaattgtaatgactattctgtttgacctttctaagccagagcttcacgaagagagatttgaatgtttgctccgtagaagtaggtctcttccaggggtgaggcactgtcttaaaaagttataaagaggccgggtgtggtggcttatgcctgtaatcccagccctttgggaggccaagtcaggtggatcatgaggtcacgaaatcgagaccagcctgaccaacatggtgaaaccccgtctctactaaaaatacaaaaattagctgggtgtggtggcgcccgcctgtaatcccacctactctagaggctgaggcaggagaattgcttgaacccgggaagcagaggttgcagtgagccgagattgcgccactgcactcctgcctgatgacagagcgagactccatctcaaaaaaaaaaaaaaaagttgaaaatactaacttttaattatcccttaaaaatagatattccagtttttctgatttttagtaatacatgtttgttacggaaattctgaaatatgtagaccttaacttatggaaactttagaatataaagtagaaaaatgaaaattacccataattgtaatttctaggaataatcactatgaacatttgagtcttcccctttctttttttctctttttttgtattttttgttttttgtttttttttttttttactatatatgtatggagtgcaacacatctgtattttagttatcactttacattgattaagcatttgtacatgctattaagttcctctcatagctctaatttatatattaaaataatcattctcctaatgttatatagattatttccagattttaatagtataaataaaatccttgtagacacagttatttgtaaatgtttgatttttaatacctaatacgtattagacagatttctactgcgttgaaacttagggtgatcattttgaatggcagtttttacaactgaagattttccctcctgaaaactttattttaagcatcttggataaatgtttcttaaaaaacattatatactttaataaattacttaacagcttaagttttccgtgacaacttggtgccatcattaaattataagcatcaatcttactgtgttgctggaatagtctcctccttaatggcttctatcactccagcctttcttgttcctgtctggcttctttctaaatatttgttttccttagtgtgttgcattgagtcatacttttctgcatgtacttgtctagacagtttcaactaccttcatgtcataaactatatcacttttgtgcgaatgattcccaaatctacagctctaaccaagactttgcatgaactttagatccctatatccatctttctggtgctcattgtcacaaactgttatcctttgactgtatcaaagacacctcaaaagtaacactagaatttaacttgtattcccctgaaattactacttgctcatctactttttctttccttcgtctcactctgtcacccaggctggagtgcagtggtgtgatcttggctcactgcaacctctgccttccgggttcaaaagattatcctgcctcagcctccggcatagctggaattacaggtgcccgccaccacgcccggctaattttttttttttttttttgtatttttagtagagatggggtttcatcatgttggccaggctggttttgaatgcctcacctcaagtgatctgcccgccttggcctcccaaagtgataggattacaagcctgagccaccacacccagcctgctttttcttttttttttgagatggagtctcgctctgtcgcccaggctggagtgcagtggtgcaatctcagctcactgcaagctccgcctcccaggttcacaccattctgctgcctcagcctcctgagtagctgggattgcaggtgaccgccacaacgcccagctaattttttgtatttttagtagagatggggtttcaccgtgttagccaggatagtctcaatctcctgaccttgtgatccgcctgcctcagcctcccaaagtgctgggattacaggcgtgagccactgtgcctggcctagcctgcttttccttaacagtaccatcatctatctagttaaggtgaaaatctttctagactcctacttagtcttcactctcaagtatattggatcactaagttctagccatgctacctttcaaatatttctcaaatttgttttctcctcttcatccctattactattgcccatatttaggttcactagtttttatcaggacagctgcagtagcctcccaagttccttttcacagacttaccttttcaaatgtgttttcatatcaagggcaaaaattgctttcttgggcatacatgtcatgctattttaatgcttacagacttttaatggcttcccattgcacctggagtcaaatttaactccatattagtctataattgtttctttttatctttctggcgttttctcctgctcctatcacacacacactcaccaagcttttgctatcaaacttctagcagttttctgactattgtgtgcaattttatgtgcatatgcatttgtacaggctgtttattctccctggaaagtacacagcccccgatacagctcgccctgcattttacccatcattgtaatgcgttcttagaagatacagtggaagttcactggtgtgacattattcatgaaccctgtcacccccagcctggacagaaataccttccttgctccatgtttattgagccatttatgatactttctgtggtagacaggataatggcccccacaaagttgtccatgtccttatccttggaacctatgaacattttaccttatatggcacaaggttctctctgaagatataattaagatgaaaggccttgagatgtggagatcatcttggattacccagatgggccagtctaatcataggaatctttaaaagcagagaacctttcttgcctgtgggcagagagagagatgacaattgaagaaaggtcagataaatttgactttgctggctctgaagatggagaaaggggctgcatgcagccaagagatgcaagtgcccactagaagctgcaataaaggtcagggagaaagattttcccatagagcctcctgaaaggaatgtagctcagatggcaccttgatttttagccctgtgagatcgatctcagatttctaacctacagaatgggggaacagagtttttttttttgttattttaagttactaagtttgtggtagtttatgacatcaatagaaaatgaatatactgtcattgcatcttctctgtcttatcaagttatatagctaatttcttatttttcactagatattaagctctttaaggacaaggactgtataattttattttattttattttatttgagacagagcctctctctgtcgcccaggctggagtgcagtggcatgatcttggctcactgcaacctctgcctgcagggttcaagcaattctcctgcctcagcctcccaagtagctgggattacaagtgcctgctaccatgactggctaatttttgtatttttagtagagacggggttttgccatgttggccaggctggtctcaaactcctgacttcaggtgatctgcccgcctcggcctcccagagtgctgggattacaggtgtgagccactgcgcccggcccgttataatttcatctctatcctcagaactttgcacagtgctaacacagtgttaaccctgaaaagtttgaatgtgtgaattaactaatatagtgttatttgtatcctgataatgtgttcagcaatccttgctacataccaaatccccctatttattttttgggttactgttttcactttttaaatggtgtgtttttttttgttgttgttgttgggggaggggtgcagggaagtctctttccttcttgttaactttttttctttctgctcctattttctttagccatggtggttcttttcctgttgatagtttgttgcttcaaatatgtcatttgcacatgacagtttaaagtagagtgacattgtatctaagtcccttttggatagaagtttttgtagtaaagctaagatgttgggagtttatgttttctcagtgtgtctttacaggcatgtacttcctttcccatagagaaatctgaacaagaattttaactttggtaattttattaaatgaaataaaattactgatttcgtctatttgttaaacttgcattccagtgtaaatcttatatgaataccagattcacttatcctgccttaatttgccaactataaacctggataaagtacaaaaaaacaactacatgaagacactagagagtaaccaacaacagtggtttctggagggcagttggtatgtggaagaccagcagtcactggatgagtttcttgtttttcatggcttctcacctgatagcaggcctcatgtgacagctggaagtccataggaagccttcagtggttatgacttgtcccatcaatcacagtcattggaacatgaagaaagagagtgccctgccaggggacatccctaattctgcatagaaattctatgcaaatcactgaaccatgccccataccatcagaatggggcatccacactaatgcttaaaactaaatagagattggtgctgccatcaagagacagaagtttgccatctgagtttagctacctggtaaaacaaaacaaaaagtcaggattctttggaggaatagaaaaatccagagttgccacaatgcccaggatacatctaaagttactcaaaatttgaagaaaccggaaagtgtgacccattctcaagagaccaactaattaatggagattggatcccaagatgacctacatgttaaacttagctgataaggattttaaagcagctgttattactatactcatttacacacaggaaaatctacttagaatcaaagctatgaaatctggcagagaaatagaaactgtaaaaaaatttatttgaaataaaaattttggccgggcgtggtggctcacgcctgtaatcccagcactttgggaggccgaggcgggcggatcacgaggtcaggagatcgagaccatcccggctaaaatgatgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagaaataaaaattttacaggataagtttaatagcaaaacagagatgacagaaaaaaatcatcgcactgtagttcagtaagaattactgaatttgaagaacagagagaaaaggagattgaaacaaaatgaacagaacctggaaaatgtgggacagtctttaaaaggtctataatatgcatgtaattggagttctaaaaagaagggagcatgggaaagaaaaaaatatttgaacaaacaagggatgaacattttataaatttaatgtaggaattatgtagagatcgttgccgtttgacaaattaaaaggatgcttctttcacattgagcctaagaataatttaggcttgactttcttctccccaatgatctgatttatcaagcctgactgatttcagttgctgtagtgtttctttctgggtcttacagatccacactgttatgagatcactagattaaattgcagccaggactaaattgcacaaaatggtagaatatatggatggtggttttttgaaacatgccagggctggtttctttcggagatctgtagtgaacactggatctttttgtgtgtgctgcttttccctctgccctttttctttgctttcctttcctgctaccctcttcttgtttctgagaaagggcaaaaaggagactgaagcatttgagctagactggctacatcaaaggcagtgagttctattgatatctgagtcagctgcaacataaagcgactactggggaggcttttgttgggtctttactttttttttttttccccctgggtgatgttgctggtggcagtgctaggagtcagttggtaatgagtccttgccaatgtgccttgattgaaatttggaagccagattcctgtgattttaaccataacctttttagaaatgcatacttgtatgctcaacagccaggtagtatgtactgcggaagccataatgattgttacagttttgaattactgctcccgaggccctgttcctacttctttttgtcctagttgctcttgaaccaccccgatgatcactcttccctttcccacacggcgtctatgatccaacaaccaaagggttaaagtctggcatgccttcctcttttctgttttatctgactggcgactttcctcttcataaatactgaaatatctcccttccctgtccctgttgtgcctgtgcccatccttgtgtgtgctctagtatgtgttaaaaatagttgttagaagtccagttacagattttggaaggtaatacagtctagaatttaaaaaaatgagctttggatttaggttgactccagagtttataacttttgagcagtgtccttaaacaagttctttgagccctattgtccattttcttgtagaatatggataatatctattcctgagttttgaaacttaatctgtatgataagccttccacattcatatttattcctttgatttcattttggttttatcatagccagttatcctaggtcatttctaactctctagtttttgtataattattctgttttaaggaattaatttcaaagagggaggttagaactggtaggttcttgttcatctgtctttaccaaagagaagtctgaggctcagagttaaattgagctgctcaagcttatataactcggaagcagtgtaactagaatttaacctcaggcagtctgataccagagtcaggactattaacaaatttgtatcaacatctctctaacaataaggttatgtcggtttagaattttcaattgcttaccccgtccctttttcttcttttactagttctttaatttctaaggataggttaatgatgaaaccagagactaaactgtagttttctcctaaacctgcttgtaattacctttattgatctttaggcattaattactttttttatttttttgagatggagccttgctctgtcgcccaggctggagtgcagtggcacgatctcggctcactgcaagctccgcctcctgggttcatgccatactcctgcctcagcctcctgagtagctgggactacaggcgcccaccaccacgcctggctaatttttttttttttttgtatttttttttagtagagacggggtttcatgtgttagccaggatggtctcgatctcctgaccttgtgatccgcctgcctcagcctcccaaagtgctgggattacaggcgtgagccaccacgcccggccaggcattaattactttttaaccttgctgtatatatctgttctttagtaggctagagatcttttaaaggcaaatatttggatcttagtcatttttaaaaaaaattttattattattatactttaagttttagggtacatgtgcacaatgtgcaggttagttacatatgtatacatgtgccatgctggtgtgccgcacccattaactcgtcatttagcattaggtatatctcctaatgctatccctcccccctccccccaccccacaacagtcaccagagtgtgatgttccccttcctgtgtccatgtgttctcattgttcagttcccacctatgagtgagaacatgcggtgtttggtttttttgtccttgtgatagtttactgagaatgatgatttccaatttcatccatgtccctacaaaggacatgaacttatcattttttatggccgcatagtattctatggtgtatatgtgccacattttcttaatccagtctatcattgttggacatttcggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatggttgcctttctaactggtgtgagatggtatctcattgtggttctgatttgcatttctctgatggccagtgatggtgagcattttttcatgtgttttttggctgcaaaaatgtcttcttttgagaagtgtctgttcatgtcctttgcccactttttgatggggttgtttgtttttttcttgtaaatttgtttgagttcattgtagattctggatattagccctttgtcagatgactaggttgtgaaaattttctcccattttgtaggttgcctgttcactctgatggtagtttcttttgctgtacagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacatgtaagtctttaatccatcttgaattaattttcgtataaggtgtaaggaagggatccagtttcagctttctacatatggctagccagttttcccagcaccatttattaaatagggaaggatcttagtcatttttgaatcctttggcagattcagttttgtatccctcttcccatttgtactgtctagcactgcatcttattcatcataatgggcacacagtactttttattggtgacagtgatgacttgaataaaacctttgaaacaccagaataagcttttaaatttttgctcagttgttaagctttggaatcttggaattaagagaaacttaaagatcctttgatctttttcctggttaatcttctttaatttttgtccactgctatttttacaacatgatttttattttgtttaccatcccttcactttgttcccaaccttttaaaaattttatctgtgtctgtcttggtgggttcccagcatggaccattatatcctaggtttgttaagtaaatagtaatttggaatcactcattaccttctctgcattggatactacatctattattgtattaactacacacacacacacacacacacacacgtatgtaactcaatcatccgtgtattagtgcacaccaacaatcttggcacccattttatactgttgattattcatttgtgaacactatagtatattttacaagtgcttctgtgcttttctacctttatttgatgtagttgattctaaatatagaccttgcatatatgtatattcagtacttggtacatggtaggtactcaataaatgtttgagtgattgtgattttgaacttgcctactttgcgagccctccttcccacctttccgcttcacagcatcctcatattaccttgtgatctgttcctactgggccaccattaattgttcctttaaagagccatgagttatttgtgtctctgtgaacatacacacagttttatccatctagaatgacttctctgtcatccctaatgtattgtcaggcttttttcattctttcaacttctgagattgagatcagattacctctctgcagccttcctgaccatcctttctttcctaggtagaattggccactcccttgtgtcttccttgttttcatatctgtttctcttggaacatatctactttgaaggaaaagactgtatttttactgttctatctgcagtaccgaacacaatatgcctagtaataactgcttactgaattttggcgaatgagtgaataactaaaataataatgggacatttcaggggttgatatttcggcctgcaatcttttcggctctgttatccaacctgttgcccattagatccagcaagtttggtcagggtgtgctctctgtcctcatccagcttactgactcaagtgttgacggaggcagagttgaggaggacatttttgatgcctgatttctgatatgttcaagtactcaaatttgcacattttaatttctttgtatttttgtctcaataatgtgaaagaacaacaaaacttcaaaatgttgtgtgagtaggtggttcttaaactctttcttgggtgaatgaatattataagactatgttggaaaagcattcttatatttctcagggtaaaggaacttttgaggtattctatgaagacttattaaggctgcaagaagctgaaattgggaagcctgtctgtttttctagtctggccctcaatttgcattacatctttgaaatagcctgagtatactgtcttatggttgatgccccttttagacggtcagagtcttagcccttctagaggtatattgagattggaaaatcacactgtgttatgacttttcgtggttttagtagttgtcctctaagtttggactatttaaaatctctagtagcagatgagaggtaataactctttggaaacagactgagataaaattaagttttggtaaaatcagtcgtgatttgtagcttggaagaataggcatattagcattttaacaatatagctttgatgctttaaagaacaccaggctactaaagagatgtcttggttctctcagatgagttctgttgtatcactttcagatattttgttctttatccaagcaaagcacaacaagtagtttctaatatgaactggatttgtagaattttgtatgaagtctgacttaaaatataattaaattaacatttggggaatgagtttagtctttactaatttttttaggtcagagagcataacttctgtgaagctgcccccatttcacccttcatgcttcacaaatacttgtagaatattttcattgccttgcaattaggagtttacatacaggtctctcctaacagattgagagctccttgagggctgtgactaccagttgatctggcccttattaggtgtgtaaatttttttttttttttaatcagacttttgctcttgtcacccaggctggagtgcaatggcgtgatctcagctcactgcagcctctgcctcctgggttcaagcaattctcctgcctcggcctccccagtagcttggactacaggcgtgcaccaccacgcccagctaatttttgtattattagtagagatggaatttcaccatgtcagccaggctggtcttgaactcctgacctcaggtgatccacccgccttggcctcccaaagtgctgggattacaggcgtgagccaccgcaccaggccaggtgtgtaaatgtttaagaggataaatgagagatgtcatgtgcggatatatgtcctattgcaaccagaaagtgcctctattaataaggaactgcatataatagtgccttctagaatagatagacctgaggttagggctgtagttgctatgtacagtggatattactattgggtgttcctgtcagcaggattacctctttccaggtagttccagattgtgacaaatggattaatctggtaaagacaggtgctgttttaggtataaagtttagcattgatccctaagtttacttctggaatagctgctcatctggagtcatcatttgcaggccatttctggtggacccaccagctgcaagatacagatttattatttgacctgttttcctccagtgcaaggatactgtgactgttaagcagcatgcattaaataactaactcatctgttaataagtgtgcacatagactttggccagaacacattagacccctgaacagagaatcttaaaatactaatgcatttattttaggtggcaaagaactagattagtcaactaaaagcacatgaaaactgtcaactccagttttacaatctacatgccatgtcgatacagaacttgtgataatgtgaatggcatttttagcagagaattgtagtatttaaagacaaaagttcatgagtgttctgaaataatggtactttttctcaacctctcgctacatgggaaaggcagccttcaataatctctcttccaagtaacatatagggcagtactaaagaaaactgaatcagctggttgtgatggctcacgccggtaatcccagcactttgggaggccaaagtgggtggatcacctgaggtcaggagttcgagaccagcctggccaacacggtgaaaccctgtctctacaaaaaatacaaaaaattagccgggcattgtggtgggcacctgtaatcccagctactcgggaggctgaggcacaagaatcacttgaacccagaaggcggaggttgtagtgagccgagacctcgccattgcactccagcctgggtgacaagagcgaaactctgtctcaaaaaaccaaaccaaaccaaaccaaaacaaaacagaatctgcattcccaagagtccatagtagaggaggaagaactgccagtgcctttttaaaacgccagtttataagagttgtgcctgattctgtttcgatgctaataaaggtaattcactttcaactcagacatactgctttataaaacaaacatgtttaaaacagtagcattaaaacattatagtttgttttatagaggaataatctgacacctagagagattacgtggtttgtacaaggttctttcaaattcttaactagtttagaggctcacgatcggtctttttaaagtagcttttccctttccaaaatagcttttcttatccctccttgcctttcattttgtaactttataataaagtcagtatgccctaatcactttcttttgtttgaagtagccagcatgcatctgacagacatgcagttagacaaaggctcagtgctttaagcattgacagtgaagagagttcagtgattttatgttactttggagatgtggggagaaacagagatgcagtatctcaggaacattcaattttatgctttctctgagctataacatcatgactgcagttggttaagtttcagtgtaattttagtcattcttatccttattatctattcactttgtagcgcttttaaacaaacatctggcactatcttagttacctagttttatgtactttccacgtcccttgtgacttcatgctggcctcttgttgccagcctgttactgccctcattgtggaggaagctgagattttctaccaggctcagccatggaatagtgacaattggtgttcaacacaatgacacaaagcattacagcattataaagaactgttgaattgtttgaagatattttttaaaagtttaaaaatctgccttattggctgggcgcggtggctcacgtctgtaatcccagcactttgggaggccgaggcaggcagatcacaaggtcaggagatcgagaccatcctggctaacatggtgaaaccctgtctctactaaaaatacaaaaaattagccgggtgtggtggcaggtgcctgtagtcccagctactccggaggctgaggcaggagaatggcatgaacccaagaggcggagcttgcagtgagctgagatggtgccactacactccagcctgggcgacagagtgagactccgtctcaaaaaacaaacaaacaaacaaacaaaaaactgctttatttagggtataatttaaacacaataaaattcacccattttaagtgcttaggtcagttggttctgataactgcgtacgtaaccaccaccacaatcagcaaatagaacattcctatcactcccaggtttcttgtccttttgtaatcgcctccccccatccctgggtccaggcaagcactggtttacattgtgtcactacttttgccttttctagaattgcataagaatgggatcgcataataggtaatataagtctttgaacttatactagctctgtttattttttcaaactgatttgaatattttaagtcatttgcatttccatgtgtttttgaatcagcttgccttatgaaagactactggtgtttttattagaaatgcattaaatttgtagatcagtttgggggaaagttgacatttaatgatattaagctaatatatttaccatgtatctctctattttaaaagatctttagttttgtatttttttaagcaagtttttcggtcttcagtatacaggccttacacatttcattaaatttgtccttaagtatttcatggttttttatgctgttacaattatttgaaatttcaacttgtaattgtttaacaatgctatggtgaagaattggttagattagatctgagtttaaagtcatatactaggttaaaaaaaaaacaaaaaacaaagcaggaagctggtgcagtggtgcccacctgtagtcccaagtactcgggaggctgaggcaggaggatcacttgagcccaggagttggagtctagcctggtcaatatagtaagacccatctcttaaaaaaaaaaaaaaacaaagacaacaactcaacaaattttcaacaagttattgccagtctaaattggggtaatataacactcgttctggatttagaaataaaacatttaagagaagcttcagtgttcattccctgaatttcaacttttctgaactctttttgacattttaaaaaatgtagacaaaggatcttgctacgttgcccaggctggcctcaaacttctcaagggaggagatgctcaagcaatcctctccccttagcctcccaggtagttgagactataggtgtgcaccaccacacctagctttgaactcctcttagtaggaaactcttagaggatttacatattaagaacttctcatataggggaggaataaaattaatttccccacttgaactaagataataaaaaataaggttgtcatgaaaaatacagacctggtgctttaaaacattttagcatttgtagctgtgtatgaaaagataaatagcacttatataacagaaatgcataatgataaactgttgtttctagtaaatgtggaaacaggccatattactatgtatgtgacactttaaatatttaatatatgtgacatatacacaagaatatagctagagaaacagctagacatctgctaaatagtaccctttcctttaaaattactacacttcaaaaattcaaaaaatacacataggtgtttcataaaatcactgttgtaacagaatgacccacgtgctaataatttggtcataataagcacataaggagcacaactggctactttccctgaaaactgttacagtcaaaaagtaaattaatttagggaaaaaagactgaagatttcaaggtacggggtcctaaaagtaaagctactgctttgcaggttttgttaactgggcgcgggtgtgggggtgggagtaaagagtagggatgtaggcttacagacccaggttgtcaggagagcaatttgatgtggaaggcacaagtaagagaagatgtaaaccacgcaaacaaaaagtatttgaaagggaaataattcaattcagcaaatatttgagtgcatactctggaccgagattatagatagaatgaactataaaaagtccaaataaaccctccagagaatgctgagaccttggctttctgattctccacataagttaaataggccccacaggaggcccccactgcaacacgcagttggttcagtgctagattagtcatcgttagaagatggccagaattcagactgatctgaaaaaccaaagaactcaggttgcttcaaaaacccagagacagccaaagctcagaatcaactaaacatcccatgtcaactgaagaatgatggactgctttggtcatagtaagagggtcatgagaggggagggaggtgaagcccaacctcttgctagccaggggcctccctcctctgtagaaaacagagttaataaccactcgcctgagaggcctgtggtaggtcaaatgagatgccatctgtgcagcaatttagtgcacaggagatgttctgtaaacttcatctttcactgacactaatccagtaaacaggcatacctgacttgggataagcaacaagaaaaaaatgataatgggaagcaatgaggaaataaaatcctcacttcttacttgaacagcagaatccttaagaaatacagcccactcaactactagtttgaaagtttaaagtctctgtgatatcagttctttctctaggtgacttacataggatgaaaaaagtgttcccaactgtaaacatgggtttctgtatcaaacatgtggctgactctccatcagcaggagtagcagtggttaaaaaacacaagctaacatgttctcagctcttcctccaagaggtaaaagctcataagcccattattttcgtagtttaaaacatatattcctgattcctttctttccctctgccccactccccaaatgctgtctttaaatagtcagattctctgctaaaaatgccattcatgttgtcacaagttctgtattgacctggcatcagtgttgataattaattttcatgtgcttttagttggctaacctagttctttgccacataaaataaatgcattagtattttcagaaatatccttgcttggtgtataagagcaagaatgactgtctaagggattactcatgtcaggaatgttttatgattagaaattccccattagaaataaaatttttcattgaagcgattaacattaacaaaatctttaataggggactgcttagaatattgaagttttcctcatatctgtagaattttcacttaattatgacatatacaagtttttaatttgaagtcttcattgtttaaaacttttccttccaattttgataggtggtttaacaaaaacctaccaccttgtgtttccagtgtcattgttctcaagatgttaaaggcttagtattgtgaaattataacattgaagacaatatttattctcaagacaagaaccagtctaataattaacaaggtaactgacatttttaacgtctctgatcccctctgacacttgtgtgactcgttcgatagtcacataacgtgtgtgagaaggtgggccgtgcctgccttggaaatcattcctaacaggtctcgcatttgtccaggtaaggtcatccagctcagtaatgtcctcatttgtgtgagagcctacctgcctatatttagtctttccaggtggtttataattggtttagcccattggacagcctgctttttggttgatagaggctggggaggatgaaggaagtgtaaaggcttgaatttggcagtctctttgccggatatctattttaacccctcctgaagttaatttacataaaacccagctgtgtaagaatttttctaaatttaaagtttattcttattaccgtagggataggaatgtcagcactcactgaattatggccttcctctcctgtgtctggacctcctggcagcttatggttcccgtttcctttggataacaggatacagctggtggcaaaattctcacctgtggaatggccattgggagttttcttctccatatagatctttgcaaagcagcagaaaccatttttgcaggaaaccacaagcctgtgttaaacaccaaaagagaattgaaataacatgtccatgagttcctctttccagaggtaccaaccatcatgtgggatcctaagtatagtgttaagtagctctttgtcctccccttcactttgaggttgtctagttatatgatgttgaattccccagctctggtccctattacctctctggcagattaagcaaattgcttcaggctggattgcttaacacttagcagaattcatgctgcctttaatgagctaccagtttaaccttctggggctagagtgatttttagacatttttgttttgatgagttgatttttgtacttatagctataactgtggatcccttgccatcaaactatggtgcagcaaagcagctgatgaatttctctgtctctgatgttcatgtcaaacagttatttctctagcattcattgggggctcagtactgtgccaggtgctgtggcatgagcagtagtggtgtggagggtgctacaggagacatctgcaatgcagtagactagattaaaaacaagttggggagagaaggcaagcacaaaaataaaagaaaaatagaagatagtatttgacttactgctgatagtgtgggttagattatcagtgataatcctattaaaatcagcaagggtggagggcatgaacatgagcaaagacttgaggactggactgagcatggtgcatgcatgtgaggtatgcagggactggatggaaggtgtggtatggaagaaaagagtgctcagtaaggctttatagataatgagggaccctgaacactctttggaggcaccagaggggtagtgggggcatggtggatggcttctgagagctcaccaatgataaatggtatgtttaatagagtaccttatctgttggaatgtatattttcctcaccatcaccttttatttagaattagggatcgacacagtgatgaggatgtcctgagagatgtggtagctgaatgtgatagaaggttagtgctgaaaggctatcatgtaattcataacaggcaagaagaataggagcttactttattattttcttattgcctaccactgtgttaaacctttaactacacatctttaattttatgtattctcattttacagatgaggaaaataaagcttggtagttaagtaacttgtccaaggtaacacagccagtaagtgccacatttacaactcaattctaggtctttttgtctctgtctctgaattacgttagtactctaatttttatccttacattagtctgttggggtcatcaaatgattcttaaatactagaaggttgtctctaatcttaatgaggactctgcaatcatcctttcctttaataactattcatccaagtggcttgtctatcgttgttgtaaaataagtacgtttaattttttacagaagaaatgtagtgggcttaatcatgtgctggccatgtgtgtctgtggatgcagcatttaggaatatgggtcccagagtacagggctccatctttaagctctggaggttggaagctctaggaaaactaaggtgggttaaatgtgttcccaaaactgtgatcacattttatgtttatgcttttctctccctttctcgagtcatggtaggttactatttgagtgccatgccctagaactccctaaagtaaaggcactggtatcccaaaagaactgttctaaaagattacttacttctgtgaaggcagagagggtgctacagaatgaaaatagcattttaggaaggttgagtcagaggtgcgagtggggcatagagagattttctcagggtgataaggccctggtgctcaagtctacaagcagagacaggcacattggcagtgagtcctccttggggaagaagaatgatctgggctacttccaagaccccttctacctgtaagttcttgtaatttgggattgggattaagaaactccagaggctggtgtaaattgatggggcaccagctgttgtttgctgcacctcagggaagtcatggtgggagtctggcctggccctgttggctggggcccccaacagatccttgctgtgtctgggtttgagtttacgctacacaattacaaactttttccagtgctgctttttgtgaatctttgaacctgcagttgtgaatgaacagaaatttgaactgagcttaaaaaaaggaaaaaaaaaaaaaaaaaaaaaggcagagctttgttgataccactgccattatagggccatgatttcttttttccccatttagctgcaacacatttatttttcccttgtataatggctgagatttctttagtatggagctgtgtcacagtggtttatgtattttcttctctctccctgcctctgtttctaaggctgggcaactttgaggtatgtggattgacctggatgcctcttgtgactccttccccacgatcccctgcgtgcacttcctattcatctttgtagttctcagctactcactgtgctgtcatatctggcgcgtgctgttccttctatcctgtgcttctcctcctgtgtccacttggtggaactttccccatggtttgcttcttccagtaatctctgtctggaccccccatcttctagagagtttattgctccttcctgatccttgtaacatttttattattgtgctcatcatactgtaatatctgtttacatacatatgaccctttactaaagtggtaggaaccacatattatttattgctaaagctcaataacttagtacatgtaatattttaggggctcagaaatgtgaaattatctccctttattgagtttttatgtgccaggcacatattataaatatatgtcaagaaaaagataacctaaacacggaaaagattatagtgtactctcctacacaactttcaaataaactctaaaatgattataaggatgtcagagttctgattttttaaaactacatttaacttactattttaaattatttgtatttcattattgtaagagttctgattttttttccatgataattacattgatttggtgtttgtgcatgtgtttggcccaaactcaggatcatttatgccttttgggtaatccagcgttgataaagaataaattaaatgagtgaacgtgggtgttactgttttgtcgttgctgttgttttaatttgctatgttcttttgttttactgttgaatgttaccctgtgttagactcttcatttccttcatgtcatgcctgcctcctttgtcccactcccaacccctcgccttacccatttgggctcagtgctttgtgttttgtcttggtggctagtaagtaccatcatatgatagtggggcagagcagggctaactgttccgtatgagaatcagacacatattatgagtcttaacatcatttcccgaagtgtgggtcatgattccagagcaaaggatcaccagatttggtctcccgatttctactctttctggtcctgggaatgagaatcagccttatttaacaaggccttaaactgatgttcatgtgtactaaggttcaagaatcgctgcttaaaactaactgctcaattattaatgtagctgcaaacaaaagtaaagcattcatgagggtcttgtaagacttcctcagtcccttattcaggaaatatatttggcccatgtggtattttacttttttgatagaacttggcatcttcaacaggaaaagcgtatttactttttgtatcctggtcttcttccgttgttcagaatttctagctcatattcccagcctccccaaccagggcataacatttttatagccaccagcccaggctccgtgggttgaaggaaagagtttttggatcctgttattttcctggaggaagagctgaacattgactcttttacaagaatccaaagtatgcattgtcatttccatgttaaccctcactcgaaatttttgtgggttttgaaggattgactgtagcccagtcttagcaggatccctggccatggaaattcatttgaagcacattgtgccatggaagtaccctgcaggtaaaaatgctctatttatacttggctgagtcccagacagctgctgtctgcctgttgggactgggagcagatgtaggggtgatctgccccctcctatttttttgtggatttggaagcttccctgttgagagtgacaaaaaccctgtcaattgatgtggtaggtatgtcagacctggacagctggtccttagaaaatatgctgagatcaccaagttaacaggtacagaagggtttccagtttgttatatgatgttgggcctgtgactccccacccccctttttagggacatgtcattaatggtggagcgcttgttaaaggcttctcttgtagcatgtgtaggtgtggctaaagaatagtgaatttgattgatgttaatgtacatctggatacattctcattttaatttttttttattggttctagggacttttggtaaagattgtggatgtcttcagttttacacatttaggaaacagtgtctttttacttatttccagtacagttgtgatgtattgaatgacaagggactttaaaacagacatgctgtgtataatgttttcttcctgattaaaaagtaatatctgttcattatttgaatagttacaattaagaaacagattatttagggatgaaaatttcctgtaatctccagagatatgtacacttaacattttggtgttcgttcctccagattcttttctatgattattgtattatattttagaattgtagtttacccaccagcgtattttaagaagttaccagaaaggcgtctctgagtatctgaagcctttcatttagccatttatggatttcaaagtatcttatgtggggttagtctccattgagactcaggaactctgcaagagggagaagcattggcttctgctatgtgcctgtcagtgtgctttaatactttacctggatcatctcttccagtaaccccacagtataggaagcattattatgctctttctgcacataaggagatgaagattcagacaagttaagtgacttgctcaaggtaatacagttaattgtagaggacttgggattgaatttgatttattgtctagagaatattgtatggcaccctattactttcctgtattgagatgtaggtggtgggggtgggggggttaagctgaaaatatctgtgagatgtataaagctgttggatagagacacaccatttctttcttcttatttttttttgagacagagtttctctcttgttgcccaggctggagtgcagtggtgcaatctgggctcactgcaacctccacctcccaggttcaaacgattctcatgcctcagcctccccagaaactgggattacaggtgcccgccaccacacccggctaatttttgtattttttgtagggacatgtatagtttcaccatgttggccaggatggtctgaaactccttatctgaagtgatcagcctgccttgacctcccaaaattctgggattacaggcgtgtgccaccgcgtctgtcctaaggagacacactgtttctctggcttattaagaggtatttggttagtatataaacattttcgtagcttctgaggttttgcagtcatttgttcagacatacgggttggtggaaatgctttctgttccttttcccaaaccaatcacacagccatataacttcatgcctgagtttctctgtggtcctctatagtgagtggtttttacatagttctttgcagcagcatgaatttcaaaaatctccaaacttttgctattgctgatctttgtaaactttgcacacccagcgctggtacattctgatgatggtgtccacactgcactttatgaagaaaagactgatgattgtttatattaaaatgtaggaagagaattgtagcagcaacttttgcttctctaatcaacaacaccagaagagacttactgtgtgtggtcagtgggggagaatgttaatttataaattgagatagttgtattaaaattgagtgactcttattttgacataaagtgaatgtgtctcttttatacagcagaaaactattaaatttgttttttctcatcagtataaaataaagtggaaaatgtgggaagaatacaaattcttaacttctgtgcttctgcttatttcacacccctcaaatttctgattcctttcaactgtagctggctttactactgagtggtgaaattgctgaacatacttaaaaccacatcatttaagactttgaattttgacatttcctcctcttcacagtctttaaatactaggcaacctgtagggttccactgtgtctgtcatgtattgtccctgtgttacatgaaagcagcctcagtgaacttgtgaatttgctcagtcatttcactggctactgggtgaggaagaagtaggattttctctcttaaaattccttggtgaaatcattggatgggcatgatgtgtttctttaattttcattttggtaaaaaaatctactgacaaagcaaagactttcagttgttcttggtctttcagtaggtttagtttttaagtgtgtttactctgaccaaaaactgccttcctgtaatatgctcctccctttagaactcagttcttaagtagagtttgtttaaatgtataaaataagttaatgcattatatgcagcgaggttttgcatcagaaccctgagttctcaatgttgtggcaggtttaagtgtctagaacaccttttagctgttatttctattacttgcttttttatttttggggtaaatgatatcttctcagggaggccttccctcagcaccatgttttaaagggcatctccctcatttgctattccttcttctgttttatttttctctatagaatttgttactgtgtgaaaactatttattttaatgttttatttacctgtgttacccctagaataatatctatgaaggtagggatttttgtctgttccttctgtgcctacagagtcttgaggagtatggtgtctggcacattgtaggtgcacaatgacagctgaattaacaatgtcagggagagtttgtaggatggggctcgaggtatagggcaagtcagtttttagatttgaggtcattagcaggagatcctcttacgatgtggggggaaaaacacacgttttaacgtcagactgggtttgaatctggtctctccaacttaccctttgaccttggtgttaaatgatttaacctttgaaagatcaatttttttcactagtgaaataggggaaatagtatctttttagtggggattaaatgtaatatcaaatataatgctctgtaaatgttagttttgtctttcccgttgtgtgccagcattgtggaagtctgaaagcaacctgaatttaccagtctgtttctggagccttctggggtcattactttgattacttttgacagatacattcttttcagcagcctgtgttgccagcataacaatgacctgtccctttgaccagtgtgagggacagacactttgtcatccctcttttaatccttgtatcagaacaactcttacgagttctggttttgaaacatgtttagaggagtttataattccgaacagttcagatgacatcagccctttcttagagccctctaagtttgctcagcttcctcattccagtgtggcgggaaccattcagttaaattgatgtttgtggtctttacacatagtcatccgaagtttcttgcaaatcacgaaacatcagagggctgctaagtcactagtttgtctctgtagatttctctaatccaggcttgtccaaaccgtggcctgcaggctgcatgcagcctgtgaaggctttgaatgtggcccaacacaaattcgtaaactgtcttaaaacattggctgggcatggtggcttacgcctgtaatcccagcactttgggaggccgaggcgggtggatcatgaggtcaggagatcgagaccatcctggctaacaaggtgaaaccccgtctctactaaatatacaaaaaattagccggttgcggtggcgggcgcctgtagtcccagctactggggaggctgaggcaggataatggcgtgaacccgggaagcggagcttgcagtgagccgagattgcgccactgcagtccgcagtccggcctgggcgacagagcgagactccgtctcaaaaaaaaaaaaaaaaaaacaccaaaaaatcagctgggtgttgtggcgggtgcctgtaatctcagctactcgagaggctgaggcaggagaattgcttgaacccagaaggcagaggttgcagtgagccaagattgtgccactgcgctctagcctgggcgacagagcgagactccatctcaaaaacaaacaaacaaaaaaattatgaaattttctttttttgcaattttttttaaagcttatcagctattattagtgttagtatattttatgtgtggcgcaacacaattcttcttcttccagcgtggcccagggaagctacaagattggacgacactcttttaatttttgtggcttaacaaggtgttaattcctgtataaatttcactgatatttcttctgcttgatgcaggaacacttgacaagttagttaaggtagattggtccataaatttataggttctttcattcccatgtcctaggcaagtctgagcaggccctggaaagctgattaaaaggccagtgagcacagtgagcttaattgtaaattaaatggatatttaatacattaagaaggcactcaagcctttcaatctttcattttcatccatgcttgctgtttgaatctgatgggcttgaaattgactttgttcttctaaaaatgttggttggttattgctgcctttctcaagcttggttttcagtgtggatttctgcagataatttttgcacctaaaagtacaaagtcattaagtgaagatagtcaggaaggaaagagtgccctgagccaggaggtctgttatagcgcatggggtggaccagagaatgaatgggcatgggcatggaggtggttcagtcagtgtgggaaagccacttgcttgtcagttttctactgcgttgtccagcagaacacgttgaagcttggggcctgcaactggtgtggagatgattgcatttaggaggctgatgtagatttttttccctctaagtgtgtgttaactgccttttggtgaagtcttgatccgagacatacacaacttgatctgtgaggattgtaatatcgagatggttctgttatttgagttaggcatggctaggctaccaaggcattgcttttcagtcccaacagttggtcatttcaatttcagtgaggcttttgtgatttgttagaatacaaagtttgttattttgtctgtgtttttgcatgtatgaatgacactttatactgttattttgctggttagtatgtgccttcatttacctattgtgagtaagaaacttcctcagatcaaattatagtaaagtcacttggttctgtttctctgactcttaagagattgagatcactttatactcaaactcagggtgtttggtaaaggacctacccttctgagcatttatagcctagatgaagtcctggtccaatcaccaagttaaacttttaagaacatgctattcttaatgttcaggaattcaaccctggaagccttctctaaatcttaatgagatttttatgagaattcatttagtgaacataacaatcagggaatccagctattaactttgaggagggtcatgccttttagtggttagagaggcaagctgtagcctcccttctcagagaaggggaattgaggaagagagttctagtggtcccttgcaatcctcccctcactttccaggctccctagtaagactgcaagaagtccctgagtaaacagcattttgtgagtttgagggactacgtaaaaatgtaagtgaacatacaatggttttgctttgataactgttttaaatatcctgttggttgttgaaacttctgtgacagtgaagccttttgtctttatttttcaatcggaagatctttcttccccacttgaaaagattgagtctgggatcaattcctgaccccgcttccttcctaaatctcttagtgtatagcatacagctgggcatatggtaatctcgggcacgggattgtactcacagagctatgcttgacacctaggactttaggtggcttatatattttcggtgacaacttttaattttattctcatttattccatttctgtttcagtgtcctgggtcatgaaacttaatccacagcaagctcccttatatgtgagtaaatcatgagatttcttattattttgtgtttatctgttctgcttacttgttataataagccacactctcacatgatagatcctcaaggaaaattttaaccatatgtccatgaatatattggtgtaagacacttcagaaattgagtttgatttagtaaatactaaatggctaatctgtgcatggaaatgaaaacaaataatacctgtaagacttgagagttaatttagtcagggtaatagtatgcatgtatgaaacaaattgtcctgccaaacagtactgtagcttcttattttttacctgcagtgcattcctgtaaaagtagtgtggagatcctcctactgccactgtgatttaccttatgttgccactaggtggcactatgtcattggcaagagtactgttttctttaggactcatctccctaaagtgagggacttccctcattcagtgggttgtcatttcactttcttgatgctatcctttcaagcacaaaaattttcagttttgataatgttttgttgttgcttttttttttggcatcatatctaagaagaattctttgcataacctaaagtcacagagatttattcctatgttttcatctaggaattgtataggtttagttagctcttacatttaggtatgtaatgtgagagttcatttttgtgtattttgtaagggaagagtccaacttttttcttttgcatgtggatctccagttgttccagcaccatttgttgaaaagactgttctttctcccattgaattgtcttgggcatccttgttgaaattgatcagaagtgtgaggaattttttctggactctgaagtcgattcctttcatttaggttgtttttgatttctttcaacagtgtttggtagttttcactgtataaacttggtacttccttgaaatttgttgcttatggttttattcattttgatggtattgttaattttgttatcttaattgttcagttcttttttttttttttttttggatggagtctggctctgttgcccaggctggagtgcagtggcgcgatcttggctcactgcgagctccgcctcccaggttcacgccagtctcctgcctcagcctcccaagtagctgggactataggtgcctgccaccactcctggctaattttttgtatttttagtagagacagggttttaccatgtttgccagggtggtctcgaactcctcacctcgtgatccacccagctcccaaagtgctgggattacaggcgtgagccacagcacctggccaattgttcagtttttgattgttcattgcttatatatagaaatactgttgatttttgtgtactgatccctgaaactatagccttgtgtcagagatgagttacaaactataatctaacttgtttggccacagtttttaagtggatgccttaggattttctctgtacaggatcaagtgatcagagatcgttttcttcctttccaatctggatgcgttttatttctttttcttgcctaattgccctgagaagcatgtctggtacaacattgaatagaagtggtgagcgcaaacatccttgtcttttcctgatcttaaagagaaagcatccaagctttcaccagtaagtatgatgttgttaggtgtgggtttttcacaggaatcttttgttaaatgaggacattcccttctattcctagtttgactatttttatgatgaaaacatgttggattttgtcaggtgatctttctgtgttgagatggccatgtaggtttttttcctttcattaatgtgatatattacattgactcaattaaatagtttttatttatttatggagatggggccttgctctgtcacccaggctggagtgcagtgacatgatcatagctcacagcatcgtggaactcctgggatcaagggatcatcccacctcaacctcctgagtagctaggactacagatgtgcgccaccatgcctggctatttatttatgtatttattgagacaaggtcttgctctgtcacccagcctggagtgcagtgacatgatcatagctcacagcatcgtggaactcctgggatcaagggatcatcccacctcagcctcctgagtagctaggactacaggtgtgcgccatcatgcctggctatttatttatgtatttattgagacaaggtcttgctctgtcacccaggctggagtgcagtggcgcgaccatgactcactgtagctgcgatctcccaggctcaaatgctcttcccacctcagcctcctgagtagctggaaccacaggcatgtgcacccatgcccagctatttgtatttattttttgtagagacgagatctgactatgctgcccaggttgggctcaagtgatccttccacctcggcctcccaaagtgctgggattacagtatgagccatcctgcctggcctgttttaatttttagagataaggtcttgctgtgttgccaggctaccttggttgaatttttaatgttaaggcaacctggcatttctgaggtaagtatcatttgataatgctgcacaatcttttttatatgttgttggatttgttttgaaagtattttgaggactcttgtgtctatacatagagatatgttctatagctttcttgtgatgtctttgtctggttttgagtattaaaggtttttggttagggaacagttgtaaataagtagttgtgttatacagaaggatggcttccccaaatttattcacttcttaatccctagaacctgtgaatatttaccttacatggcaaaaagaacttttcatacttgattaagttgaggatcttaagatgggagcttattctgaaatatctgagcttcccgttgtaattacaggagttctcatgagtgagagggagtatcaggagagtcagtggtcagagatttgaagatgctacactgctggcttagaacatggaggaaggagcccatgagctacggaatgcagctctagaagctggaaatagcaaaagaacactttctccacatagagactctagaaggaacacagccctgctggcaccttgatttttaaacaagtgaaagtcattttggacttctgacttccagaaatgatatatgataataaatttatgttgtcttaagccactgagtttgtgataattttttgtaacagcagtagaaaactaatagagtagtagtttgagaaaattagtgataaaggatacttgggaaggaaaggataaatgcagttaggtcagttagaaactctctgatcttgccatcatggagcctgagaactttagagttagtaaatactttagctaatatatgcttcaacctctcccttttagacatgaggaaacgaggtctgaagatgttgtgataagatggcacagctaattggtggtaaattgtgaattgaacctttgttttctggacttaagtcatagaaaccactgtaaaccttgttaagctttaaaaagtttcattctgttagggaagcacagctcagttctgagtaacatagttaatacactaagtgctttgtatatgtttgtgtttaattgacttgagcaggctctactgaagaatacttctttaaacttcaggattcaagtatgtccatcaacagtaatacttaatggggcaatatgttatctcctttttaaaaggagagtaacagtgtattggattctcagtgaactgagtcaagttgcagggatttatgctgttttggtgaggaaaagtagctgttttatgatggctcattgagcagggtggtgggggaagttctctgcacctggacaaagaaataagcaagagaacaaagactgtgaagattttcatttagatcatatttgggatctgccaggggtgagtatcatcattagaagggagaatattgctgctaaataaggaaaaacactgtacccggagaagaacttttatctgtcagttaagacaaataggctggactccaaataaatattttaatcagactttgaataaagatgtgtccagaatacgttgcaatagttaaaaatgtaaggaaggttccaaagtgtacaggtggcagtactgttggatgtttcaattaagctcttttaatgaattattttcaatgaaatgttcaccataaaatgtgcaggaccctggcctgaaactttggagaccagtagctcaatatggctatgccttggttttcctgtctgttagctctgattgcatgagtacaacctttatgttaggcaagctagttacatcactaagtcgggtttttctcacagtcgccacaaaagtaatgattattgccagatgaattcataagaattgcattttcagttccatttagtggtagtgctaaaaactctgagtagcttagtagtatccttcttggtatgagggcctggattgtttagagagaggaaagatggagaggcagtggcagatgcaagaaatatttcaaaagaaacagcagggccaaatgctttattagactatagggagtgaaagagaaccatgaatgacagttgattgagaacttgagtgtgagtgacagctgatgccatcattgggtatagagaagaaggagatgatgatcttgttctttacacatgttaaataaagtcacatgggtatcctgttcataggtggaggtgtgtgcttgaaactacagagcaaggaagttggttttgaagtgaaatcgtttgagtcttctctaagaaattgattcttttgacaccatgtgactgtaagaatagatgagctctttgagaagctaaaagagtggatggaattagtatagtggactgtggtgtagaagacaaagtgagtcaagaaaggagttccagaaacctgggttgcattttagccttaaacattttgttcctggtgtttcttaatttcacttatacatcaggattggaagtaaactttgggctggagctgggcaatttattcttttattcaggtgccttctttgtgccaagacctgttctggatgctggagatttagccatgaacaaaacagaaggtccctgctctcctggtacttgcattgtagtgagaagaaggaagacagcaagataacatatcaggaagaaaagttctatgaaaataaatgaaatggcgatgtgattgtgcctgaccaggggctgttttatcttgggtggtcagggaaggcctttgaggggcatgtcatttaggctgagacctgaaggagccagcatgtgaagctcctagaagtgttctagcccaagggaacaaatgcagaaactctaaaatgagaagtagtaacttaatatgtttgaggaacagaacagtggctggggcttaatgagtgcaaggggaaggggtccaatctcttctgcatgaggttggagatttagggaggagatgaggaagaagctggatcttgtaggatttaacagaccactggataatctccctgggcctaccttccctcacatctgaaccctactacagctcctatccctgtgtgtactcagaaaacattagagctccttctggcttgaggtcaagtcagacctcttagggatactgggatttatcctaatgtggatctgctgaccctgggcagatgggattcttagatagtttaaacatacatattttggactacccttttgaggaaaaaatagttttagtcctttctagttgtcattaagatccacatttagatataaatggatgttcttgaattgaggaatatgtatatatttatatatatttattatatattatatattatatatattatatattttatatataatatatatattttagcagatttggctcttatgagaggacagtgtaataaagaatacttctttgtttttatattgtttcatggctggattgctttttgggaggaaaaaaactattttcaaaacttggtactgttactccatttgtgaacctgaataagtggtgtataatatgatttaatagtagtcctttcattctctagttttctgtgggtactttacctgcagttgtgtaattcatttgcatcacctgtaacctttctagttgacagctccttaaaaacaagagctcatgtttgcatagtacctcatagttaagaaagcacatttgcatgccttacgttaatgcatgcagtgctcacagcagtgttaccagtcccagagcagagaaagctgcatcgttactttcgtcatacataaggaaacataaggttaagacggttcatctagtgaatggcagaagtggggctttacccagaaatggttactctgaaattcattttcattcttctatataccaagatgtcttattacaaataccaagtccacaactgttccataagatgcaaacatgtcatagcacttaatattatagagacttgcagaaataaaatccttttaaagaataggtaacccaagtttactcttccatttcatgttttaaaagatttaatgggttttatttgaaataactccaaggccaagcacagtggctcatgcctgtaatcctagtaccttgggaggccaaggcaggaggatcgcttgagcccacgagttcaagcctgcagtgagctatgaacataccactgcactatagcctgggctacagagcgagaccccatctcaaaaaacaaaacaaaactttaaatgtacagagaagttacaagaagaatacaataacttcacctctatcaactcttgttaaatttagtcacatttgcttattctctgtattacatatttttatttattttagtcatttgaaagttgcaaacagtatactctgttccccttaaatatttcagcatatatttcctaagaatgaagacattctgcttcataaccacagtataattaacaaaaaacaggaattgtaacattgatgtaatactcttacatgatgtaagtctatattcacatttctctaattttcccaataatgtccattatagcacccttttcctttttcaatccaggatttaaacacattatatctctttagtctcttaattttattttgtagcatgttttgtcatgattttggcaatggactacatgagtgatgttcttggagtatcacattaggaggacacatgatgtattcttttccaattattggaagtgttaactttgataccttagttaaggtggtattgaatctacataatttatctgttccagaggaattgggcatataagagatggtatgagtagttgttcactttccccctctaaagttgtttctggtttggaggtatcttttgcatattggattttcctaaaatggggtacccttgttctgcgcaaggtgtacccttgaatataggcgaaagggctaatgtcaacagagagctcattttgagtgataaattgcctgaggtttaagggggcgttgtctctgcctttgtggatacacatggttatttaagaaatgtaatactcagctgagctataatgaccatttttaatatggaacatagtaggcacttagtaaacattcattgagtgagtgaatgaactacagtttagataagactactaaaattttaatgaaattcacttcattttgacagagctacttttcttaaaattgctcatttgtttcccaggtttcattcattaatctgcctagcataggccctgagtagctagtgatgtcacctttgttactgaaggtgtggccaacagggaaatgaaggtgataaccttgtctttatggtgcatgtggaacctttgaaactgtaaggaaatccttacagcatccctgtgaagtacagctgagtgtgtttgatagttttattacagagatgcattctgtgagataatatcttacctagttgaagaagcgtactagaaatagtgcctatatctctccagtcctgaattatcttagttcttttgggagttataatctgagccatttgtttatagcaagccatgtgactgcttctattttttatgaacatagtacatgccccctttgtctctagagctctcctcactgtcaagatacaaagcatagtcttgtcctagacggggtaagggacgagggatgctgtcagatgataaaagaaaaagccaagcacatgaaggaaaggttggtattaaaaaatgtattacatttcttaaataaccatgtgtatccacaaaggcagagacaatgcccccttaaacctcaggcaatttatcactcaaaatgagctctctgttgacattagccctttcacctatattcaagggtacaccttgcgcagaacaagggtaccccattttaggaaaatccaatatgcaaaagatacctccaaaccagaaacaactttagagggggaaagtgaacaactactcataccatctcttatatgcccaattcctctggaacagataaattatggagattcaataccaccttaactaaggtatcaaagttaatgggctctatctatcaccactcccacactctaagccctactggatctagcaacctagcaactagactccagaaacagtaaataaatcctccctcagactaacagctgaaaaggaaacaagagttttagacttctgatgaaggaggaggaaagggtctttggatgccccttatgtcaggccccaggcttagtctggaagagatctgtctaggccaggcctgaagctctgcaaggtacaaggaaataatagctgtcaagaattaggcgacgtggatgaatcccatacttgatatgccagagaaagtcacttcctctgtcctctcatcattttactacacccaagtgaatgtcccacactcagttctacatgtaggaatggactttatgggagaggtcaggactggtgacgaatttgatgagtcataggaatcattgtatgttaggagtggttgagcccagtcttccggaagagtgaggatattgaactacagagagagattgagggaagttgcctgcagtttcacagcaggttacgagaggtctgaacaggtagcagaatctgcaaataattagcttatctggtgtacaggaggcaggtccctaattggtttgaatttaatactcaaagtacatgcgcagagaagttatagtataagattcagaacaaatgggctaagtaagagaaaaaaatgtagcaattggaagatgaagaagagaggaatattcaaaaagatagcattgtgctcctttcttggtggagtgaacaggtgaggattatactgtctttatggattataggtacattggaaaatagtttacagttattatttgaaattcctctatagtgaaggaagtagtcaagataaaatgtgttttgtgacttttgatataggaaagtcagtaatagccatctcaataaagtatatgctcagctatttcatctttatacttagagattcctcaagaggatggttacacattagctctggatcagtgagagtaagaccaaggccctggaacagtaaggctttctcttgtaaagctcagttcccatggttctttgatgctttttctgtgttagaataatgttctttactggtttccaacatgtttcggtgggcattggacccttgtggttaatgatctgtgcagctgtaactccagagtggctggctctacagaacactgactcagatggcttgtattcgatgctgataattcactaactaaaacgactataagaacacatttcaagaggagaaatttggggtgcatatctcagattcttcagttataaacttgcttttttgtgtctcttaagatttatggtctattgaacacatctctgtgtctccctcaggaaagccaaacagcatatttttgcccctgcaaattaaacactttttaaagccagtgagttactcagatgtgagatttcaattttttccaaggcatgctcgaaggtaatatatgggataataatcattacctgccatatgtttgggataaaacccacacttattagattttcaaggggaagagccattccaattataaaacaaatttccagaaccccaacagatctggttgattatgtcgtccttcctctcttgttttctctcagtaccaaatgtttttgcatgtaactgcttctgggaggaggcaaaacatcctgataatagaagagcaccataagaaagaattatctggcactagatgcctttctttatttaaaatgtgcaaaacaaaatctccagtgattttaaactgtttctattagaatagggaccgttccttatgatattgttctgttttcccaaggaaaagttagggtgctattattggttgagaacctactcttggcaaggaaacatggccagcacttaatacacattacctgatttaatcatgacaatagacatatagggtttggttattgtatccactttacagccagggtggatggtagggttcgcatcctgtgagtggctacaaagcacccccacctccttttttccctcaaaagcccatttaaagaagggaaatcagaagagcgtatccactggacttgcatttagatcttgagaaaagcttatcagagtgattttctaccaccacattgggttcctgtttactccagacttacattttcagcctccgtgaagacttggactttgcgcgtagattaacttgcttctctgtttatgctaattaaaacagacctcagaagacgagcatgcaaacggagatactgtgattaggaggaggaggttttaaaatttttatcagttaaaaaaatttattcctgaacaagtgtagtttgcataaataatcaaatttttgaagggccacagaaattaggttacctcagcttagtgttctcagttgcctccttatagggaagactaatttggtaatggcacagttttatcgttcttcctaggaaatgcatttccacagcaggctctgaaataacctggctgtgcttctcacttggctgttaggatacattttgcttatacaaagagccttatcagcctcctgatctcttaaatggattacctgcctttgccttaacaatacatttctgataggtctgctccagcatctgtgggctggtggccttgtccagccagatctgagacctgccagaagaataaggaaatcaagggttcctccgtctagcttttgatggttttacagagcaggaatttcagtttctttctgttggactttttaatcagtttccagaaacttgctttgaatttgaagttaatgggcttttcatttgtaagtagtattttctcatttttccttggcatttttagaacagacaaaggtacaaaggtcaaagacttttcagagcctttttacaggatactttttcaataactgggtgtttgccaagctatcacataacagtgaggggattaaaatttccatttggtactagtgaagaggagtcttgctgtccaagaaagattaaaatatatcactctgtacctttaattcatttaaaacaagtatttgtgaagcacctattaggtgaatgggacatttgatcttagaggaatagattctttcactggggaggaaggggctcagatgcatgcgtagataaattacagtgcaaggaatacctgttggagtgctgctagacgagctgtgcaaacagtgattgttcatggcagggagagaggaatggaatattggcagatgtaattgggaagctttcagaaaaggtgggggctctaccagcctggatagataggctgtggagactgggaagagcagagtgagaggaggaagcacagtctttggagtaaggcatggaagagtgttatcagttgtggggagagactttgcttgaccagggtgggcagttcacattgaaggatacctggagatgagattatatatagctgctctgtttagtaatgtagtcattagccacatgtgactgtttaattaaagtgaaataaaattaaaaattcacttcatcaaatagtgctcagttgctacacatagctagtggctaccatactgattgcagatagaaaatatttccatcattgcagaaaattctgttggtcagcactgataaaggaagtatggggttttacacaggataacagtgtgaagagcaactggagatcttttgaccaggcaaatagtagcatgatgaaagtcatacccaaaataaagagtagaaggagagcagtgaggggctgtcaagtaggtaggcctatcacttcaccgttacagcacacagaatgagatctggggatgatgaagctgttccgcaggaagaacatatggattttgtctggtagaatgactgaaaacctcaaggagccacagaatggccactgagggttttagtgtgagggacagagggagaatggtgtagcatcaatgagcaaacagtttggaggaggagctgccttggaagcctgagggagaacagtcatgttttttacaacaatgtgtggtagtaaggattaaatgaagtgagatatatatatatatatatatatatatatcacattgagcgagatcatagataaaactttagatataggtggttttaaaaagagacgtacccccgttattttgacatagtgcatgtaaagttacattgtgtggcttcgtcttgcatcttctgcataaatacttgcgctgagagctctttcccttgttagcttaggtagcaactaccttttactgaacaccttccttgtaaggtaacttactttatctcctcacccatgtgagatccattttatagatgaacgaacatagctaggaagaggtgaagcggtaattcaaactaaaaacttttgctcttcccatttcatctctgcacgtgaggatggtttcactatcagctccccaggttgatactattgaagcttgatgcttacatcacatctacatttagaggttgtctttggcactgaactctatttaccatctctttttcaaatgtaagacatacatcctataaaacttgcttactctcagtggtaattggtatgtggggtgacctggaatgactgccatctggacttctctagggcgctggctcttggtgtgaggtccgcaaccagcagccacaggcatgagcaccactaggaacttggtagaaatgcaggtgtttacgccccatctcagacctaaatgccagagggtggggcccaaaaagtcactttaaaataagcccttcacatgattctgatgcactccaaagtttaagcatataaaccaaatgaacaaagaggatagttttgaaaagcctcctatgaattaaattggaactgtatgggtacatttacatttttcaacacggctgactgtgtaacccatcagcagtggttgcctgtaaagatgcatgggaaagtgtatatattaagtaagatattatttcagaaggacagatctatggcttttcttttttaaaggctagcttcctgagtaaattatcactgcgttattgactcagaataatatcaaggtgtgtactatcaaatacagggttgggtatctctttgtaagagatagcagtgattttcagtggataattaagggaattagcacttcacatttttttcatgatatttttatgtcacttagaatttttcacgaattattccttgtatgattgtagataattaaagccccatatgctttgcagtagtagcagcagcgcagattatgatgcagatggaattggtaagagcagtaggttttgaaatgaggttgtagacgggctgctgagactgatttttggacagcataaatgaaagcagtattctgatgtcagcatttggagtttaaaaatccctagccatggatcccgtgctgagtcattggtacttcaggtaaaccaattccaactctatgtaagctagccttcagccatgtgaaactgttaacggcatctcttcctctctctgaactgcacccccgagccctgccaatccctaacacatgcataaagaaaaacacttatctttcaggattcatttcctgccacttgtctctgtggagcccctcctgagctttcatcctcctgtggatccatcactcctactcctatgccccggctactctgtgcagactttgtaataagagcttgagcacttcagatgcacatttgtatgcatgccttttccgtttattatgttccttgagggtaggggctttgtatttgaattattattttattgctctcatttttacttcagcttctatcacagtactttgtgcatcataatgctagtgttttttattgtttccaagtagaattaaagctgttctttgggaaagggtgttgcctcatacatggatgattataaatgtctgatttgccaaagatgagagttttctttttggttaggatttatgaccccaaagggaaggttactgtagttcatcagccaataaatgaaaccacacagggggattttgtgatctgggacaatgtgtcactttgctttgatctttgggtagagcctctaagaggtgctctcctagtgaaaacctggaactgatactaggtgaaaaaccggatttcaaccactgtagcctagtgcttccgtgtggtgtgtgggtatttacttggaacactctgtgtttgcttcttactacacaaatctcattttattggtctgacaaacctatgaattaggtttgagacaggaagatttatattttaaagttctagtatgttgattgtaacattttcattgctctctttggaaattctgtcacctgagatgagactattagctagattcgtgaagtcagcccactgaatctataattcagaaatctataaatagctcccttcaagtacaacattgggaacatttatttatatcagcacggaggtagaaattacatttttctggaggatacacgaatttattgattgatcggttggtgatgcacatctttagtactttttcctcattcagacacatttcccccccagagattctgcttatttccttttggatccttttatgtgggggctgtaacttagggtatttatctttaagtatagagaatgtcacctgtactcccagaaatgtgtttgtttgttaccctttttaaaccaggaaagagctattggctctggtgtctttggagcccttcacaaagctctgtgtctggattaactgttgaccccatgtgatatacagagcatctggcggctggggtggaattctcagctgtctctctttgttttgtccacagaaggaaatgtgagttttatcttactgctcaggcgatggtacattccttttttggttcatgggactaccaccaatctgattgtgggagtatttcctaccattcctgtcatcttccggaatttgttaaagaaggccaggggtgatcttcacctaccatcactcgtgaacaccattttcttctcaatcacctcttgtgttcctaaattctactttgagtgaagtgtattattgtgtagtttgtcctgtcttgtatggtttagggatcccaggcagcataatattaagaagctacaactgtgggtatttcttacagccagtattgttcctccacaaatcctcattttccagatccctgtgaaatttattatattcttgccaccatatactcgtgattatgtgttgcccatatcttgctaagtctcagaatacaaagtaattcttctccttgaccgtgagacagagataggtgtttttaaaaatgaagtaccgatatttcagtttttctggtgagtatgggacgttgatttttcatttgccatactgtatatgtgtgcatttgtatgcagtagaggttggcagaaatgtgtattgtgttcaaacgctgatcttaagcctctgtttattccatacctgctagtgcttatccactatgctatatgtcctacattaatttttctcatttaatcatcttaatgatctcatgagataactattttttttctacattttaaagcagaggaaagtatcagagaacttttgtcacttgctgaggtcatgcagctagtaagaacagagttagaattcaaaccagacctttcttcagaaacctaggcttttaatgatgtcagtatattgctcctctgtgtcagcgtttaaccctgcatggtgtagggaagaagcgggctattgcctaggatttgtgaaataaggatgttggtgagattattaaagtcagaaggaaacactgaaaagtggaatttgttgggaagaaggggaaccatttagggacagacactagacctttgtggtaactggtacggcggagcatggtgctgtggggtcactggttctcaaacttgagcatgcatttgggtcaccaggagggcttattaaaacccagattgctgggccacaccccagagtttctgatttactaggtttgggatggggtgaaaaattgcatttctggtaagttcccaggtgatccaacactttgagaacccatgtagagaaagtgtatgtgcttaggagtcaagtagacacagctttacattcctgccctactgtgggaggcttagagtcttcatcttaaaagttctgtaatatagggtagtatgtatattacaggatttttcatgagcactacatgtgatttagaaagtgacagcaatatttggcaattattgaatacttactaaacatcagttactttgagaagcatttaacatatgtaatttaatcttaagcagttaagtatgtcattcctacatgtaaaaatcttaatacgtatcagttgctcagttaatattcctgcacacctttatcagtaggccttcttaggcctggaaatgtgtaatatcccttagaaagattttcataaagttggcttatttctttaaaaaatgtcgacacttaaaaaggaaaacttaaaatacgtgtttttgtgaaatggttttactggtaacactagataagaaaagtgataatgtctgaaatgatagaattttcttctgattacttttgtggttaagtactgtgggttgtttgatactcatgtaactattcgttagaaatcagaaagcttaaccagctttacaaaaaagctggtttaccgttaaaattaattagatggattttcttctcctaaatttccatatgacaccttttcagacagtttctttcgtaagacttatttgccatttagttaaaattcttcacctattattaagtaaaaccaaaaagtaatcaattttattaccatactttatttggctctgtttgagaaatagtgtgttttactagaagagattaagagaggtagagacatggagattatgaaatgtgggatgtttctatttacttgggaatggatgggaacattttctttgtacctagtgtatgctacgtacttggtataccttgttaaaatactttagtacttactttatgtcgtggtaaggggattaaatggcaaccttaatttgtgtaagacatttaagacactcctggcacatagtaagcatttgatacaagagccattatttcatgcatttcagatatgggattataataatttccatcctcttagagtttacaatctaggagttcttacagggaatttgaggtagctcctaaaagaatcagcagttttaaatacacagctggtaacaagggaagctggtattctaagtcacgtgatttcaaagcctgtggtcttcctctggtactatagcccccaaagcaatgctgtccattctgtattggtaccttcccttcttaatcttgtagttgacagtgtcccacttcccaactttgaatgtctcttttccatggtctcagcatgttgtaccctgggttaggaatgatgtgtgaccagaggtgattcaacttgacctgctgggctccgtgacttaggcattgctggtgcagagatgacgattgtgcaaacctgatggactcatggaatcagagggcaccttgatctgcctgcagtgggtgaggcatagtatgtattagatcaggtaaaggaggcccttcatctgaggaaggggcccaggtttctacttagaaaagaaaggcattgtatttcatgctttactctctcgctctaatcatcagtgtgacagataaagggagcagcatggccgagtagtgagacaggtaggaagagtgagccttgaacatgtgttcatgaattctcaggggcttggtatacttgtagcaaagtgtttgaggagaggctctgtgagggagatgatgctggaggggtcagtgagggctaggtttgttgggggctttgtgtgctgtgtgttgaagggacatgctcaggcatagggctttatcaggagagtagcttgatcagattgtattttggagactctgtgcttcccagtgtgtggaggccagcttagaagcctggagtcccaacttaattgatgactttggagaaaaacaagagaactgaggataataaataaccaagaaagctaggtgaataactgtaagatataggtgagagcagaagtcagatcttcagattttaatgacagaatgtcaccttttcaatcagcaacaaagtagccgagtataatcttcaaccatctgctctctgggagaggagagaggagaggggaaggagcgaggaatgaggagccagagagattgattttagctaatcacttctaactctttcattaaatttttatggagaattaatacaggctgggcgcagtggctcgtgctggtaatcccagcactttgggaggctgaagtgggaggatagcttaagcccaggagttcaggaccagcctatgcgatgtggtgagaccctgtctttacaaaaaaaaaaaaaaaaaaaaaaaaaaaaaaaagaaaaaattagccaggcatggtggcgtgcatttatagtcccagctatttgggaggctgagacaggagggttgctcaagcctggaagatcgaagctgcagtgagccatggtcgcaccactgtactccagcctgggtgacagggcccaacaccctgtctccaaaaaaaaaaaaaaaaaaaaatccttacatgtctgcattttagccaaatatatggttttgttagcaaaagagagaatgtctctttaagtattgacctaattaataattctaccacttccagagagttgtgaaacatttttcagaggtagagacactctcgcttgctctttctcgctctctctctcttgctctctcgctcttgctctccctcgcaccctctccccctctccccctctctcccatctctctctctctccctctcttttgctctcactctctgtgtgtgtgtgcgcacatgtgtttgaaagccagcaccatctgaacaatttagctttgctggacaaaaatagacttgagagggagaattgtacattgaaacaagaagaacttacactcttacaatttttcaacactctcttccttttaaggaatacttctcattaaagggaccatacattaaattatatccaaacttgagtagttttaatttcttttctgtctgaaatccctgttagaacaatctctaaaactactccatagacacagaacttgagtagatttattgagcgccatctgctggctttgttttaatggaccaaataggtggtgcctggacatctttaagaattatcctgtatcttagtgttgcaaaattatgaagctggaagacagtatgaatttgggctatgactggtagtagtatttaaaataatagttttgtgttggcattgagaaaggggtatggttttggcaggagaatacacacaacctgattaaaaaagaagacaggttatagggatttcattggccagtatctttattgggcaaaagattagcctagtttaaataaaaagtaaccttaaatgccaaataaaattctttaatattttctaacagtgaagtcaacctaagtctttatctggaatgactttatgtaaaagtcgataaatttcttggtggatttctattcgtgttgcatgagatactttgaggtgtcttttaaagaaagatttataaaaatggctttgttggctagtttcaagaatgcgttttattttgagggatgtggatactatcttagtattttcctgctgagacagatataggaaaagcccctaggttaaataaataagggtgaagctgttaggtgctcttcttgtcattagtctttttgaattttagttatattttaagtgacttcttaagggcaactgagctaaaaatttggcatacccagaccattagactctagatcttttaattaatttctcatccagtcatcttaagtatttaagatgaattgtagaaagattgtcaggccgggcgtggtggctcatgcctataatcccaggactttgggagaccgaggaggtgggcggatcacttgaggtcaggagttcaagaccagtctggccaacatggtgaaactccgtctctactaatacagaaaaattagccgggcacctgtaatcccagccactgggaagactgaggcaggagaattgcttgaacccatgaagtggaggttgcagtgagctgagattgtgccactgcactccagcctgggcaacagagcgggactccatctcaaaaacaacaaaaaaagaaagattgtttacagaaagagagaccagaaaggaattcgtgcattcatttggccaacatttattgagcacctagaacaacgagacatacctttaggcaatgatgtagcattgaataaaacaaatatggtcccacctctcaggaagcttacgtaacagttgggaggaaaggggaactcagataaatacataaatacatgcttttagaattttatatatacatataggtataatatataatgtattaaatagacatacatgaataaatacgtgtcagaaagtaaatgatgctatggaaaaaataaagcagggcaagatagataaggagagttagggtaggagagctcatacttcattgaggatggtcagggatgacctcactgctaaggggacatatgaagaccaatggttattagtgttatataaaacagttgtttatgatcgtcttgcctgaccttcaccaaccatgtacagaaagcacatgggacagatgatgttattaatcgtttcatgggcccccttggtctagaatataaaggctgatccttggcactgctttatgcccatgttccctatgctgaagccatggtccgttagtccttgaatacaccgtgtttgttcagttctgtgccttcgtacatactctcccctccttggagtgactttatctcttgtcttcctagtcagctcttacatggcttttgaaattcataaattttactttctctgggtagcctttgtagtctcctctggcaaattttcttccttctctttctttatcttctgttaggccatagcacttttgaaatgtttctatttatagcacctgttatatcactgtaactgtatgttggcatgagtttcttctactaaatcagggggtcttaatctgttttttgttgatgtctttgggggtgtgtgaactgctggaaaactgtactaaaaggttatattagactagtggttggcaagctacagcctgtgaaccaaatctagcctgctgcctgtttttgtaaataaagttttgttgaaacacagtcactcccatttctttatgtattgtctatggctccttttgtgctaccaaaaaaaaaaaaaacataagaaacgagtagttgcagtagtaaccatatttcccacaaagccgaaaatatttaccatctgagtcttcacagataaagtttgccaatcctgatattagatgaaatggggattaaaaaggaaacatttggtgttgtatggcatgaagctgactgccttttccttgtgtctagaaaccacagcaaagacagaacaagtcacctaacttcaagtttctctttgccccaagacagagggcatgacattcttttagtcaaccaatttggatgtcaccaacacctgatgacaggtggtggtcgtgtggccaagaatgggagcttctggggactggtgtaatcagcttgcttcctttagaactgacatccccaaagcagcggcaagtgggagtaggatatgatggcagtagcacctaatcaccctcctccactcccacacatcagactggtggtgctccctgggcacaggtgggcacctgctggaaaagttttcagtgtgcttcttctgagacttgcccatgagggcgtggcaggaatgggggccatggatcctggcaaggatatattcctaaactgtccttgatggtgtaggtccctcctccttttctctgtggcattttgctttgtccatttgatgccatatctttacagatgggtttcagcaagatattctcaaagcatttcaagcaggaatgagccctgagtaatattgatggagcctctcttttcctcaggcactttgtgtaattttttttttttttttttgagatagggtctcactcttgtcacccaggctggagagcagtggcacagtcttggctcattgcagcctcgacttcctgggctccagcagtccttctacctcagcctcctgagtagctgggatacaggcatgcactaccgtgtctggctaatttttgtattttttgtagagatggggttttgctgtgttgcccaggctggtcttgaactcctgggttcaagcaatccacctgcctcggcctcccaaagtgctgggattacagacgtgcgctatcgtgcctggccttgtgtagatttttttaaaggtaaggggttgaagtggggaattccagccctctgacgggggtggtggtactgctggctctttagctgagtcctctatcgtgtttcatctggaccactcttgatagcttcctaagtggtctttctgtagtttccttgctctgtcctgttctccgcagaggaaccacagtaatcctttgaaacatgaatcatgtcactcttcttttcaaaaccctccaatggtttagcatcacactaaaaaagaaaaagaaaaagaaaaaaaaatccatattccaacctcgccttccatccagtgttcattcatttgctcctccagactgacctttgctattttttgaacacgctgagtttgtacttcccttgcactcgatatattccctttgccttgactgctttctttatcttcccttaacttgcttcattcaggtttcagctcaaatttgccttccttggaggagcttttccagaccaccctgtcaggaaaagtatcctctcatccctatttcagacaaactttaacccctttatgctgtcttactctttctaatagaactttccctctaatgttactttctataatttgtcttacctgctaaaatataagctccatgagggcaaagggccttgtctttcatgtttgaggcctagttcttaacagtgtctgacacatattacagtaagttttgtaatgaatgaattcattttgctgacaaaatgagtttcaagtggttcttatcaggggtctgtagctattaagtgactgattctgattctgtttcccagcctccatttttatatttcactaccatgtgtggcggctgataccttgttaccgagtagcatgttgcatttaagaaatagtgagtgctaaataatattaaagatttttgtgcatatgcttgctttgtaatggtattgatttcccagagaaacgaagctactcagagccattcatgctactttgaggtaatactaaaggaccaacagaacaggatagctctgttcagtgatttaggattttagatttttttcttctggtaggatttctgttttctagcttgatggcaataacatcatatatttacgttctcatcctaaggagccttggggtactgctttgctgtgaccgtgccttatgaatttgtctttcattttctagagcactccactaaattaggcagcacaaatgtaactcatttatcctataattaaattttgtgatattctccttttgaatgaattccgatgtaaggaaggccaagggatagcacttcagggtattcacaaagttagaaatacaaggtttgtgtttctttggggtttgctagtgttacatgacattttataagcgtcattatatccagtgtttagaaactctcaggtctgagagctgaatggttttggatttagtttgtagcctctgtcacctcctccgacatgtcacccctgtccactggttgcaaatatcatttctttcaaacataatttgaaatcaggtgagagagaatcggtattcctcaggctccttccaggtgacctgtgtttgagaagactgtgggaggcctccctgccctgcgttttgctcaggcagtcaagggcctcctctaatccctgcagtccctggtccttgcttctcttactatgcttttgatacagctgcaattgttaccttatgtgtctttttccctgaagaggctgtgtacaaagatgaatgagatgcagtctctggcccagcttcactgtaatggcataagctttcagagagtatgcgcctgctcgaggtgatctgtcttgagctttgagcagcactgggcttagacatttctccacagaagtctttttggtcatattcttcaaggtagagtttgggcattcatctccctgtacctagagaagtcagtatatgtattaatatagcatttgttatattactaataaatgtataattatattagtaatacattttattgctagtatacaattattgaagtaataataaaaggaaatgtttaaagtaacaaaatattttcagatattttaagactcatttacctgtcaacatgatttcatataatgtttgtattttaaaaaatgatcccagtaatggatggcagttctatatgtatatttgctagcagtaagtcatttgaaaatcctttaattaatgcaggctaggtttccacctgattatcacagatgaacaattatatcttgtcaagattgtatcatcctgaaaggctttcatagttaccaagggtgttattaacaataggtggttaaaataaagagaactctgaaatattttaaatggtgtggaattgagtgtatcatgaatctgggaagggatcattattttggtttagcaaatgagctttctgaaacatttgaaatgggaaacaagtattttaagttttggctgcagagtgctcacttgtgactgccattaatagagagagatatggcaaatcccatgtttttaggtggcgcttgagtttgggttcctcttgggtccatagggccatttctgggttcaaggcacaggaatagatagatgaaagatatgttatgaaaaaacccatttaaggctagagaaaaaaaaaatttctgagtttgttgcttttcttcagacgtctctcttccattgtttgttctgaggatttctttttaaaaagtcattccttttaatgctgcaagacttttatatccttgcctcttttggctttgctgatcctctcttctctgatttctcctcttctcggactggcccttccttgtttggcctgtttctctggatccatttcttcttactgccttcccttgctggaacaccagcgtctagtcattggctctctattaccacaaactcatctacagtcaaggttttagttcttaacttagtgcaggttgactttcagatctgactggccaggctagcccttttttgacagcttgccctgttacctacctgttggatatagaataagtacaaatatctatcctgtctaccctgctgatacatgaaacttaagattcaaagccccatcatcttatcacaaattattcccacaagccactagttttccttagagatacccctttttctcttaattctgcttgaggcttactatcttccagtcccatccagtcacttgtcatatttcatcaaattattattattgttaatttgagagacaaggtcttgccctgtcccaggctggagtgcagtggtgtgatcatagctcacttagtctgcatctcctggctcaagagatcctcccaccttggcctccccaggggctgggagtacaggcatgagccactgcgcctggcccaaattatttttaacagaatttttttctcacatttattatttttttagattggtagatcttgctaccatggcagttaagcacttttaactttctcacattgtgtttttgtattattttctccaaatggtttctttgtctctattctttttccttcttaggacgtgactgtgagagaaatctttctggaatatttgctgcctttaacaccccctcaccccccatttttctttcagtatataccacataagactgtctttttttttttcttcgtcgcctacacaggttcaagtatgaatcttttggcttgccattaatattcggcataagctcatctctgccatctttatttactcagttatggaacaacttcctaatgctagatgggccttgtgtgaagtttcaaaaagacagtttttgctttccataagcctcaggtggtgaagagaaacatgtacagcgcagtgcacataattgcacatctctctgactttgtcacacgtttggacccaagcaacacgtttgggtttgggtttaccgtgagtgtaagcagacctcttgcttctcctcccttctccacctccagactcttccatctttcttgttcttagcaccctctttctcctataccctgtagtccttcgatgcctgcgacttgcttgctatgtaacatgttccttctatcaacaatgatctctttacacgtatctcttttttccccacacctaactgtgtctcctcttaacttcaaggtcaggatatagaggaaagaatacagacttaggaatcctacttggatttgaattcccgcttgaccccttctagctttttaaaggcaagatttaaaaaatactctcggctacagctttctcatctctaaaatggagataaagataccttgcagtatttgcaaagcacctcagtcagcccctcacctgcagtaggcattcagaaaatgcagtagtatgtgctgactcatcttcctttctcacctttaccatgctcctacagtgttgactatttttatgtatgtatgtatgtatgtatgtatgtatgtatgtatgtatgtatgtatgtatgtttttgaggtggagtctcgctctgtagcccaggctggagtgcagtggtgtgatctcggctcactgcaagctctgcctcctgggttcacgccattctcctgcctcagcctcccgagtagctgggactacaggcacccaccaccatgcccggctaatttttttgtatttttagtagatgctcctgcctcagcctcccaaagtgctgggattacaggcgtgagccaccgttcccggcccagtgttgactatttttgtaattttagtttagtgataaaaacgtctgtggtgttgtattatttatttttcctaggtcctcgggtaaaaggcgcttgtgtgagcatggacaggctccatgctctcagagtgaggctgaaggaacttctacatttgctgttaatgatagagctttcttcacatctgtattgatagggcttcccacaaccccagcccttaatttattttaaagcctttttacagttttttgtgggaagccttggaggttttacaattttttatttttatgtttttaaaacttttaatgtggacataattccaaaatattaaaaatattaaaaaataattttataaagagttttccaaaagtagtacaaagaatactcatatattctttactcagggcaacacctgttgttaacatcttacgccatttgctgtatcattttcactctagcgatttacctgtaggccgacaatttttttccttaattatctgtcagtaagttacatgtatcctggctgtttatttcaaaaatgcttcagtatgtatttcctaaaatagggatattctcctttgtaatcacagcagggtagatactgctctttagttgtcatgtctcttagccttctttaatgtggaacacgtccacaccctttctttatcttctgtcttttccgattttgaagaatacagtgccctctcctcttgcttaatagactgtttctcattgtccgacgtttccttgtgattaggttgagggcttgcatgcttggtcagagcactgcataggtaaccttgtgtctttctcagtgtgtgactctggagacacatctgtcatctgtctttattgagatctttattttgattaacctgttcagtgtattggcagatttcgctgaatgaattctcctttttttttctttcttataactaataagcagtctttggggagacacttaaagactgtgtaatatgtatgctgttcctcatcagaatctccctctggattgagcattcattgataactttttgccagagtgaatctttaccatatgtttgcgcagtgataattttactattccagcaatctcccctctttaagcagtcagcccgtcattctgtgatactcataggaactcccttctctgctgtataatttatctactgttattaatatggactcatgacttcctatttgttaaaaaaattgtttataatttattgctgttcttgattgtgtagtctttaaattgtcccaggtttgtacagaggaagccacttgagtctggcttctgtgtccttaagacatggccccatcgtttttttgagcacttcattgttttctgtcaaaacaagatattacagtctcatcttatagatactctgacccaggcctggaatcagccaagtctctgaagggactcggttctttttattggagaatggtattagtgaccaatgcctgtacactagataatattcattgctactgagtgttcctctgttgtgtaagcctttaatgaaattgaacactggctgccatgagttgccaagttaaaatgccatgactttgccttttagcctatggaaaagttgtagctacctgtcagtgtttggttgttttagcagagtaactgggcaaagtgttatcaattgcctatcaattgtatgtttaaaggagagaacgaagatagttatgtgaatacaagcagtgttggttaatgagattttgaggggttttttttttttggtactgtaataattgccacctcatggaaaggtaataccctgtaataacactcagtttttatttagtttacttaactctcttgtttcacttttcccaaatttgcagtgggtataaatcctgtcattttgtcagactgggaaataaatttgggaaggcctgtgaaacttttaagattctggattgaaaggtagtttttgttataatttcacaattcttggagcctacaagaatgtctttacataaaatatgtgactgcaagatataaaaaataaactcaggaatctaaattttataccttttaacttcaaatatttgattataaattatttgagcagatatttcttggaaactattctgaaataatttcaagtttatagaaaagctgtaaggatagaacagatattacatcttataaactttatgcccctattttccaactgttgacattttgccatatttgcttaatcattctgtctcttatcatttctttcctgaaccattggagagtaaattgtaggtctcacgtccctttactccaaacgctttgttgtgtggtttctgagaacaaaggtgttctttcataaccacggcacaataccaaaaccaggaattttaacattggttccatgttaatctgtaaacctcattcagattttgcaagttgtcccgataatatccttaatagcagcttgtttttattaagtattcactccaaaatcatgtgttgtgtttagttggcaaatctttttagtcttctttactctggaacaggacctcaatctttgtcttttgttaatgacattttctgaagagttacagaccatttttttacatagatgccccttcaattcaagtttgtctgatgttttctcatgactagattgaagttatgcatttttgttaggaacactgtaagtgatgctgtgtccttagtgcatgctatgtgaaatgtgatgttagcttatttctctatggttatttttccttttttttttaaatcatttgattcaggtgttatctgccaaagttctgctttcccctttgttatttataagccttaagtgagcatttctccaacatctttgttgtgtttttaacaacttctttaacattttaaacatcttttctgttgtccaatttttaacaacaaagatgttaaaaatcagaaaactcagaaaagcacatggtgtattaaaattccacctaggaataactgccattaaagttttggtgtctccctttctgtctcttcagatgcaacttactagtctagacaaagcaggtttctcagtgaataaaacatgctctaatggggtgtacatcctggcacattataatagtagtcatttattgaatattatgtgccaggcacttgatataggtgctttccttttatcaatcacttaattcttcaaaacgaccttatgagataaggttgatgattcttgtcctccattatggcataaggaagttaaacaacataccccaagttaaacagatgtaaagtgatataccatactgtgataaagacacaggcaggttggtgtcagagatcatcttcttaatcacggtgatacactaacaagttataaactaacaagttaacttaaagtggtgataatactgaactgctgtgaggagaactatgatgacactgttacctataacctgtgatggtttgtacttgactagggttttgtcttatagcaagacctccattctttccgtaagtggtgatgtctcttaaatgggcctgccacggccttccttggtcctccctgtggaaattctccccttttcccctctccttcccttctgctgacctgttctcagtggtgtgctggttaaaaagaaaaaaagaaagccctcatttatatcatttgccaatttcagtggtgtaaatactcccataatggttgatttcaggtatccacaccacattacgaatacagatttgacaagagatgtgagttgtgaagacacgcagcaggacaccattatgtggaatttctgctgtctggatacaatagatacaaactttcagggcatggagaatagtatgttgtggtaaataattagaaagtgataagttttgagtatttatgacatttgtttttaatgcagtttacttagttataagcctatatcatgtaatttttaataatggctgagtttaacagctgtcttgcagaattcctgaaaatttaacaatgagcactcatgagcctacacaagccagctccagtataccactgtgatttctttgctgctgactgggcccacctttgaaaatctatggctgacacttccttactatctaagatgacatcagtgccatcctgtctttcactcttcctcctacagggctttctatctcattctcctaatccatatctactaccttccctgttcaaagcccatttctttccattcatccctgcactgtaatttgactcttcccatcccccaaatacgtttccctttcccatcacacttttttttttccccccatcaagttacttttcccagttaaaggaaagcctcagaccactagtatcttgggacatggagagtctcccagcaagatgttgggtcttatgaagtgaggaaatctttggtctagaaaaggaaaatacgttcttagaattccagggttgaaatctaggtgaaaagatttttttaaacttaatatataaaggaagttacagtgccattattatagtatgtagctactctaagaattacttcaggatggggaaaagtgagaccatggctaccatttaaaaccccattttaaagtaactgttttataaaaacctgtttttatttgcaaataagtgatttgataggtgatattttagaacacagtttatttatatgggggtggggggagctaacctatatttacagaataaggcctagtatagaggtcttttccattagtttttgtgtcatctgtcagcaaaactaattaggaccctgaaaaaattgtcagttgcagggatacatttctcactaatgaagaaacatggaaaatatctgtgtaaggggatcacgctgtttcttaagttcagattattggaagagggtggtgatgtaggtgtgtactcttcctgaggttgggtcaaactaaaatgataattgagaatgtcttgaatattgcccttgttaataagttgatctattttattttatttagaaacatggcagacttgttcactgtgtagccagactgatgtgtctatttattcttgtaggctggtctttcccaggcacagcagaataatttattaataccagggtattctttaaggatggtaggattaaagcatcatgacaaaaattgttacctagatctgtttttccttgttattttttcatcaccattctactcatttaatctttaaaagccatctcaagtaatagtaggtacctggttctactggagtaaaatgggagttagtggctgaaatgcagtttgttatttgctgtcagtgactttatcagtgtgcagagaatactccttcaaggaaaacaggtaattttaattccaggtgccttcggaatctaaatttcaagaggctttgaaatgaatggagcttctgtgttctcttctcttgaatattttgggcataaggtagtgtgacttaatattaaaaacaaacaaacaaacaaaacaacaaaaaaactacagaccaggtgcagtggctcatgcctgtaatctcaacatttttggcaggccaaggctggaggattgcttgagttcaggagtttgagaccatcctgggcaacatagggatacctgatctctacaaaaatttaaaaagccagaagtggtggcgcatgcctgttgtcccagctacttgggaggcagcagggggaggatcacttgagtcctggaactgcaggctgtggtgagccctgattgtgccactgcactccagcctgggaaactaagtgagaacctgtctcaaacaacaacaaaaacccaattaaaggtatgaaagcaatttaaaacttacttgtaaaaagaggttcatattgaaagcattgctaaaaggatttcatctgcctataattagccacctcctctgtccccaaaggaaggcccagacttcactagtatcttggggcacagagagtctcccagcaagatgttgggtctcatatgaggacaaaattcttgatctggaaaaggaagatatattcttagaataccaggttagaaatcaaagtgaattttttttttttcctgtaaaagtccagatagtaaataatttaggctgtgggctaagttctcacgtaatcattaccttttatggcccattgtagtgcaaaactagccatggatgatgggtaaatgaatgggttgggttcaattaaacctttatttattgacagtgaaatttgaatttcatgtaattttcacattaaaaggattaaaaggccttctttcttccctaaccctaacccccacacccgcccccacaaaatgtaaaacaggggatggtgggaggctggaattgacttgtgggtcatagtttgtcaacctagtcatagtttgtcaacctgtgctgcaaaggatggaactttttatttgtacttttttcaggctgtgaggatatttcagtaccttgagaaatggactcttctcatacacgctgcaaaaacatctttttaactggttgcatcatgccaaagaagattacacattttaccaggctaagcttttcaaaaatgtttccaagagagagtcttataaacaagacagaagtctaattctgagtagtaactgaagtcagtgataattctgttttaccagccgtgatattccttggattaggatactgttgaatgctccactgtggtagtcgtagtagtcatggacccactggagcattgtttgttaatagacctggttcctaggtttgacttgatgatttttgctttttagtgtttagtaaaaaactaccttctgctcagttatgctgctgggcttagtaaattgtgaccacagggtggtatgtttctcttgttggctttaattgttgctaaaatcgaaaggaaaaatattctgtacataatgagaatttactcccctaattatgatgctaaaatggcccagccttctctagattgatttttctatagtgcattattaagatttatatagtattaaatctcagtgctttaaaccttgatgctttgtaatcttttgttatggttacaacaggaattatatagttcgtaattgggagaatgctaataattaggactgtatttcatagaatatatttagccactggccttgatttaaaaaaaaaatcaatatataaaaactactaaagagtatttgcggctgggtacggtggcttactcctgtaatcctagcactttgggaggctgagacgggtggatcatctgaggtcaggattcgagaccaacctggccaacacggcgaaaccttgtctctactaaaaatacaaaaaaatttagctgggcgtggtggtgggtgcctgtaatcccagctactcaggaggctgagacatgaggatcgcttgaacctaggagttggaggttgcagtgagctgagatcacgccactgcactccagcctgggcaacaagagggaaactccgtctcaaaaaaaaaaaaaaaaaaaaaaaagcaactgaaagacaaagatgtcttaccttctagtagttgcaaagtcatagacaaagttattggctcaagatttttgtctgattttatgggattaatgtaggggtggataaagaagagtaggaatgtcagatggtcaggaaatacaaattattagaaaagcagcctcctattgaaataggttaaaaatattatagaccgagagttgaacatgttccaggagctttcctatacagtcatgtgttgtttaaactatggggatacgttctgagaaatgtggtattaggtgattttgtttgttgtgcaaacatcatagcatatacttaacacaaacttggatgttgtagcctgctgtgcacttaagctggagcccaagctcgtcttctttgcactctaccctttccaggcaagcctgttgctggagaatgtatggacttggtaatgatttatgggatatagaatttagagaattattgtcaactggaacacaggagttaaggagcattctgagtataaggatgtgatcatttattataccccctccatcctctctgccttatttttggattttcttctatgtctccccctgcccctcccctttttaacccattcatcaagtaaagttttccttcatcttgttgattaacttacttgtctaatgacctccactaaaatgtaagtttaaagaagagagagcgatcttattttcaggttcattctgtattgtgaatgcctagatgattgcctggtgtataagtgctcaatctttatacttgtttcagcttaccagaatgggggcatggtttagatgataaatttgattttcccttaaatatgatgtttgataaagataggctgcgaagaggaaccttactaatgtaaacttgctatattgtttcctttcctagggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtaagtatttgaatgggatccttactagcttttcctagttcttaaacccttttattcgatgtttatgagtatagagtgacaggaagagtgaagtgtagacagtataaaaaaatttattagtttataaagcagtttgaatatctggtcctgctggtattggaacagattgccagttttttattgctgtgccattttatgtatattactgttatgtcggccacctaccaaattctgtaaattataacttatttaagaactgggattatgacagttgaaagctgtatttatcctcctacttggcaaaaatgatgttgaaaattcaaggatttaaagattctagagagtctctaggtatattattgccaaatttttatggacagggaataaaagaaggtagtcagcatagataccgatttcttttctgaagagtattagatatccttccttgtaacccacagctccagtcatcttgtttcctgtgatgtatatcatatcagaaaggcttttctggaacttgaggtctgctctctagcaggtaccatccagtatcaccattgctgaacatttattatgtgttggtgatggggagaaacagcttcttaacctaggtataatcgatcagtccgtgactcagttctcattaggaaaggaattgaggtaatttttataaacataatacttcctataataggaacactttagggttaaagttcgagggctgtgtgtttatatacctgtgtgtgcatatatatctagaaagggcatataagtagatacaaggagactgcaagcagatataagggaaaaggcaaatacaaaaagcatggcctgtgtcctaactgtgatcctcagtcacaaatcccaacaaagtctgttctattggtggagagggatgtacctggaagcccttatgcctttactggtaaggtccttaaattaggatgggcagcaggcaattactttctcagagtcactgaacttgtatgacagcctggagctctaagtttgtaccagatccttgtacattgtcctcagcctccctttctgagctctagttcacatttcttcccttgactttgattctagtaccactttatatatgtctatgtaagtacccttgccctgcctacccaagccaagcagaatgggtattagactctgctcctttcctctaatttggtccgaatcctcagaaatcattcctgacccctttgctttggccctgtagtcctacctagtacctggcttttcttctgttttctgctaatcatctctcctcttagccacatttcagtatttttccatcatgcttatgaggtcagataccagccaccccccccacccccacccacaccccctccccccgtcgcccccatcccattggcctgaatgttctgcttcccacctgaatttagtcaggcagctgatatgaggtgcctcatcacagcagaggtaacagaaggattagagtccttgaaagacctttttttacttctggaaggccaaatgcagagtaaggcaacactttaacgtgtgagcctttgatatgtgtgcaagggtaccagtgagatccttagttggtatagtagaaactctgttaactaagcaaaggagattcctgaccggaccctattgctctgcttatcacatatgagatttttctgattacttgtctttttcagctactgtcatttggcttagtttggtaatttattgtggaggggtagagatagaggcattttgggggttaacttgttttgcatttcttgtttataacatggggtaaattctttagcctggacctaaacttctttaaatctgcctttgtggacttagacttgtgtgttcccttccttcaggcccttactcagtatcacctcctcagtgaggcctttcggtccagctcataaaaatacacagctgcctcctctccacattccctatccccctttcctgctttatgtttctccattgcacttttcaacttctcacatatattttacttatttatcttatttattttctatctgccccaactaaagtgtcagctttatgaggacaaggatctttgtttggtttcttcactggtatctgctaagaaggctgttctaggaaactgtcacttgatagaacaacatttcacacatccagcttcccagaagctgctcttctagaaagatgtgtatgtatgtgaatacacccacactcgcactcacacgtaacccccctccccgcccccctttttttgttttttaataaattcaaaagagtctctggcttcttgagttgcatttttagcttggagaaggaatacgatgatttttgtgtaccagttagctgcattgatagcctcagatttcctgtttgctgagggcagtgttagattagtcaagaatctgcatggaaagtccagtcttcgtggaaagtccatgcagtgcactgtgcatcccagttcctggataaatgtgcatggtctgtttgttgcagcagctactgcctgcagggatgtctctgcactctttgtgcttacgtgtgggactagctctgcaatttctagtcattttggctaagagaagaaaaagagctttgtgtcttgttcttgtcccccaccccccaccccaagaaggagtcttgctctgttgcccaggctggaatgcaatggcacgatcttggctcactgcaacctccatctcctgggttcaagcagttctcctgcctcagcctcctgagcagctgggattacaggcgtaccaccacacttggctaaattttgtatttttagtagagatggggtttcaccatgttggccaggctggtcttgaactcctgacctcgtgatctgcccacctcggcctcccaaagtgctgggattacagacgtgagccaccgtgcccagcctcttcttgcttttattattatttttttatttttcatgtttcatccagattgctggctctgatttttctttgagttctctgtatgtttcactgtgtgttttgtaacattttagtttttcctaaaaccaaaggattgattaaccttcaaaaggcagcactttttgatgttagtctgtaaccttttatcaaatcaatatttccctaaatagagttgacacacagacattctaaattatctcctaataaattgttttgacttcggatattgaaattgcaggcccatctccccacccatctcagttttctctcttttttttgcgtgttttgtaataagtcctacaatgaagtgtgtgtgtgtctgtctgtctgtccctccctcctgccccctctttccccattcccctgtgtgtgtgtgtgtgtgtgtgtgtgtctgtgtgtaattacaaagaagttgtaaaggccttttaaagtagttatgatgtgatttcccctcctttttaaaaataaagtattttaagcgtaagtagtaacatcttagagggcaggtacgtggagactttgactttctattttatctatctttaaattttttttttttttttttgagatggagtctcgctctgtggtccaggctggagtgcagtggcgcgatctcggctcactgcaagctccgcctcttgggttcacgccatcctcctgcctcagcctccgagtagctgggactacaggtgcccaccaccacacctggctaatttttttgtatttttagtagagacagggtttcaccgtgttagccaggatggtctcgatctcctgacctcgtgatccacctgccttggcctcccaaagtgctgggattacagttgtgagccaccgtgcccagcctgaattgtttaaatgtttacagtgagcatgttatttttatgatacatagtaatttttgatgaaaacattctgaaggctgaaaagaatgtcctgtcttttgaaaataaatccatctttgtgctgattaacactggaggctaaccaaagcgttataataaaatattacatttaaaacacctatgaaagtggctagttcaagaatataatttgccttgaaacatagcttgagatggaagtatacttctagtaatgaaagatcttgccttagtaataaatgaaagtaaaatattccattattgtcccttcatagaaaacaaatacaaccctaaatgacattttaattaactagtgattttcctctaaagctgagatttgtttttttaagacctatgtaggattggcaaatagtgtacaaaatctggacatcctttgaagataattgttggggtgggatgggggcatagagtactgttttattgtgttcatttttattaatgaaactgtgaatttagaccaagcagtgatttcatagtggaagatggaacaggatgtttagtgggttttgtatactatttttgtaaaaggctttggtgcagaatctttcataaaatgaaatctattttcagcatgtctgttatttatttttagaattcacagcaagagttcttgtttgaagaactacaaacctttattgactccaaatttgactcagctctgttatattttccttttctttttcactgataagggagggtactttataaagtagatttgtcattaaaaaagaataatacatttacctgatcagaagttcttttgggtttaaagaaaaaaattgcagcccagattgcaacaaatggtctgagttataatatgttatgtctttctttttctttctctctttttttttgttttgttttgagacagagtctcactcttttgtccaggctgaagtgcagtggcacaatcacagatcattgcaggcttgacttcccaggctgaagttattcttatacctcagcctcccaagtagcactcaccatcgtaagtggcacgtgtgtgtgtccatcataagtggctggcacgtgtgtgtgtgtgtagatggtgtctccctgtgttgcccaagctggtctcaaacttctggtctaagtgatccttctgcctccacctagcaaagtgttgggattacaggcgtgacccaccatacctggcctctttcatttctcgtcaaccaagaattactttctagcagcaggtgtccagtattaccaaatggaatagcatatttgaaaagaagttgtagacttttaatttaatgggcttcattagagaattctgacaccccccatcccccagcctggccctgcccctggcaacgcctgtcaaggtaatcagttatttttattggactttttctaacagtctccctattctgaaatactctcaagctatctctagacagatgagattttatattctagaaaacttaaattactgtcctaatgctagttagtacatatagtggttatactggaaaaacagagtgagaactagttgaagaggaaaaaaatctgttgtctactgtccttagttgtaattttttttttttttttttgagagggtgtctcgctctgtcgcccaggctggagtgcagtggcgcgatctctgctcactgcaagctccgcctcctgggttcaggccattctcctgcctcagcctcccgagttcccgagtagctgggactacaggcgcccgccaccacgcccggctaagtttttgtgttttttagtagagacggggtttcaccgtgttagccaggatggtcttgatctcctgacctcgtgatccgcccgccttggcctcccacagtgctgggattacaagcgtgagccaccgcacccggccctgttgtaatgttaggaggaaattatatatttcataactttggaaccatgaacacagcactggaatcctagggcatacaatattaagggagtgatatcctcccaagggggtgaaaattgccttttgggaccaaaaaaaacttacagtgatatataaaacacagttacacaaatttgtggtatatctgtggtattaaagtttcatgaagtgaggagtgagtagagaataatgtctgaaaaggctctttgggatatgataatggaagaaaaggctgagaaacactgccttagaggtgtgggctggaatatagcggagcacatttttagcattaaatctctccttcctcctctaaaatgctcatggtgaaattcctgtgcctactctttgttctcttctgattaaatactcctgtacacatagagacattttacacatataccaaatttgcacactactattaggtccccaaaacccagcagtgggtgtatacttctgcacataatcctatttcctattagagtctgaatctgaagactgaaaatttgtttcctttaaccctatcatagacacttcataaggaagaaaaagacaccagatttttagagactttgatgcgaaactgaagtaataaagatattatttttatattttccatcattttttctcttagaaggtgacatctgtgtgggactgggcttggctggcccagcaaacacttttagggtttctttttggatagctgatgaaacaaagttcctattgtttcatcctcaaaagagagggcccagatgggatgcattccacttttagcttaataggaaatgaagtaattcttgggctgtgcttcagcagttttgtttatcagtagcaatatttcgtttccatgggtgcggtgctccatatagtgagaaggagcctgcaggagagctctcccaacctcgcacacacacacctcctgacctgccagcataaaaaaggtgcagattaggtgattttaagagggtcatcagtagttaagtttttgtttctcacctaggtgctccttgtgtttttgtttattctttccctcctcacttaatttttttagttctatagtgccaatggcaagctttgttgggccatgctggagaagctctttgtagagtattagggatctgttttccttgagtttcctaaacagaagcattttaatagctaataataaaaactaccagttttagttgcccattttatgccagatactttgtgcacagctctaatgtttttaacaatccgtaaggttgatggtgttctcattttgtgtacaaggaaaacaggcttcaaggttgaatgactttctcaggataaccaaatctgttgcagtggagctggagttcaaacctaatattttctacttgacagctaattgccagcatacttgatgaggatccctacagtttactcagctgggagcagacttctcccaccccataatttatatttgtcttgtaagtggacttgatagtgtgagaagttcagaaattaattcctaatttaaaatacggaattaaagtttgggctgtgtttcttccaatagtttctctctctccttcccctctctaaatcctctagagtagctgccttcataagttcagtaaaattttcagaacttccctttttaaaaaaagattgggatttttattttcctttcttgttaccaggaaatttaatcaaaggaaaaacaccatggaactaactgaaaatcctgctattgttcttcctactgcagcttctgtttttatgcagaaagttagattgtggttattatatcaaattggatacagtttctcatccccatgtctttgcagtgtaattgtagacattgttaataaccctgcagttggccaggcacggtgtaaggtgtaatcccagcattttgggaggcctaggcgggcggattacgaggtcaggaggtcgagaccatcctggctaatgcaatgaaaccccatctctacaagaatacaaaaaaattagcggggcatggtggcgggtgcctgtagtcccagctactcaggaggctgaggcagaagaatggtgtgaacccgggacgcagagcttgcagtgagccgagatcgtgccactgcactccagcctgggagacagagcgagactccgtctcaaaataaataaataaataaaataaccctgcagtctttatgtacaaaggtagtcatatgactaatgaccctgttgcaaatagtcatgtctctagcgctaatttatgatagtaagaggtttggtgtaggcatacgcggtgtaaaattattgagtctgtattatgtaactttttaaaaaatgctgatttaccccccaggtgctttatcagaaaggttataggaattaaaaaataatcttgagagccacttgaacctaatggaaaacattaatgtgagagagtaggcctgccaaactggtgtggttgatttccggacagtagggtgaggtactttattcttgatcagtagtaacgcttccaatgtactcttaagtttaataaagactaatccaggaaaccctgagttccccactcatcttttaaccctcaggttttcttttgaaaaagaagcctctaatcgtaccaaacaaattccagatttatggcatattttacttatgatgattcatagtttcttcttcagattttgaattcgtgtctgaagggaaaatattggattaacaattggacagtttctcaggtatctctttcatggctatttctgacattctgccttctcggttatacagtttgattttagttatacacagagctgacagtagctcacacatccatccattcacctgctaacaaactctgctaatgcagcagaaagagataagcatactgttgttgccaagcacaacccccgcgccccaacacacacccatcccgcgttgttctgtttctctccctgtcgttcgccctcatcccattctgcctgagtaaacagtcattttagcaattcgggacaaatttctgtgctgatacttactttggcacttcacagttttgggtaaggtagcattgcttcaccatggctctttgctgtgtgaatggtgtttacttttagtggtattgtgactccctttctgattcaagggttcaggtttctcatctttgcataggcctgaggaaggagatcaataagaaaggaaaaggactggttaaatggatagggctgtggatattctgttttacatagtgtaatctctcttctaaggcactgtaaatttaaggtttgaaggcataattcaatttggatctcagattacttgcatcatcatcatcattgaattgtgaaattttgacatttattgacatttattcatatctacctcaaaggactttcagaagtttacagattagcttaattttggataaatgggacaatgctatatattgattctgttgacgaaccacagcatttcttctttaaagcagttctcctgactgacatacgtatcactccatccatccatcgttcatcatccatccaccatcagtttatttggaaattaagtgaggctatatatggtgttttgggtgataataataaagaatttaggaggccccttctagattttatttatttatttagagacagggtctctgtctcccaggctagagtccagtggcatgatcttggctcatggcaacctctgcctcccaggttcaagtgattctcctgcctcagcctccctagtagctgggactacagatgcccggctaatttttatttttagtacagacagagtcttgccatgttcgccaggctggtctcgaactcctggcctcaagtgatctgcctgcctcggcctcccaaagtgctgggattacagcatgagtcatcgcgcctggcctaagtccttcttaattgccatctcctttgtgaaatcttcctgcttttgcccacatatggaatgcaccactcctctccccagattgcactgtatttagatatttaggtattttagataggaaagttcttgtagaactcctctcattttgacttcattgcagttatctgcaacttgattctctgttatgaaccgtaaatctctggggagttgagactccttactttactcatcttcaccttctgatcatagtgcctggacttgatggatgtctagcttttagctcttgaacaaaactgagtcagatgttagagaatattttaaaagaaacattttctgctagaaaaatagacaaatcttactaactgaatcatttggcttgtttctgctaacattgatgtctgtgtagttaggctggctgcccttcaaagaaatattgcttttttcccctaattctctttcatatattaaatgcataaataccgcatatacattattataaagtgtgcatgcatgtgcacgtgctcgcacttgcacacacacaccaggcagcggatgcttcagcttgctacagccttcttagaaagaattcgacttggaaggcagtgggagtatcgtgtggattcagtgttcatgtgaagacttatcttcatggttcatgaaccaattattcttgcttaaaagttaaactagcccatcattccaagtgttaggctcctcttaggcagggacttagctcttagccttcttcctcttcaaacacattgccctgtttataggcaatgtgatacaaaacccttgcatcctgatataatagaccatgtcctttggcatcagcctcgactctgaataatgaattctgcaccttaatatctgtgtaacatggggcaagttacttctttaagtctcagtttctcatctataaattgagaacaatacatgcctcataaaattgttgtggagagatgactgtcagatgcctggcgtgtgctaggtacttgcttggtaaatgtttcctaccaccctaaaattacacagcagtgagagatttctcttgccacaggatgagggcttaaggaggcccttgggaaaaaagcatgtggaaaattaacttacttattattctgattacatggaagaaacattgtctctttcaaagacagcagaaagcttagttcattccaagtctgaaacctctgttggcctgtgcccgtggtatggaaattcagtcgcagggaccatgtagagggtttccctccatgcccttagctgtagaagagcagtctgaatgtgttagagattcagggaagtggcacgtgcatgggtgcccatgattaatcaggcagagcacaaagtggcgttacccaaacaaaaacattaactctactttcttttctgtcatcagaaagataatgggagaaggatggtgataggagcatagttctggctatttgagatcagtgtgtgaaaacaggggaaatagtgttcattgtgatgagtatattctgaatattggaaatatttaattctgtgaggctaaaatttcaaaagaaagcccaattgtccaagaaggtcttacccatagacacgtggtgttaaatcttgctgacctgtctgcagccgaactctttggagtggcatgcagttttctgcctccaatcatcactcctgaggtgcctgccagtctgtacactgggcaccatggagtccttggcatgtttgcgtttcctgaactgggctcccagccacagcattgcattatcctcatgcaaaccaggtaatttcattgaagtcctcattacattagtggttgagatgggaaataatgtgtatctgagaacaaaaatcattacttattttttaggccttggattgctcatagtagtaaaataaaatcaagtaattatgtacttttccaagtgcttcatcatgtgagcctttgtatcgtgataataaagcaagtgctagtgaatctgtaaaattcttgctatataacttgtatgagtgatattttttcctgttatgttttcagatctaatttagttcagtagctattggactttccatcatatgctatgccttgaaggtccttcagctttcattcttaaatatgttcaaattgaatagcccttgttgacattcagagcctgttcggttccagataccatgttataggcatggtgaaagctgggatacaaagttttttgttttttgttaagggaattcatatttgcaaataatgttaaaagctgaaaatggagttttaagaagtttggaaaaatgctgtcagagctcaagaggaaggagggggtgttttttaggaggagaaatttgtatgtcgtgaaataagagctaagaggatccactagcgtcctttcagcagtgaggctctaatactgttttatttgctgcctgtgtttcctttaggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatggtgagaatttatatgatctacaaacacactttaagtttgtgatatttctactttttttttaatggggctacttttctatggtcatcatattcaggtcttccacagaggctgcgtaaatcttagaattactgtaggaaagtggcctcaatggcatctcttctaggttcttcaattgagctgttaagcatgttgttgcagcgaaatgaccctagggattacccaaggagagtggcacgtcaccttcctgtgggtctggatttcagatttgatctctcaagtgtagaaagtgacatgctcttcatgaggagagtagcagagttactttttggtgtttaatgatcaaagacatggttttcattattgtattctgaagttctctaaagatagcctggaagtgaaggagaggaaagattgggcagtgagtgggaggagcatgagaacagggtgtgctctgagaaaccacacacttccttaaccaggttagtgtcactcttactgactttatctgttggccctccctatgagagttcactgaagaaaggactttttgtttgttttttgtttttttttgagaacgggctttcactcttgtagtccaggctggagtgcagtggcatgatctcggctcactgcagcctccacctcctgggttcaggtgattctgctgcctcagcctcccaaatagctgggattacaggcatgtaccaccatgcctagcaaatttttttttttttttaattagagacagggtttcaccgtgttagtcaggctggtctcgaactcctgacctcaggtaatctacccacctcggcctcccaaagtgctgggattataggcatgagccactgcgcccggccagaactccactttttcaaaaatatttacatagtaagtcctcttactcaaacaagggttttcccacataattctagtagccaatgacatctacttgatgtcataattgtatagatattttttaatgaaacataatgtgtacctggagttcaataagtaacatccagtttcccttctgagttcaagtccaattgaacgatttgggagtcctgagatagaaaccaaaatgtttattactgatgaaatctagattggaagcctgatgttagagctcctgccagaagggtctgcttgtactttctatgtcttcaatgaaagagctggtcagtcacaccattgccctgtagagtccacccagccttgagtattgaattattttgggtaagcagaccacaagtcactctccccacaggtgagcagttcctgaggagaaatacccagaggggcctgagccatagcatagttagtttctacactcagatgaattttgtcttcttccatggaagaatggtaaagaggtctttgccagctttgattctcttaaatctacactaaatttaacagttaaacctgtggtcagccgtcagaacggtgtcccatactgtcaggtgcatactgtcagattctacctggatagtcctgcccaggtaaaacctgaaaggaagtatcaaatcaaggaagaaaggatttatccttttcttcttctttttttaagtatagtgtccaagaaacttctgtcttgctaatatttagagatcagaatatttgacattctgaaaaggcactcatgccttatataaacctggtgatgggccttaatacctctagctcctcctatttctgtattgatacaggaatgtttattctggctgcctttcacaaatcagtgtcaagatagtactgcattagttatttgtggggcttatggtgttttatggttttgttttgtcttgtttaaagaggggcccaggagttggatagttttatgttgccatgattaaaaacaactattagaaaaagcaaacatctgaaactttggacatatcacttcctctttctctctcttttttttttttttttttgagatagagtcttgctctgtcgcccaggctggagtgcaatggtgcaatctcggctcactgcaacctccatctcctgggttgaagcgattctcctgccttagcctcccaagtagctgggaatacaggcacatgccaccacaccctgctgcttttttgtgtgttttagtagagacggggtttcaccatgttgcccaggctggtcttgaactcctgagctcaggcaatccacccgcctcagcctcccaaagtgctaggattacaggcgtgagccactgtgcccggccacttcctctctttgggccttaacttccttgtctttaataggagggaattggccagctttaatttttttttgtactgtcagtgtactggtaaattttctgttgcacaaaattgctcaagcagtgctaacaaaggccaaaccaaatttgaacacttgaggaaggaaatacatattaaaaccacaatgagatatcattacacatttatcataatggctaagatgaagaataccaagtgctggcaaagatgaagaacatatcatatgttgcttgtaggaatgcaaaatgtataaccactctagaaatatttggcagtttcttgtaaagttaaacatacacttagcgtatgacccagtaatcccacttttgggtgtttatcctagagaaatgaaaatctgtagtcaccaaaaagtctgtgcacggacgtgctcatagtaatgttattcataatcttcaaaaactggaaataacccagatttccctcactgagtgaatacagaagcaaactataatatatccatacagtggaatactactcagcaataaaaagaagcaaactgttgacatgtgcaacaacttggatgtgttttaaatgcattatgcgggaaaatgaagtcagtttccaaaggttccatactatgtgattctatttatatgatattctggaagatgcaaaattatagaaaaagagaacagatgagtagttgctaggggctgggagtgggggaagtctgactggaaagaggtatcatgagggaattctttgggttgttggagttgttttgtcttgttcgtggtggtggctgtaagaatctatgcatgtgttaaaactcataggagtgtacatcccctaaaggtgaattttattgtacatatatttaaaataataaaataacaaaagaaattgtgtaagttgtatactttgcaaggtgaaatgcatgcaagtgacttgatagaagtgtctttaagtcaacaactgggatgaggaatctgattttctgtgctcagttcacattctgcagtttaaattgttctattaattgatgattagaatctgggaacactgggtacagtaagggagagaagcatcagttaagagttcatcacgcctgctgttgagggacaaatgtaatggaatagtctgttcacatcaatgagttgcacataaatacttttaaataggtatttaaaggagaaaggtacaaagtaaccatgatgcctgaggtaatacaggtaaataaggcaccttgttacataacaggacttcttgctgttgaaagctaggatgtttagagatattctagcctaatacttagacaaagtagtttatgtaagatttatggctaatcctcctactgttttaattgtttagttgcagtgctttttagctttcttcaggtcagtgactcctttggaaattgctcagatttctcctcagaaaaaaatgtttataggtgcctatgtgcacacatttacatatgataaatttcttaagtctccctgaacttcaggcatgagcataaagttaagaattctgggtttaactttgctcttacaaagtgggaaaagcaggggcattggagtcagtttgtttgcatcctggcttcattgcaagagtttgtgcaaaatactcaatctctctgttacttaatttcctcatctgtgaaatgggggaaagtgtattctgataatgtgtgctagtttataagctattcattttgaatgtaccatttggagacacaaaacattgatgttttacttgttacaaaaattaatcttcactttaaatatgaacaggagggagtttgtccttttaaatcttccaaatgttctctcatccctaattatataaacaagcttctacacattgtactgtttgccacagttctgccttaaatgcaggtgataaggattcatctgggtgtggcgtgaatggtggggtaaggacatttttttctctgagttttccaagtctcacttagtttctcagctcggtggttagtgaaaatggtaagctaggggggtgttttccctgagagacccttgtgcagtagccgtcagcataactcccaggtaatgtagggtgggcccactgcagacttgctctagaggaagcagggagaaacatcctgggggaatcttcattcttatttactcatgatattgtataaccaagtgaaaaagagatctgatcatctttgggggcaagaattctcccctcaaagagaaatttgggtggagaggtggaagacaggtttaggaaaaactgcagtaagaacagcctgtgtattcccaattctatacatctgatattggttaataggtcgcccaccataatcatttgatgattcagttcccacctcctttcagagtgtttgatagcttttctttctttttttttttttttttgagacggagtctcgctctgtcgcccaggctggagtgcagtggtgtgatctcagctcactgcaagctccgcctcccaggttcatgccattctcctgcctcagcctcccgagtagccgggactacagacgcccgccaccacgcccagctaattttttatatttttagtagagacggggtttcactgtgttagccaggatggtctcgatctcctgacctcgtgatcctcccgcctcggcctcccaaagtgctgggattacaggcttgagccaccgcgcccggccttgatagcttttcataaatattttttcgtagctacattagtgtttgtgtattttttttttttgagggagtcttgctctgtcccccaggctagagtgcagtggtgcgatctcagctcactgcaagctctgcctcccaggttcacaccattctcctgcctcagcctcttgagtagctgggactacaggtgcccgccaccacgccaggctaattttttgtattttttggtagagacggggtttcaccatgttagccaggatggtctcgatctcctgatctcatgatcctcccgcctcggcctcccaaagtgctgggttacaggcatgagccactgtgcctggcctgtgtttgtgtattttttcagctgtcatcactgctgaaaagaaaataacaacatattttaaaactgctagtggtttttttttccccttggcagaagattaatatttattgatcccaagactagtagtggtaggacttgagctccaaaaggttttgttgcctctgaaaccttgtttttgttacaaggttacaggtctcatttttccacaactgcattttctcacagtggcctgttctccttcctttcacatgcagctgagaattcctgcatcatgtgggactttaggttttttaagaggtagtccagaatagtacaaagaatggtgattttggaatcataggtatagattcaaagagtactgtaagctgggcttgctggggggattgatggggtaggagagtagtccttgattattgtactgatctcagaacttagaacattttacttagagaatctgaccatttataaaagatacaaccctctagcaggctcatcatgcttgaatgcctactaggcacatcaacttttttgcagatctgagggaaggtgtgtgacaggtgtgtccagcatataagtaaatagaaagcaggatgtgagacattttctgccttccttctctgtgggtagaggctaagcctacagagatctttccaattaagtatggttaaacaggataaccagccaacatggggtctatggaataacattacagcataaagaaaagggaaaagtatcataagtattcagatggaagattttctgagtatgctttctgtaagaaacaaaaaaatgtagatgatatttcccatttgccctttaaagagctcaataaaatcaggtttattatgaaattagagaaggagacagcaaggagaaaagtaggttttatgagtcagtgttcaagtagagaagcagaaccactaagagaaataatatgttgagatttattacaaggaatggcgcctttgattgtgagggctaataagtccaaaatttgtagggcaggagggggagggaagatcatgggcaaaagtcagtccaccaacatgggccaaaatatcacgtgaggaagggaagatcgtgggcaggatggagctccacaggcacaggctagtgctgtcctccacaggtggaatggaatcccttctctccaggggaaatctaagacctgctttcagagccttccagttgatgcagtgggattatcctgcccacataatccaggataacctcccttattagatcaactggttaggggctttaattacatctgcggcaaagctattattatgacgacaaggatggaaggggagtgagttggcaaaaatgatgcagccatccacaatcctaaagcacagttaattcacactggggacaaaggactcagttgacactgtaggaaaggccattagtgatctaaaaaaatgaagttgagtaactcagattacagaggagtactgatgcagagaaaagggaacagagattgatcctaaatgattgagctctgcagtttaaacacaaaaggaagaaagcagtgatggaagctttcatgctcttaaaacaacacagactaaaggaaactaaattcatatattcgtttatccctttgcaccttggcctcttctacaaacctaattcacatgacccctgaatcaaataaaaatgtgtgagaaattaatgggagaatacctaaaactgggggtatatgcatgcggtggactactcagcagtaaaagagaatgtactactgctacatgcagcaatgtagatgaatctcaaacatgctcatcgaagaagccttacacaagagtgtatattctataatttcatctatatggagttgtagaacaggcaaaactaatgtaggtgaaaaattcagaacaatggttaactctgaatgaggaggagaggattaactggaaagtggcacaaaagaacttttttggatattggtaattttctatatgttggtacagatttgggttcacgtgtatatgcatttgtcaaaatttatcaaatgggtatactataccatatgtatttcattgtatataaatcacctaaaattgtaactacatattgaatgctagttaattatatgcatgctgaagtattttggggtgaagtggactgatatcttcaagttattttgaaatgcataaaaataaggtggatcgatggggaaatagaaggaagaatcgttggatatatatgtgataaggcaaatatagaaaaacattaattgtaggatctaggttgttgagtgagtgtctggctatttgctgtgtgattctttgaactatgtgtatgttggaaaagttaataaaatgttggaagaaaacataaaaaggtgctttttaaaccacattagtttagcttgcttgtatgattgcttgtttttgtatttgtggttttatttcctagcaaaaagaaacagggtggagtaatggaaaaggttttttgtttgtttgtttgtttaatgcaagacagaagaacttttgattttaaatcctgatctgactgtgggcaagctattaattctatgaatctgccttcatttgcacaatgaagataaccagacctcatagggttactgagaagatagaatggaaaaagttgacataaactgcctagcccagtgcatggtgcatagcactacattgttttctcctaatctgttatcctcagaaagggtctacacaaaagcagatgtggtaccagttgctaagactttcagaaattgagagaggatgtagtgcagaagtcagggcatcagcttctgagcaggcgtgtggctgtagtattgggatttctactgaaatgctgagctgactcagaacaaataacaaatcagaagagtggttgtgggagggtggtaaagagacagctgcttcaaggttggaaataactagcctctaaagaatcaggtatttcctagttagtgcctcattagctctttgttcttgataaggatgtcagaacaactgtaaggcaaaagttagatggtgctatttgatcttttgtgaggattctatttgtccttttgtctggccttgccatctgcgcagaggtgttgattattaaaatttgtacctgcacatgtagttgttgcttctggggcataatctttccagccatgtgcctctggttaaacaccctttaaatcctgaattggtctatgcatatacagttctgtagggaaaatatacaatatgaaaaattgtgcttccaaggaaatttaccttggaaatagggataccagactaatacacagatgacatttggaaacagtgtaattcagtgtaaaatcacagcttcaaaaatctgttcattcctttgtgatattcacgtatagaagcatttgaggacttcacagtaaggagaaaaccactggggtccaaaaagtccgagtgcttagtgaagaagtttagacccgtgggaggccatgaagaaagagatgatagctaagctgaggcaggcacaacttcagggtgccattcccagctccctggagttaagtgtagtacagccttgtggggctatatgtggcatccctgcaaagacctcagctcctgtcatcctaggttgggcactgaggactgctgaaggaagagagtattgctagtgaaccttgaatgtaatttgatgtccaagaggacagtgaagagagccgggaaacagagaggaactgggatttaatgaatgtctactacagccagtcataatactagcatttcatctacctcttctcatttgttacacctctgtgagtgaggtgttggtatctcactttagggatgaagaaagtgaagttcagagatgttacatgaatcacgcttggtcacacagatggtaaatgccagattcgaaccctgatttgtctaactacaagcccttcctcattctgtcactttcagagtgactcactttactaagagggagcctttatttcaagttaaataaacgttttcctttctgcagttattagtggattgtcttagagttagtcttccttattgtgccaggagatgcatttcttcctctcattaaacaaataaataaagctggcagtgccagaaatttgatttgcccttattgtgtaggaataaaaagacccatgtgtactgaacaagcagaacctgtttttagtgtttaactagccaactcctgtctgggtgttcttttaaaaagtaattataccatttatgatacacccatttaagtcccaacagctattccctcttggacctcatgttgtggggctgcatttgcttctgttattattatttgagtaaaagaacgtgtgtatgggtcgcctttatatgcctgcctgtgaaattggttgaacaaacactgtgtattaagtcagaatatagaaatgtcctgattctcttttgcaggactgtgttcgattgaagattttgcttcctatactttctatgcttttgtagctttgttttgcctttacttgagggctgattctacctggccacaataaagctgttcacactgtatgttgtagcttaactttacaatcttaggcacttggaggcagtggtgtttacataacttgtctttatgtttgtttgttttttgtttttatattttcctcacttacgttcattttctcccccatttacagatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgagtaagtgctccttctgccttatttccctcctctcatccccagccccacccccgattcataggagtaccacccacttggcatctcattgtgtgtttgccgcaaattaaaacctcagctctgtatcttgccttctgctggaggtttgtaagcttgctcctgctaaccacttcattgtctgagagagaaacgtaagtcgtgttaaccattttctctctcgtctgcctgcctgccttcttcaattcttatctcttatattttactattttactcaaaagtcagaatgagccttgtctgtggaggtagcataacattaccaatgtatacagtttatcctggtttagtacaagaggaaacagatttcctatatcatatatttttttctggtatgtctttaagacttgaaagagttaattagaaaccagtacttccatattataattgcatacagaaaatattgtaaacaattaagttttggattgaatgtaatttctgtgaataaaatttgagagcagtggtttcttcatatgaacagcaataaaaagcaactgaattgtcctggaaatgtgcagtaggaaatcctgtctgtttttgggctcaattattatatgtcctgactctttaaagagttctctagaggaaggttgttagtcaaaacatttgaagagcgctcttttattcttgtataaataaagaaataaacacactagagcagccaaaagtttttattggaatgtttatataaagaagtttcaagaatagtttctgttgtttaatacatttttattagttttgtggttatcatcattatcttttccaccacattatctgaacaagtataaacccattggatctatgttctttagcaattgagggacctgtgcaaattgagtcagtattagcaaattctcagatattttgctcatgccagatttaatttagttgtgctttatgttttaccatttttaactgtgtatatagtctggaaggaccaaaaagagacctcagaatgtagtgctacttacggttatgtaaacagctttttcttgattcacttgccaggcttatacctttccccatcacgctagacagacagttctttgcagaaagctttctgatgggtgctacagatacagtggtggtaggaggggcacttatctcaaatgagctttggatacctgagctctcctaagacagtattccagggagtgatacattctactccttcacacttcccatctggccaatgattggattcattctacggttagcctcatggcctcaggaagagaggccttgtttcagaagttgaaacagttaactctgcataactattgtgaagttcaaatgcatttcctctaaatttgatttttgctgggaagcagagttggttaaggactgccatccaaatggggaaataaagtgattacaacagcttcattatatccttggaggggatgtcacaagactgttattgcagcacagctttaaggaaactagagtgtgtttgttctttgacttttttttgcttactttaaaagtactacttctgttacatgtgggaaagccacttacctccttttgaagggagattggtaagggaaaaccaacctgagaaatcaccaatagaggaccctgataggagaggatgagcaccttgctgcagatctagctcttaacttgaattctgggatgttactgttgtgaagcttagaaaaagttctgagtcataattagcgattaaaaaatggaaagggggcgattgtcccaaatcactcagtgtgagagtgattctagtagaatttggtagaatttcagttgttaaagaatcaagaatgatcattttgttattggttttcttttctcctttccttcccctttcttttcctatatacataacgtaaaaatggttaaaatagtaaattttagggacagcattcagtagcattcagtaccatcacaacactcacagagttacgtaaccatcaccactattatttccagaactttgtcatcacccaaactgaacttccttttctccagcccctgataacctctgttctcctttctgtctctaagaatttgcccattctaggtacctcatataagtgaaatcatgcaacatttgtctttctgtgtctgtcttttacatagctaatgtcctcaaggttcacccatgttgtaacgtgtcagaaaaacaatacgtacttcaaaattgctaaaaaagaatgtatttctcaccacaaaaaaataagtagctgagatgatggatatgttacttaggttgattttatctttctatggtatatacatagattaaaacatcacactgtaccccataaataaatttatataattgttgttaccaaacacacacacacacacacacacacacacacacacacacagccaaaagtgtaaacaacctagatgtccatcacagataaatggacaatgtggtatattcatataacggaatactacagccttaaaaagaaaagatcatctttaacagatgaaactgagatccagagagacaaagtggttggatgaagataacaaggtggtatgaccagaaatagaagccaaaagctgtccagagctctttccttccactcctgggattcttaaaaagtggcccaagaatagacttcatggggtctgtatctcttgaaattataaaggtttatgcacatgtttttctgaataaagcatttgttggtgagattcacgaaggggtttgtagaaagttaagaatcgccacaatgtatgatgctatctttcttttttttttttttttcttttctttgagatggagtcttgctctgtagcccaggctggagtgcagtggcacgatcttgtctcactgcagcctctgcctcccaggctcaagcaattcttctgcctcagcctcctgagtagctgggattacaggcatgcgccaccatgtccggctaatttttgtatttttagtagagacggggtttcaccatgttggtcaggctggtctcgaacttctgacctcgtgatccacccacctcggcctcccaaagtgctgggattacaggcgtgagccaccgcgcccagccatgatgctatctttctaatagtttgggtatcttcttccccaccctgctttttaaaaatgaaattgtccacatataagccggcctcttttattgcctcttttcagttagtatgaaattgaagtatggctatgtatattttacatttattgaataactagttgcattctacactttactgaaaagtcaagcttatttaaccccatttatagcccttcccaagtacatttgttgttttaattccttggtgctttaccttgttttttgctttttaatttttaagtggggtgtggggagccttgtgctggttagggcccaagttctttttgtgtttctttgttcaaggcttattttgattgccagtctattttgataaagcaagtcttacttctgcgaaaattatgattagccattcttggacatataaggattctctaagacctatccctttagaaaacacttgaactttattttaaatcctaccagatagtaataactactcaggacattttttttacagtttcccttttttgtaacccatgattgttaactttcactttgttcagtgttagggaaggcagagcttttgttgacttgctgtttcactttagcttatatttagatcttacattatgaatatgaatgcatttgtgatctgaaaattcatcttaaatacattgtatttaagtttcactctaagtaaatgaaagaattcatgtagggagcataactcagtgattgacatatatgttatctcttatttccctttctttaattttctgtcttgcctgagaaatcttagccccagaagagtacccaaaacatgtaggcctacttttcctttagttggacaatcatctcctctgatttgaagaccccacccatggtcacctaactagttagtaatggagagaataggtaaagaccccagtttgcaggctcttggtgtcatgaatgctaggaagtgacaatatcagatgagcgtggcattgtagttatctaagaagaaaatattagagccagatgttattggatctggctgatctcttactcacacatctcaaagtagaaatcttgggacttggatcacccatgttgggggtatgagggagcttgagagtaagaggaggctccagctagtgactaggtgtgcaaacttggaagtcaaacctaggtttgcattttggctctgccatttgcaaactttccttgctaagccttgatttcttcatctcataaataaaggatattgctatttacttcctggatgataacccagcctttagtgtatgcaatatgaaaaattagggcttatttgtcatacagattctggttatttttgtggagcaaataaaggtgcataaatatttcttcttggagaaagatggtagtatagtatggtagaactgcttacggattaaaagcttaataaaaatctaagcttgcctacttagtagttagtgtgacttggaaaatgtcacctatccactgagtctcatgtttcccctctcttaatgataatacctgttctgcctacatcacaaggttattttaactaaaaaaagattggtgcaaatactttgttaaactctaagatactctatttgaacatttcttatatattaataataataatgacatcagtaaaattagagttaactgatcaatgaaactcaaattccagttgatcggtctaccagatatcttgttttgtaatatttcttgtagttctctgtgaattaaagttagtagagagattggagaattgtagttagactggctggttttgaatccagggtctacttctgtgaaactgtattatttatcttgggtgattcacttaacctctccaaacctcagtgccttttttttttttttttttggtctcacaagaagaagaagaggactgtcttcaatgggttgctttgagaaataaacaattcatgtagagagcataactcagtgattgacataaatgttacccccatttccctttctttaattttcttttccttctaatgcctatgtcagtttttcatacttcagggaaattttaccagaatcttgaagtattttaagcatcatttgaatgtccctacttgatgtaggacttgatgtagggacttgatgtaggttggaaattattccctagtgtaatagatactactttaaataaaattagtttggccctttgatacatgctgtgatgttgatgcctgtagattaatggaacaaggaattctagatggataaaaaatcatttacagtccttccacccttataagaagagtatttattttaagaatttcaactctggagtggtggcatacaagtgctgaaatatttcagttgccataagagccagtttaaacatatttgtcctcataaatgtcatcttatttttagtatcagctgaacaaatcttcatttattgaatgcctatactgcactagaaaccatggttggtacattacagatattgtttcatttcaaccttatatcaacctcgtgaaataggcattatctgtgttttgcgggagaaatatggaggctcagataattaaagtaactagtccaaggctatatagaaaattgtagagctactgttacacagacagctgtggaatgccaaggcccatattcttccctctacaaaaatttggcagagagaaagaagagactcaggacgaggctactagggtacagtattaaatgactcttaaatgtaaagggttatatggtttctagtctatatgttttttgaggaaaacaaggttcttactataataactgtacatttatattacccattatatgacttttaaagtatggttgattacatttaagctaccattttacatatggtaagtattgtcatctctgattgattgattgattgagacagactattgctgtcacccaggctggagtgcagtggcatgattccggctcactgcagcctccacctcccaggttcaagtgattctcctgccttagcctcccgagtatctgggattacaggtgcacgccaccacgcccggcttatttttgaatttttagtagagacggggtttcaccgtgtcggtcaggctggtctcgatttcgtgacctcgtgatccgcctgccttggcctcccaaagtgctgggattacagacgtgagccactgcacctggccatctctgttttataattgaggaaactgaggccagagaggtaaagtgacttgcccaaggtctcggttcacaaggttgcaaagtaacagaacctaaagtgcaccgatctgtccagattgaggggacacatgtgaatgttgaacacagacccagcctgacaagctctaggtactcagtcatgatttactgtagtgggcactattggcccctctcaaagggtttgtgcctgtaagctctcaagtccttcttacaagacacttgcgcttgaaacctaggtgtagggttaggtggtggagtgactactcaagaatacatatttcacaatggaaccaagtgctattgagcaagatgttctgccaacatagtaattttgcccttttagattcctcttcaggtacttgacaagtgggtcctcagtagcccatctggtgcaaaacaagtttggagactttgcttttgcatagtaaagcaaaagatgaaacaaatgtacagacataccttaaaaataataaccagagaggcaggatttgggataacttgacatctggccaaattcccattcatcagtctgtccatccctttgtatctgacttcctttgtcattgtgtgatctaggtctttgtgtcttggtaaagataaggttgtagaactgagtggaaactagagaatgggggaggagactaacatttattgaatattgaatacctgctttgtattatgcacagtactaccttggtgctttacttgcgttttcatttaaaacccctcagcaaacctcggggaggctaaagcagcttgtccaaggccgtatagttagtcgctcttttcacaacctgtctttaggttgtatttggatttattcatagaattttgtgaggaggcatgtttggtagcattttcaggcttttaacctaattaatttatgatggttaataactctggttctcagtgcctttttttccccctaagttttcagctggacaactttaagcattttgacattttgtattttttaaaccatttaactagtaatctcaggattgcctatctggcaacatgctagaaaattgcaaaatgtactttctgaagataatattgtacttatagagcaatttattgtattcgttgctaggtattttgtgtaaattctcatatctttatcctctccccagccctttgaaggtgggcgttttatctccattgcacaaggaaatgtaatagccatagctggtaagtgatggaggaataatttgaaccaggttgtaactccaagtcctgtgaacttttacaaactcccttgggctttctaagaagatgggtaggaatttaaagttggttggaatcacagagccattccaagcatcttgtgtttctataaacttcttttctctccctgcagaatgacacatatgtactgagcaaggtatgtgtttgttcttggttgccgtataacatttagacttcagagtggtcagagttgtgaaattacactacttgatctgtggtaacaaattatctatggcaacagcatgtgatttgtttctgacttcacttcaggcttaagtggaagaaaatacagacctggagtatagggcttgatagtcaggtgtgagaaaatgaaggatcagttgatagcaccttctgctcttaaaagctacatgtgatttttacttggtcaattctaaagttttcttaaacgcataccaatagaaagaatgacttgaacattttacctgcatttattattggcagaaatagaagtgattggggaaacaaggaaagtgattagagaaacaagaaaaaaactaggtgtgttgaataaacattttcactaaaaccattatttggctggagcagaatatcaccagcatagaatgaagttacgcgatacaagaataaatatgaggtagtaaaaaaatacaaccaatcctatgcatttattaatatctgcctgttctgttttgaaagtttaaccttatagtaggagaacagtttctcagcattaccaacttctagattgttcttgattcattaaacagcatatacaacttgtcctggcacatcagtaagacctctatctagttgaactacagacagttataattcagggaagtttttcagtaacatgttctagaaggaattttgtgttaggattctggatttaatgaatcacaaaaatcttttagctgctgaaattggttatcattgtataataatcattttgacaaggttttgtttaaatctttaatgtccatagacataaataaggcgcagtattcttaagtattcttcttaaagcctattttgttttattaatgaaaacaaaatgtatttgaggtacctgatatttttcctaacacttttaaaaatacatttatatcaggattgaggataatttatcatcgtttttttggcctttttttttttttttttgagacggagtctcgttctgtcacccaggctgaagtgcagtggtgcgatctcagctcactgcaacctccgcctcccgggttcaagtgattcttttgcctcagcctcctgagtggctggaactacaggcgtgtgccaccatgcccggctaatttttttgtatgttttttcaccgtgttagccaggatggatttatcatagtttttatacatgattttggccattttttcttacaaaatttggagatggcaatgttgacattctgctcttaattttattcttatgtgaatgattttcaaattgaacttaccctagaaagacacatggcctaaatggaatatctacaatttaaaaaattgttttatttaatgtttagtgttctgaacactagttaataaaaagttaaatctagagttttaatataatctaacatctgtaattcttttttttttttttttttggagacggagtttcgctctttttgcccaatttggagtgcaatggcgcgatctcagctcactgcaacctccacctcccagatgcaaacaattctcctgccttggcctcctgagtagctgggattacgggcactcgccaccatgcccagccaattttttgtagttttagtagaaacagggtttcaccatattaaccaggctggtcttgaactcctgacctcaggtgatccgcctgcctcggcctcccaaagtgctgggattacaggcatgagccaccgtgcctggcctaacatctgtaattcttataccatttaaattttaataaatatttgttggcttaataaagataaaatgttcttcctaaggttatctagccggtgcactatctcttaatattcattttaactgtcaaactatttatccatttgaaaactctttagttgtttttgcatatgacattaacagtttctatagtcactgattattgtaccattttattcttatagtacatattttatgctttaactggccaatagaatttctgcataaaaagcacataaggagatttgtactttaaatcaggggtccccaccgcctaggctacagactggtactggtccatggactgttaggacccaggttgcacagcaagaggtgagtgtcaggcgggcgagcgagcattaccacctgagcttgcctactgtccagtcagtggtgacattagattctcataggagtggaaaccgtatcgtgaactgcatatgtgagggatctaggttgcatgcttcttatgagaatctaatgcctgatgatctgaggtggaacagtttcatcccagaaccattccataccccgccccctcatctgtggaaaaattgccttccgtgaaactggtccttggtgcgaaaaatgctggggaccgctggtttagattatgtagagaatgcttacatagtactctttattttaatagtatttcttgtattggtggtgctgcctcactgatagtgatggtagccctgtaatcacttaatccttgttcagcaggcatccatctctttggccttaaaaatggcaaagctgaacttggtgtgtccctattgtttaacatctcttataggcctcagtttcttcatctacaaaatagggaaaaataatatgtacctcatagatctgttaggattaaacaagaacatgtttataaagttcttaggagcttagatatctctttatttggagagctaggaaggacaattcattggaaatatttcaggtgcgtatgaatatgatatctcttttaaccaccattcagtttctgacttactgtttcctagtcagcctcaccccacaattgtaactatctcttaacctagtggggaaaccaagccccattttccttacagaattttggagggtaaattgtggtaggtgttgtaggggtagttgcttgacacttaccccacaagcaggcttcccttacttttttttcttttttttttaagtctaatactcagaagttgccttcttttttggttcattagaattataccagccctctagcataccacacagtcacaatatatcaatcgtttcgggtgtccagacagctaacattttgaattcacattcatttaatcctcatgacagatttagtattttcactttacagatgaggaaattgaagcgcagagaaatttaagtagtccaagatcacaaagatggtaaggtgagagtaaggaatcaaaccaactctgtctgactttccagcttatgctctaacaattaccttataaaactttttttgtttaaaagcacaaaatttagagcaaattactcatagacagtagttgcttcaaggatgtgccttctttttctttgcactctccttatgctaattattaaggcgagagtggcagttctatgttccctcccccccaaaaaaaggaaggaaaagaggaaaactaagtttcagtgctaaaatatcttgtggccctgggtatgcaggattgcatatctgaccataactagcctagcagcgagttccctacggatagctaaaatacatcattttgaggtggattagctaccccccaccccctacccctttctggcatttagcttctccagctccatttgagtagagttgtggttgggtttgtagaactcattaaggttggacactattatggtgatgtggttttgagaagatattgcaatagccctcagaaaaggaactagatgctgcagttccttgtcagaagtaaacttggagcgaaacacgcctttaggaggggtaaccaggctgctttcctctatttttaaagctgtagtatgaagccaaaactaaaagaggatgggcttgcgatattcggggtgcttgggcagccatgtgtgagtatcagcttccagaccaatgctttgttaatcttcattgtttattctctgacattttctctggctttttgctgtaactcaacctgaagcatcattgaacttccctgaaggacttgtgttgttaggatcagaaaagtgttcttctctgcagttaagttaatttgactgggttttctatgtatgttagcataaaaccccattgttttcttgcgcatgctaggcaaggtaagaaggcagagactgattggttgttgattattgcatggcaggtagaatgctagaaaattagttgaaactcatcctgggcttattgaattttgttgtatcatatacataaactgtggacacttggtttggatgctgtaaccttatctctgagaaatggcttctaatttgtgttattttgcatttgaaaaacttgctatggattttataaaacttataacaaaaaccctaatatactttattagcttctgataaatattacatcagacatccagttagtataatttgaatgtggtttgaaacttttttagaggtaggtttcgttgtgggtagtggaaggaggcacataagttttagagttagctctgagtacagattgtggccgtttcacttacagctgtgaattcttggggaaattattcattaagtctcagtttccacacatgcaacatggaaatacactgatacctgcctcagagtttttgtgaggattaaaagtaaataataaaccaacaacatagtcattttattatcgctatcaaatatgtaccgtacataattttatgtgctatacttttatatgactggcagcacagtaggtttgctttcaccagtatcactgcagatatgcagtgcattacaacattatgacagccgtaacatcattgagtgataggaattttccagctgcattataatcttactggaccatcattccatatatggtctatcatagactgaaacatggctaagtggcacatgactgtagtaaatattgttagcatccttcttttgttttgtcatttttgccttcctccccctagtgttttctcacccctccaagaataaaatcctagttcctaccaggactcacaaagctctgtgaaatctgaacctggtgcaactcttgagacttcatttcataacatttttctcattcccatagctctgtctgcacagctacactggctgtaacctccctggccagctcattgccacctcaggatctttgtacttgctgtacacattgcctgatgttcttgttccctaactctgcatgctggctctttcataccactcaggtcagttgttaggtcacctcctcagaaagctcttcagaagaagccgccatttccagtcgaagacattttctaccataagcacctgttttattttccttaagtgaagatttggatttgcgttttagaatacatacagagtaaataaaaattctctacacaattttgctgtaaacgtcttctgggatttttgtgtatacacttccttttagagaatatgtgcatttgaagtggttttgttgtttaaggtgtgagtgttcagtcgaatacctcttagtgccattttaaaatgtgatctaaagaaacattttgcttttatcttttctttctgctcattaatccacataaattactacactaaattgatttagaataaacagattgcttggaattaattttaaaatttattttttagccctcatttcagcccttagctctgtgaagccttggttgatttgcctaaacgctatctatctgcagaaccttggccttgttacttggaagattaaataagatatttatgatgaaaatgctctgaaaaactgaatacagctttttacaatcgttttatatttattatgtactgtgatttgttcctgatatttcacatttgattcagggaaatcatttcaacaaattatagagcttcttttgttgtcgtttttgttaggtgtggttttttttgtgttttgttgtttgttttgagataaggtctcattctgttgcccaggttggagtgcagtggcccagtcatggctcactgtagcctcgacatcctacctcaacttccgcagtagctgagactacaggcacgcaccaccactaactaacgcacctggctaacttttgaaaattttgtgtagagatgaggtcttgtatgttgcccaggctgatctcaaactcctggactcaagtgatttgcctgcctcagcctcctaaaatgctggattacaggcatgagcccccatgcccacacgacagaacctctttagaacatgactgttaaagctgatatttggatacttttgattttaatagcaataacaacaataataaagactgggtgggactgaacttttaaaatactcttgctattgttcagttggttttcagctttgctcaggcctatatgaagtttacctttgggagaaaatgaaaccttgtccaatgggtctatagcttataccacatgccgtattcctatctatgctatgcctcttatctcttctgccagtagtttttctccccagaatctgtgcacattaaatttcatttttccagtagttcatttttagaatctttgcttcagtgatgaattgaaaagttaaaaaaaatctgatcgcttgtaagtaatttgagaagttctctgacccaccttacctgtttattgtgcagtgctattatgagggagagtaaatcaatgttatatgtttctgcaaaagcagcaaattacaggagaaacatgagaaaagtcacatctagtttgtccaaaagacattatctctttatgaggacctattttattaatgtaactgtttttaaataggattaatcaactttaattataacttatgaaaagtgccgaatcaggtcagtgggctatataaaaatacgcaaggtcattagaagcttattggacttgttgagtatgggttcttttcttgaattttagtgatgataacctcacacatagttaagtgaacttcgtgcctgaagatgggggtcctgcctagacaaatgagcaaaaatgtgtcttttttcctgaactggaaaagctagtttacagagtgatgacttctttgtgattaaagttaccagtttctgtaagtatggaacacatcgcttctccattaagttggaagcttgttaatcagctgattttaacgttcaccattacactggagttttgggttcatatttagttcttaatctttctatcatgtttaagtttctcatgatcttcagaaataaaactggaagaaatggatgtgcattcctttctctcctgattctgttatttaaattggtaatcctacagggtttctgtttgattttgttttgtgtttttgccccacgagaaagctaaagaaactttttgacattttaaagatgagtgtgtactcctcccttccctttcccctccctcctcctcctccctccctttgccgtcccctccccctcatttcttggaaatttgacttttttttctgtcatcggtttgaaattactttattcagttatatcattctttccaagtttcagcttattttgtaagcaattctcttttttcctgttctcattaccactgttgttgatcttggtcaacagtggtaatgttctcgctttgaaaataattttcaggggcctgtgtttctcagcctcactaagtggcgtgaagcactggttaaacagaagacagttaagtagctagtaagccaataactgtcatggaatagacagagacaacacaagttctgacatagatcaacctagtttgtgtataaatacaaatttaaataatatttaaatagaaatctctatttcagtggtccccaattttttttggcaccagggactggttttgtggaagacagttttttcatggacctgtgggaggaggggatgtgatggttgaggggatgattcaagcgcattacatttatcatgcactttatttctgttattactgcactgtaatatataatgaaataattatacaactcaccataatgtagagttagtgggagccctgagcttgttttcctgcagctaaacagtcccatcagggggtgatgggagacagtgacagatcatcaaacattagattcacataaggagcctagatccctcacatacgcagttcacgatagggttcacgctcctgtgagaatctagtgccaccgttgatccgacaggaggcggaattcaggtggtaatgcaagcagtggggagcagctgtaaatacagatgaagcttcactctctagcctgcacttacttcctactgtgtggcctaacacgccatagactggtactggtttgtggcatgggagttggggacccctgctttatttaatcacttataacttataatcacttagatgctctaagtcatctggggggtgagaaggttggaaaagaaaaagtacattagtgagtgagtaaagattatctgggattgtttcttagatgaggatctatttgatgttggtgttggtctactgtgaactaaatataactgcattggagcctaagcgcagatgtctgcgtcatggtttattactcctgtgttcgtttcaaggagctcctgtgatacctgctgtctccacctaaaaaaaaaaaaaaaaaaaaaaaaaaaaacagtaaaaataaaataatcaattaattcttcctcttgctggtctgtcactcagtctagagtgctgtggtgagaccatagctcactgcagccttgaccactcgcctcagcctcccatgtagctaggactacaggtgtgcaccaccaggccgggctaatttttttttgcaaagagtgggggtggtctccctgttttgcccagcctggtcttgaactcttagcctcaagcaatcttctcacctcagcctcccaaagtgctgggaacacaggtgtgagtcactgcacccagcctatttatttatttttaataattaagttgtacataataatattcatgatgcacctgcataagacaggtttattttattatcagatattacctcccatattgtatggaatttttaataacagttgtagctgatgctccattttgtagtctgatagtttcactttgtcatatttttatctatttctatggtctttataaatatttttgaggccctcttttattatgagtaaattattcaactaatattgaatatcaatttctgatttttaaaaaaattaaaactagtgagtgctagagtgagccttatcttttacctactgattttttgcttctgttaaattatttccttaggctaaatttcaaggaattgtataattaggtcaaaggaaatgatgtttgcaactcccatattcattgcaatgtggccagtattaactctgcttttcttttttaagtaactgccacctgtaggttactttaatgcagtgttttacaaccttggctgcacattaaagtctctgcaggagctttaaaaaacactcatgcctgaggaccacctctagagattttgatttgatagatgtgatatgccatctggatgtaaggatttttttttttttttttttttttttaagacggagtttgactcgccgcccaggctggagtgcaacggcgcaatctcggctcactgcaacctccgccccccaggttcaagtgattctcctgcctcagcctcccaagtagctgggattacaggcgcccgccaccacacctggctaatttttgtatttttagtagagacggggtttcaccgcattggccaggctggtctcgaactcctgacctcaggtgatccacctgccttggcctcccaaagtgctgggattacaggcgtgagccaccatgcccagcctctggacataaggatttttaaaagctctccaggcaatttcaaagtgcagctaaggttaaaaggttactttagtgagattgagcttaacattgcatctgaaaattgatttatttgttgaatcaggttggtggcttaaatctgattcagtaagaggaaccaactaaatactttgatcacatcaataaatttatacgtctgtctagtataaaattgatttaactttaatttttactaatcttgtgaatgttggtatattagatatcgatgcatctataactaatacagtggcagtatgctgaaaatcacttttttcgagatcttgaaaccagtacagtaaggtaggactaaaaaatacaactttggctattggagtgatgtagtattccagaagttatggactcattgagaaagggagtgaagtagcccctcaggatgaaaagcaagagaaaaatgaccatagacgccatggactactaacttctgtacccatatccatagtacgcaatgatctagaacttgcacactagtctctcaaaatgtgtatttttaaaattatttatatttttagtttcgtctgtctgcattctctgctacaaaataggcagcagaggtaggtttgtgttttggtttagattgttgatccaaatgctggctggctccattacttagtagctgttaggcaagttactacatttctcacaacttcagtttcctgacctgcaaattacggtaataatattctccttcacagaatgattacgagagtaaatgagatgatgtgtaccaaatgcacagttcaatatctgatacattgttaagcagttgataaatattaacaataaaaggaagtggttatgttgtggaaatagaaaccagtatttaatgagtacttactagtagtatgcatattaagaatatatatctcggccgggcgtggtggctcacacctgtaatcccagcagtttgggaggccgaggcgtgcggatcacctgaggtcaggagtttgagaccagtctggccaacatggcgaaaccccgtctctactaaaaatacaaaaattagctgggcgtggtggcaagcgcctgtaatcccagctacttgggaggctgaggtgggagaatcgcttgtacctggaaggtggtggttgcagtgagctgagatcgtgccactgcactccatcctgggtgacagagtgagaatctgcctcaaaaaaaaaaatatatatatatatatatatatatatatatatctctgtccttatatcttaatccttgagcctctgtaagaaaactgctgttatcccactttccttttctttcttttcttttcttttctttttttttttttttttttttgagactgaatttccctcttgttgcccacgctggagtgcaatggcgcgacctcggctcactccaacctctgcctcctgggttcaagcgattctcctgcctcagcctcctgagtagctgggattacaggcatgcgccaccacgcccagcaggttttttttgttttttttttttttgtatttttagtagagatagggtttcaccatattggccaggctggtctcaaactcctgacctcaggtgatccacctgcttcggtctcccaaggtgctgggattacacgtgtgagccactgcacctggcccccacttttctttaaacagataaaaaactctggctcatagaagcgaaataatttgtcttagatcagaccatggtataaatgggattctactcagactttagcacctgtacttttcccataccacactatgatttagcctctagggaagtctcagttgaacataattagatgaatttgtagtgaattggtatttttttcctcgtaggaaaaggtaggttggtgtcaattttgtgaacaatatggtgagcaatgtgggcatgccattttccagcctgtcggaatcaatattgtccttcatttgagtagaatgtgcttgtttttttttttttttttttttttttaaagacggagaatgagaatttgggctaggcagtttgtccaacattttgtcagtctcttcaacgctcactattctgttgatcaatgtagcagatggtggactttggaactttttatcagagaatgtgtgttgagaaatgttctacttggaaggaacattcctttgactcataaaaaaatttttctcttaaagacctctttgctccttgttgcattcaaattaccctgaatacttcctgctgtgggcaccgcatgaactgttcctacaaaagccagccctttccacttaaagtagtgcagcattatataagggggagagcacaggctttgggagcagcccaacctggattcaaatctattacttgttagcaatgtgctaagtaagagggtgctaatatttattgactgcctactgtgtgccaggcattattaaataatttatttactatcctcattaatttccacaacaactttctttgctttttcacagcaaccttttaaaaggactgttacattttttataggtcaagatgcatgctcaaagaggttaagtatctagctcaagttctcacttcttgtaagtggtaaagtttgattttgaactgaggtttatcaaactgctaatgtatgtggtataccttgaacaaatatgttaatatttctgttctcaatttcctcatctctgaaaccggaatactaccactttgaaggactgataagaggattaaattagtgtacttaaaattttctgtcagtatctgtttaagtagatactcaaataatactagtttcttccctacctttagtaagtaataataacagaagaatgaagcaattttcacctctgcctttattaaaatgttttacatttaactttgtattttgaaaaattttgaactcagaaaagatgcaagaaacgtgcaatgaactcctatatatccttcatccaaattctccgattcttaacattggttacatttgctttatctgtgtgtgtatacatatacatatatagaattttactgaagtctttgagagtaagttgcagaatcatgaccttctgttcctaaatatttcagcatatatttcctaagaacaaggacagtcaatacagtaacagtgcatttatcaaaattagtaatttatcattaatacaataatctaatatatagtagtttatattctacttttcaccatctgcttaatagtgttcttttaagtatttttcctcctgatctggatcacacactggatttagttgtcatgtttagtctcctttgccacctgtgccttttgagccattactgccactacattgggttgtattagaattacttccttagattatctgtctcttcagagagtgatgatctcaaaccatcttaaacgttgtgagtaaaagagaagaatatttgtactcttctgccctggagtgaaatcccaacaaatacttgagtaactgtgtatgtcaagagattgtgctgagtggtggagatcagcaggtcaggagatacacggtcctggttctcaatggggcttccagatgagtaagattgttatagtgcagttcagcaagtcttgctgagctcacaagagagactgctcctggaagtgtgctggaaactagatacaattcagggctcccaaaggatgtttaaaaacaatattaattacctcatgacaggaagattgaaaatttcaaggtaatcatattgtcagcttttcatatcttaaagtctgttttgaaatcgggttgaatgtgaaaatctaagagactttaacactgtctgatgtagtagtaatgaaacaatgcctgtactgcatcattgccacaattggtggtaaagtaccatttcgtttattcagggtgatagtttcctcattggaattaaaaaaaaaaatcagaaggcagtagaaatctctatggaccttcctgcagtatttatattcgttcatctacagatctttctttcacttgttttttgtctggttttttaaagtgtcagctgaggctatggtgcctcttaattcaccaactgaaacaaccagaatttctagtgcatttggttatgctttcctgtcctgcaaggcctgatttggttacaatataatctttgttcacatttttcaaggtaaattttagatacccagccatagtcctctttatggcagaaacacaaggctgacggacaacttaattaccaactgtagatgtaggaagggcttccagtcaagagaatgctgagtagttattttacaagtctaaaggagactgaatgtggaagatggatttaaaatggaaatgtggtagtagtacataaagaaattctgtgctagaattgtagagcattcagatacacctaggattctaggtatgggcctcatagttcacctaagaaggagagtggacagagagagagcagggccttgcctttccttccctctactggtcctgtcacacatagccactctatttctgcatatgattttatctgaaaacatgcagctacttagaagtttgaaaactagtgtcttagttgtatttgtgaaattgtaccaagccatggtctctcaggttccttgcagctctgtataaagcctctgagctgctttattcacaggtgtttgctgtccattggttgcatactttgggaacataggtgcatggtaacattggtgcatggtaacattaagttagagcatactgtgaagcagatgatgttggaactaatggttcatgtgaactatttgtactatcactaccagtgctacagagagacaattcactttatttatactctattacagtgtcttcaaatgttcatctcaaatcaggtacattttgatcaatgctgttataccattttatcataatttaatttgcaacagttttttgccttagtggtacataagatgatggtgcctttacaagtaatagcatcttaattttgatgaaatatgctatatttagtgcataagatgccacacatataagggtaaaactcctcatacattctttcctgcttttttgcatctatgaaggtggcaataacttcagtaagccaaactgtggctaacagtaattaatattgagacattaatgttgagacagatgtcatgtatctttgtagctctagcctctagcatagtgcctaccacttaataggtgttcagtaaatgtttcattgaatggtcttttaatattagtttatgaggctagaccattaaaacaaagttttagttgggagtaattagaaaaaagaaaataacttactttttttttttttttttttaaatggagtctcgctctgttgcccaggctggagtgcagtggtgcagcctcgactcactgcaacctctgcctcttgggttcaagcgattcttctgcctcagacttctgagtagctgggattacaggtgtgtgccaccacacccggctaattttttatattttttgggtggagacggggtttcccagtgttagccaggatggtctcaatctcctgacctcgtgatctgcctgcgtcggcctcccaaagtgctgggattacagacgtgagccactgtgcctgaccggaaatgactgactttattcaagagaaaaataatttgtacaagtaaggcaagtaatcatagtatattacttagatcacctgtgtacaacatttctagatgcatagtaatgtagatactgaatactgatcctaccaaaattgtaacttttaaaatatttgtatatatttaagagatacaagtgcagttttttgtttttttgagatggagtctcgctctgttgccaggctagagtgcaatggtgtgatctcggctcactgcaacctccacctcccgggttcaaacgattctcctgcctcagcctcccgagtagctgggactacaggcgtgtaccaccacacccagctaatttttgtatttttagtagagacggggtttcatcatgttggccaggatggtctggatctcttgaccttgtgatccacccacctcggcctcccaaagtgctgagattgcaggcgtgagccaccacgcccagccacaagtgcggttttgttacatggacatattttgtagtagtggtgactgtaggcttttagtataaccatcacctaaataatgtaccttgtacccattaacaaaattataattattatgaagagaaaaggacaagctgtgtgcatgtgcttttggggaagaggggcagacactaagctaaatactcattttctatgttgagaagtcagtttgtaacctcattggtctccattcccacattcctcttctgtgtgcatgtccggttctgctttgtgatgctgttgtttggagatgtgtagtttttatgtaacatggcccaaaaatgttaggccaagattttatttgttaactggccaaaaaaaagtgataaagagaaatactttgtttactcgtatttttatattatgtaccaactttggatcttaaaccctcagtaaaatgcaactccagcagacgctgtcccacacctaatatggagcttctgttctagttagagagctgagaaaagtatataaatacctattaaatagcccaaagaggtgtgtgtgtgtgtgtgtgtgtgtgtgtgtgtgtgtgtgtattttttaaagccagtagagaccaggcgcagtggctcacgcctgtaatcccagcactttgggagactgaggcaggcagattgcttgaggcaggcagattccttaagtccaggagttcacgaccagcctgggcaacatgacaaaaccgtgtctctaggaaaaatccaaaaattagctcgtatggtggtgcgtgcctgtagtctcagctactcagggggctgaagtgggaggatcactggagccccggaggttgaggctgcagtgagctgagattgcaccagcacactccagcatgagtgaccctctatcaaaaaaaaagaaaaaaggaaaaaaaaagtcacaagagagtaatataataaggaggaggggaaagatcctatgtccatagagaaaagaatggaaaagcgatcagtaagccagaccgaaagatgggtgggttttggatagtctggaatccctggatgatgaggtgtctttgaggaatgcacatttacagtttggctgcagaatggggtataagaagattaattgtggctggaaaagaacatcggtgaatacggagaatggtgatggcccggcagaagagttgctggtgtggcatggcctatagaggcactgtggtagagtggaaagagatagtattctggctctgcttattagctgggtgaccttggtcatgaagttctgtggctctttgctttatatatctatacagtagagataggatgcttcgcagaattaagattatgatgaagagagaaagcctaggtgatacaggcacacatgtatttcactctcaatacaaaaagaacaacaaaaacgttgttttgttttgtagaacagagcttttgagcaaaagaatgatgtcactattgctttgaaacagttgtttctgatagattggggggtagtgaaggccctagggtaattgccccataacaagagtggctgtaagagtccaggtaattcagtcaaagtctgaactagaccagtgcctgtaggatttgaaataaggagctgaatgggggaagcattgcaaacacgaagtcaacatgttcagaatgttctgagcaagggaagtggtattgctagggataacagtggtttcataaatggaaataggtttggcattgctgctgcttttgattatggagtaacataaaattgaggtttgaaatttgaaggtgcccattagacaccctggtaaagacattcataaagtagttggaagtgttggtgcagaactaagagagactttgagtcaagagaaagagattgtgggggtgaattggggctgtgggaaaggatagatgaaagaagaggactgaatgcagagaattgatgtgttcacctctaggagatgaggaagaggagccagggaaaacagtagatgtataggatggatttttgtggatggcaaataagaatacattttaaaagaagaatcagatcaacatatttttttcttttcttttttttttttttttttgagacagagtttcactcttgttgcctaggctgcagtgcaatgcatcgatctcggctcactgcaacctctgcctcccgggttcaggcgattctcctgccttagcctcccgagttgctgggattacaggtgcacgccactacacccggctaatttttgtatttttggtagagagggggtttcgccatgttggccaggctggccttgaactcctgacctcaggtgatccaaagtgctgggattacaactgtgagccaccatgcccagccagatcaacatttttaaattctgcaaaactcagggttgacagggataaagaaaggccactgggccgggtgtggtggctcactcgtgtaatcccagcacattgggaggccaaggcaggtggatcacaaggtcaggagatcaagaccatcctggctaacatggtgaaaccccgttgctactaaaaataccaaaaattagccgggcatggtggcgggcgcctgtagtcccagctacttgggaggctgaggcaggagaatggcgtgaacctgggaggcggagcttgcggtgagccgagattgtgccactgcactccagctgggcgacagagcgagactccgtctcaaaaaaaaaaaaaaaaaaaaccactggattttgatatttacttatcactggatacctgtgacaaagctttggtagcattcagagtgagtaggaggccgggtgtggtggctgacgcctgtaatcccagcactttgggaggtagagaaggatggatcacctgagttcaggagttcaagaccagcctggccaacatggcaaaaccccatctctactaaaaatagaaaaattagccaagtgtggtggcacacgccctgtaatccctgctacttgggaggcggaggcaggagaatctcttgaacctgggaggcagaggttgcagttagccgagatcgcgccactgctctccagcctgggtgacagaacgagactctgtctcaaaaaacaaaaaccaaagtgagtaggagccagaccacaaagccttaaaatgttgaaatggctggaaaggaggtagagatggtgagactccctgaaggaaagaggaagaggaagacagaacatgtttcagtgcgttcagcaggatttctcgatgccagcactaccgagtttgggcctgataattctttgttgtagggagcagtcctgtgctttgtaggatcccctcctactcctgagttgtgacaaccaaagatgcctccagttattgtcaaatgtcccctgggggccatattccttgggtgagaactgatcgacagggttgaataaggattcctaccgctggagtggggaaggagctagtccagaagtgggtggaaaaccacaggcagccaggggatgatttactgaagcagggacccaaggagggcaggaagaaacagagcaaaacctcggtctagaagaggtatcctgaagttggagagggtggggaaatgcattgttgttgttgttttttttttttgtaatgacagttgttttggcttacattagatggcctcaagcttatcactgagaaaggagaaaaggtcttttgagaatgaagtaggcaaggttaatgtttggcattagaggaaattatataaactttaatcccagtgggggaagattagtgtacaggtgagtaaaaggattactgagcagcaatgaggcctggctgaatggaacttttgaagcaattattaaaaagattggtaaaatgtatatctcaaccacgctgatactttttatatttgtgcgttttacagactagacttatgtactttttttttactttttattttgcttatttcacaggactttgtagatttcaatgttattgaacttttatttcagttatttttaatggctacataatagtctatagatctgttctttaatttaccaatcagcgcttcagttactaactggttagattgcttccagtttttaatgaagttgtgccaaaagttgcagtaaacattcttatgcatagagttttgcgagattttactagtggacccagtaaaggttttatacggtggtaacacagagcaggaaatgtattttctgaaatgtcacattaatgaggccacccttgatccaccacatttaaaattgcaaccttcattcctgctttaatctctgtagcacttgctatcttctaggtgttttacttatttatcttgattgctgttgtctcccttgttcgacagaacagggattttggtttgcttcaccagtaccttaaatagtgcctggcacatacatacttgctgaatgaatggatgatgggacttacccagacctgtaggcgaaatgagtttggaagagtgtcagtagcaacagatattcatggaagccagtgggaagatacttgcaatgactgatctttagtatctagagggacaaggaagcaacaaaagtccccagggacatgaattgggagattgaagggttagtacctggaggtaattgtgacaacaaaagcacattcctctggaaggtgagagtgggagaggtagaaggtaagtaggctgtggttagagaaagggatttcccaaggtttagatattagaaatggaacagtttgagaattaaattctcaaatttaattttgagaaggttggtagaatactccatttcatggagaatggactgtatcactttttaattgctcctgccttggcaaacagtgtcctctaatcttgttatatttgggtcatgctcagtggtggtatataaagcaggttttgttttcagagatcttttttgttggaatatggctgtatgtgataatctgattaagcagatatgccactaatgtctgccacacaataaggcatgttagtgactatgtcaatgtaggcttgaaagctacattgatagagaagttgtctccccgctatttgacttcttgagtcgtttctttgaactgtcgagagtattttacaagtgcttttctgtttgaggtcatttcactcagagtatagcaacttagtaaaatatgtaaaacatgtagtatagcatatgccattcttattttaagctgcttttggggagccactcttgggtatggaagttgtaatagtagtttttggagtacactttattattattaccgtcagccagtacatgattttccattgccttatacgttttccactgtagcattaaaaaaaaaattttttttttattattacactgtaagttctgggatgcatgtgtagaacgtgcaggtttattacataggtatacacgtgccgtggaggtttgctgcacccatcaacccatcatctacgttaggtatttctgctaatgctctccctcccctagcccccaaccacctgaccgaccccggtgtgtgatgttccccttcctgtgtccatgtgttcttattgttcaactcccacttatgagtgaaaacatgtggtgtttggttttctgttcctgtgttagtttgctgagaacgatggtttctagcttcatccatttctctacaaaggacatgaactcatccttttttatggctgctactgtagcatatttttagctttaaaattccaattagtctcaggtgaattgttaatgacagacaggtgtgacttagtagaaaaaactggagagacagttgaagtaatctttctcatatttttcagtggctagatagcatgtctgtaatttcttaactctttagtttcttctatttcaaaacatgataatgatctcaaatataaccttcctcccaaaatctcagggatactttaccaatctattgtttgctttggtgggattataataactgtgatataggttgggaggccaaggtgggtggatcacctgaggtcaggagttcgagatcagcctggccaatgtggcaaaacccctgtctctactaaaaatacaaaaaaattagctgggcgtggtgggacgcgcctgtaatcacagctactcaggaggctgaggcaggagaatcgatgaacctgggagttagaggttgcattgagccaagatcgcaccaccgcactccagccttggcgacagagcgggactctgtctcaaaaataaataaataaataaataaataaatatgatatgatatgggatattcaaaggtgttaatgttgtaaggaaaggaaaaataacatttcatataaggaggaaagggttgatggaaagcataatctattattgtgcctgatctttgagctgctaggcaccttatcagaatgctgtttgaggagtgttttcattatgtttaaagctttcagagaaagtaggattttctgatacaagtagaaaaatagaaaaaagtagatatgtttttctacttttaagaagggaaggcttactaggaattatttttaaatgaatgaaagagtagaaggaggaagaataggcagtatccgtgtgtgatttctctgtgtcaaacaccatagatgtagttttttatgcacattttctctaattctcaaaacagtgcttagattataatatctgtgtttgcatattatgaaattaaggctcagaaaagttaagaaatttgtctagcatcatatagttaggagataaaattttgtacccagaaatctctaactctgtataccacactgtgtatcaaactaatgagaaagaatagtgacaccaacggttaggacttcagacatttacatttgtgctgaatgtagaagagggtgcttaacacttgaaatgcgtgctcaagtacaatagttaataatatgagattgtgtggggtatgattgtgtgcctcatccctgtttattgtatgccccaagattctttcatctgctgcaaaaaagcacagtgcagattatgtgtggtatcacagcaggcattacgggcatgggtatgccttctggatgcaagggtggaattggaggtgctgtagcctttagaggagaaacccacttgccttgttcaaatcagttggcgtataatggtggaaagttgttatatttgtttataatgatatgagttgagcaaacttgcttgttttttaaattttacgaattttaactttaagttcttggaaccaagtgctttattccaaataggatatgataattatattgacaagtgttgaacaatatgtcattgtaacagtttttctttgtgtaattgacttcaataatcttgagggtgttttctgcacctattgttagaaaagttggagtgcccttgtaagggttggagtgagtggttcttctcttgccattataattgactgtagttagcatatggtctaatttattttaagagcacctcttaataagccttgattttgttgaaaatcaggctaaaaccatcttccttgcacttcctcattacttggttgttagcataatattaactattattagatcccacatatctctttatcttgatctaaagaacattgttagggctaggagtcctgcagttttcatttaacccatttgtgatctcttgtgaggaggatggagctattggttatatgcctgaatcatttgggaggtatatatactaatttttgctgttgaacctcaaagaacaatcaggttagaaatacgaagtaagacttagaacgttaagcctatgcctgggaggcagaatgtatatatattaaccagagatgcttgcatgtagggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatggtaagtcagaaagcttttatttttaagtatatgcatgtgtatgtgtgtgttttgtatgtgtgtgtccccgccctcctccaatgaaccttgatataattagaacataaaaatgctttcctggtgggaggctgagacgggcggatcacgaggtcaggagatggagaccatcctggctaacacggtgaaaccctgtctctactaaaaatacaaaaaattggccggcctggtggcgggcgcctgtagtcccagctactcggaaggctgaggcaggagaatggcgtgaacccaggaggcggagcttgcagtgagccgagatcacgccattgcactctagcctgggcaacagagcgagactccgtctcaaaaaaaaaaaaactttcctggccaggcacagtggctcatgcctgtaatcccagcactttggaagggccaacacaggtggatcacttgagctcaggagtttgagaccagcctgggcaacatggagaaactctggctctacagaagttagctgggcatggtggcgtacgcctatagtcccagctacttgggggtctgaggcaggcagatcatgtgagcctgggaggcagaggttgcagtgagctgagatgacaccactgcactcctgccggggtgacagagcaagaccttgtctcaaaaacagaaaaagaaggactttccccaaagattctgagacctgtaaagcagtattagcagtattaaatgttaccacttacagatcagagctagcattaaggttgtagccgtagggggactgagaggtttttttcattggttttgggaataatggaagacacacatttcaggtacagaaatatgcaacaactagaactaaatttctggcataaaaggatatttgtctgtgtttggcttaactttacaaaatgaaagaaccaacagtttctgagattgttgccaaagaacaagaaccaaatttaatcaggagtatttttacaactattttagtggcgatgatatgtaccatttaaatatagtgttactatatttaaatcaatagttgtatggtacaaagatagctaaaaaaaacagaaaagattttataatccactcaagtcttcaagataaagttgttgccagacataaaaacattacagactccctgttagcatttattacgaataacataaacgtcatatgtgtacatctctcttgggcataacatctgaaaggctgtgtttaggtaatttttccacccagtttatttcagagctgatttgatttggaaaccactggacagtaatttcatttaaggtcagctcaatgccagaggcttctttgggagcatgcattatttgagaccagcaagccaagaaattccatagggttatgtgatgctcccacttttgtgttttagaattgtgtttgttccagagcacgtgacatttcattttcctctgaatggacttctaggcaatcaggtttttccttagagctctttttactaggtgaatggtagttcacttgaaaatatagttttgcaggtaccaaagctacctgccaagatatggaaatggttggcaggcaaatacgagaaattaaaactgtgggaacatacatgtgctactttctttaggcaacactacttgtttcgccagatttctgttttataatgtttaccatttattaaatttaatgacttcatttcctgatttttaggagactgtcgtactctcagcaggactggaaataagctaattttgaatactcttaaggagcctaacacagaagcttttagtgaaagtccattttgcttgtacactctactagaaagactttaacaagcatgacacattttacacttgtacatataaacttttacaataggctcagtaggtagataggaatggtctgatgatggaaccctgtaagtgcccaatatattcactgagtgagtaggtgaatgagaggatggatggcagtaggtatgcatattattgcagtagatcaggtaatgaatgaatggcgagcaaaccagatgtttggaaaaatagattttaggtgttgagaaaatatttttataagaatttttgaaattttgatataaaggtaaaatcactaaagatcacctgtatttgtttttctccattttaaaccttgctgcatgcacatgggatttttgcatatttataaacttagattaataatttttttctaattgcaatatggtcctcatagttaataatggctagtatttcttccatcagttttatgaaccttgattttcttaatcattcccatgctgttggttatatctgtttatattttttaaatactttaaagttgcaaaatccatttttgagattacatatagtatccataatatactctgacagtatataggtatatgttctcatttattttatatttaatatgttctgattttatcaaaaggtgaaagaatatctgccatgccactgttcctgaaattatgaccccataactcgatggttaagttagattggttggaacatattttggggattaaaggacactgaactcagtaagtatttagggcacaggcacattggctgcaccttgtaatggaaaagagctaggatttgtttttacttgtatatatgaggcagggtgtaagtagactctgcccttctgaagacaatgaaaaatataggtgggacacagtggtgtaggccctataatcccagcactttgggagaccaaggtaggaggatcccataggctcaggtgttggagaacagcctgggcaacatagtgagaccccgtctctacaaaaaataaaacaattagtcaggtgcaatggtgcacacctgtagtcctagctactgaagaggctgaggcggcagggtcacttgagcccaggagttcaaggctgcggtgagctgtgatcacaccactgcacttcagcctggcctcagaatgagagagcccaccttaatgttagcagctcaattgaagatattcactgagctttttaaaaatcaggtttttgagactcttttatttttattttttttaagacggagttttgctcttattgcccaggctggagtgcagtggtgctgtctcggctcactgcaacctccgcctcccgggtacaagcaattctcctgcctcagcctcccaagtagctgagattacaggcatgcaccactacgcccagctaattttgtatttttagtagagacagggtttctccatgttgaggctggtctcgaactcctgacctcaggtgatctgcctgcctcagcctcccaaagtgctgggattacaggcatgagccaccatgcccggcgagactcagttttcatctacttcctaaaataagttcaaaatttagaaaatagatatttcatatatcctaatctattttgaacatcccagtatataggcagatatgaaaggaaagtaatatcagaaataagaggaaatttatttgtattcttttagattcgcttatcatgtgaccttagaagagctagaatagaagtgagttctgtccaacagaatttttgctcagaggtgtcagtgacatcttctcctacaggcagttttttaaaagtgtatttcatttcctcctagaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgctgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagtaggcctgtccacatcctccactgctgcagagcttcagcacgggatggggaataccagtctcacaggacttggtggagagcatgagggtcccgcccctccagcaatcccagaagctctgaatatcaaggggaacactgactcttccctgcaaagtgtgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctccgctctgttgccatgtctgttgccagatgggtctgatgggtccgatgctcttaactgcagtcagccttctcctctggatgttggagtgaagaacactcaatcccagggaaaaactagtgcctgtgaggtgagtggagatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcatgcgagccccgccttcaggcagggaaaggagcactccctctctaccttgcatggtctctgcccaggacgcacctctgcctaagggggcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcaggtaagcaaaacataatacaaaattaacagtctgagaagcagattcccttaagagtcactgtggtgtcctggtaaaaatataggcatctttgttgttttgaggccttgcactcattgggtaggtagccaagttaatagtcaccaccatcaggaggggcacgtcatctcagggttggacagattttgcttcctgtattgtagacttactgcttggttgcttaagcttataaacactcctgtctcattctggagtggttgcaactttgcaaacctagaaaacaatgcctagatcacaggtactctaaagtggtgaaagaatttagcagatgtttttattcacatggcttaatccttttctctagtaccatagaaaacagtgccaaaaagctgtgttttatctacaagcctgaaactcccttcctcccctatcatcctagtctgtattctgagcaaatttagagtcagagtggtttcatgaacagctgtaagtattgttctgagctgacttcccaacatccaaaatggtggtattaggtcattggtggttttttgtttgtttgtttttgttttttttgggctaggggtgttgttgacggggaactccttccttttcctgcttggggagtggacctctagttccattgcctgttgcttttgggcagcagtctgagaattcaagaccctgcacagtgcaggggataggatgcaggatttccgcccaagcccagtctgctgagctgctgtcacagggcagaccttgtgtctgctttatcttggtgaagcagctgcactgagcagattgctcacacagcagcctgttccatctgtgggtaaccatgttccgaggcagcaaagagaaaccgctattgctccgtggaaataaactatctgaataaaacttcttaacgggggttgaggctgaagctgaaacgggagtcggacacgatcttggctcctgaagtctttaaaggtcagtttgatgcacacttctataccaccacctgttaccagctgtagacagaagacctatctccatgcttgcccctaggcttttgtaggtaagaagcagcctgttttgtctttattgtttatttttgctgttcttttcaatttttgaaaatccctttacacatatgtattaagaatgtgggggagggttatggagagaaatgaatcaatggagcaaaagaagttgctttggaagaagcgcaatttaaatacagtggttattttccctggtaaagggcttttagccgtttataatctttttcctccccagttgagggatttaaggaatccgaggtagaatttttgatgactttagctttttagttttattaatgttttggattgttagtgatagatacttgctggctgttgtctcaggatttaaatgaggtctctaatttttaaaaaaagccacaacaacaagtctattttgggggccctggcaggttggcatttcagaagaatgggagtggctgtaagctgatgcctggtgatgttcttttcatttcggtgctgcgtccttggccacatgggccggaattatttctctttctggctcagtggtcagaatttgactcaagcaagtgtgaactctgtggggattgtgtctgtagtatcctatgagaaaaagtaaaaaccagggagaatttcagactttgatttttattagcacatatagtaaagatggtgagaaatgacggatgtttaggattttgaggttttgagaaggaagaaaaatgtatggactttcagcagtatatatgggcttgaggttggtaaattttgtgtaggtgagttacttgtcctgttaccaaaaggagtcatactcatggtctcaaactgcagaggaactctgtattgatggtctcagactacagagaaagtagccagtcatgaagaaattggtactttcttcagaaaatggccaggattgggaaaatccctggtcacattactttagagaaaaagcacctgagtgtgatctcagagccaaagggtattttctatcaagtttacattctactcatagatttaatcatactgttttgtgagtgagaagacataggtttaactgctgatttggaaggagccagtttgaaagaaggggatgtggcccttgacccaccaaaagcattgaccacagtgcttaggaaatcagtgatgcatgactgagccacgccagtcctgcagaggctgccgacacccgtcaagtgtgagtaatcactgttttctagtgtgactggttgctgtgccaagatgcatcttttcaaagttgataggtataggaaaggaaggaggtaccaaaaatcacatccccagaggaaagcaaccctctttccccccagaaattactctgactcacttagagatgttttgatcaagggatagttctaaggggattgcttagtcagattttaactttaataacattttatgaaatttaacacagattttggttctttgggcaaggaaacttgtttacccatttttaaactgctggtaagattatataattataaggtcaaagaaggaagaaaagaggttcatctatagaaatgtaactcttacaaatttaaggtagacttttgtacatgtcatgtgctcctagaataaaatcttaatataatttattctttggtgaaagaaacttctgtgctctttagtgtggggagcatttttcttgccagagtagtggcatcactaggttaataaccacagatgcatttccacatgaaatcgagatgacagttccatttgcatttggattattaaggtgaattttgactgttcaatcatgagtcccgtttaaagaagtgtcagaagcctaaatttgcctcagacatcatttatcatttccttcctgtatttgcttgaccatgtggtggtcaggtaacaaaaaccaccactgtttttggtctgtcaacatggccagcaagaggacaactatgtaattcttgagaaaacatgcgcagaaacgtttctcttaagaaagggatagctagtctgtgattaggtttcagttttggaagaaataagggttaaaaataagacgtaactgctgagtagttcattcttactggttacagtgatgggtggatcagagtgtgttgtatgttagtgaaagtcatacttgtcccagaggctttttctcattctcagtggctttttcctttttgttttgtacaaatccttgcttttttgatgatggccaagatggactacctagcttcagctattaatctgttcccctgaagcttatgaatttagttttccatatgcaagttggtgctacactcagatttgtcataaaaagtcaatagtgaaatggatgttcaaaagacattgaattggatcctcgcttagttccaagcgcctacaaaggctagggaaaaccagtaaccatgcgataaaggaatagctcagcatagggtcagaaatgacactagccgctgacaacaaaagaatacttttccattttaacgcaaaagcaaaacaaaacacatgaaacctggagcatgttgtatgaatagtaaggcacaggaatcagtttttaaaaatgtactctgtaacccccctgcactttcagaaatgccagacgtgaaagctgaagatgaagtggattttagagcaagttcaatttctgaagaagtggctgtagggagcatagctgctacactgaagatgaagcaaggcccaatgacccaggcggtaagtggcatcagtaagtctataagggcacaaaatgtgtttatcctgttctgctgtgtcttatttatggctttgtcttttatttgagggtaagtgggcaaaatagtattttcccccttccctcttgtgctgttatataaatgtgtttatgttgctgcagctaagctttcataaatggtatataccatacagcaaagttttggaatgggctgttacatgttttcttatagattatgctgaaaaacattttccccttgagcacaaggctttaagatttgtcagtaagcttaaattgtcacaaaatctgagctatcacaaaaggggatctatagaccttttctttctttttttctttccttctttttctttttcttttttttttttgagatggagttttgctcttgtcacccaggctggagtgcagtggtgtgatttcagctcactgcaacctctgcttcctgggtgaaagcgattctcctgccttcgcctcctgcctaatttcagctgtgagtagctgaaattacaggcatgcgccaccatgactgactaatttttgtactttttgtggagatggggttttgccatgttggccaggctgttttcgaactggcctcaagtgatccacctgcctcagcctcccaaagtgctgggattacagatgtgagtcatggcactcggcctataaacccttcttaaacctgactcttctttctttatataaaaactgatagccaaaatgagatttttactttatagctcaatagtaactgtctaaattatgaagtatatcgttttcagcaatgaaaaaacaggttcaataggccagacgcggtggctcacacatgtaatcccagcactttgggaggctgaggtgggtggattacctgaggtcggaagttcaagatcagcccgaccaacatggtgaaaccctgtttttactaaaaatacaaaaaaattagccgggcgtggtggcaggtgcctgtaatcccagctacttggaaggctgaggcatgagaatcatttgaacctgggaggcggaggatgcagtgagccaagattgtgccatagcactgtagcctgggcgacagagcacgacaccttctcaaaaaaaaaaaaataagagaataaaaggttcaatcaacattttttttttgttttaagaatagtttgttttgggatatgattcacataccataaaatccacccaatcaaataaagtgcataggtcattggttttaaatagatttacagagttctgcaaccatcgccactaaggctctaatttcagaacattatcactctaagaagaaaccccagacccattagcagtgtgcctttccttcactcttccctcccccagctcattaatctacttttgctttctgtaaatccatagagagatttgctgtgagagtgtgaaagtggctgtagatagtacgtaaactgcccattccagaacttcatgtaaatggtataacacaatatgtgatcttttgtctctggcttctttcacttagcgtaatattttcaagtttcatccatgttgtggcattgatcagtattttatttctttttattgtcaaatactgttccgttgtatagatataccacatttttttgtggatttggattgtttccactttttggctactgtgaataatgctgttatgtacatttgtgtacaaaattatgtggacatgtttttatatacctagtggagttgctgggtcatatggtaatttccatttatttggcttcaaaaatatttttcttcaaggtcttgagattatttttctttgtttaaagctattaacttttattttattttattttttatttttttgagatgaagtcttactgtcacccaggctggagtacaatggcaggatcttggctcattgcaacctccacctcctgggttgaagcgattctcttgtctcagcctcccgagtagctgggattacagggactcgtcaccacgcccggctacttttttgtgtttttagtagagatggggttttgccatattggccaggctggtctcaaacttcttatttcaagtgatccacccgccttggcctcccaaagtgctggaagtacaggcgtgagcctgtgcacccagccagctattaacttttaaaacaaacttgttgagagaaacagtgccctatgctttagattccatggtggtcaaaaaaaaaaaattagaaagctgaaaatcaagttagtgaacttactcatgctgcccctttgaaagtccatgttccttgggctacacttgacattgcactgtttttactcttcagaggactaagtggtatgtttttttgaaatttcacggtaggtaaatggaacagactatcccagattgtttcaagagtatgaacagtgatgaacaaaccttgttgtattggagtactgtggtatgaaggtgctgactgttctaacccgcccttattacacataatattcatgactaatgcctgggtggctacttgtaaagcaggcattattcagacaaatgttgcttttacccctgtgagaagaaaagagaacacaccctgcatgggtacgtgtgtctttgtttccagaagccccttagaaagggaaggaaaaaactcacatccttgaattcaaatacctctgtttcttagtactccattttaatattgtagtgattagagtcattgaatccaggctggtacttggctctagaccctttgctttctgatgagggatatctctattctaatggtatcttgtctactataaagaagaaaacaaaacatgacttaaagaaaagaaaaggtctcctctctcagtccctttcctcttctccttttttctctagttttaagagttgagagagtgaatattcctctggttggtcagcatacctcaatttacagataaaagaatagacccttggagagtcacatgactagcttgaggccaaaggcagctggaagagtttgaggtttgatttctaatctgggacttacacaacagggcgattcctccttgactcaagaaacctgggctctgattggtaaagttgctataagaagcctgagaaccatgtaatttatctctagctgcgagatatcaatgccttatgctttgtgtttgcttccaccgtgtagagttggggaaagcatatgtcagtgggattttcagttcttgaggatttgcaggcctaaattcaggaagtttttgtgttcacagcattcttataatgatgtgaaatctgactacttaactcttctccgtggtgctctgacaaacttgccttatttgctgtgagttgaaaggataaaacagacacacactttaatttttcccatttaactcttcacatactatattcatataggttttcactggatggggaaagagagcagaggtcggcaaacattttgtaaaggacagattttgtaaatgctttgtgggacatatggtctcttaaaactagtaagctttgctgtgagtatgaaagtgtctgtagctagtatgtaaacaaaggagtgtcactgtgcttcaatacaactttattatggacactgaaatttgaatttcatgtgatggtcatgtgtcgtgaaatattattgttttgaattatgtttccagccattaaaaaaatgtaaaatctcagccgggcacagcggctcatgcctgtaattctgccactttgggaggctgaggcaggcggatcacttgaggtcaggagttcgtgaccagcctggctaacatggggaaaccttgtctccactaaaaaaaaaaaaaaaaatacaagagttagccagaaattgcttgacccgggaggttgcagtgagccgagatcgcaccactgcactccagcctgggcgacagagtaacactctgtcttgaaaaaaaaaaaaaaaaagcctactcttaattttttttcatgggctgtaaaaaagagttaatatcccactggcaatagcatgtgagcccctgcctaataaatacttgtgcaccagtggaagaaaagaaaaaagaagcaagcagatttcttaaattgttttgtggtgaaacctctggtttttaaactacaggttgggagtgggatcaagttctgtctttcctgaatagctttttgacagcctctctagggctcagtttccttgtctctaatcattctctagctttaaccttctagagtctgttttcatgctgaaaagggttagagtctatgattatatttgagggaggagtggcatttgtgtaatatttaacctgatctttctgccacataccccgtctatgtgtgtgccttgggaataggccagtcattgcttcattgaatcattgaatcatcctctccaaatgtaaaatagaacaaattcctgtatcttatgctttgctaccggcttcaaaaccagtagtatggtaaatttatggcagttttctaataaatgtaaataatccatttaaattcttatggaagttttgtaacattctctaaacgtgtaatggtcagagcataagaacctctgtcgagtggcactaccaaggatttaaagaaaaaagctacagctgagttcttgttttctttagtcctttagtctgctatctgtcatacaaactgaggagtaatttttcattccttaacctgtttgacacatgtattgtaaataaatccttactttaaaggtccagtgctgaaaatcatagttcatgaaggaattagacagtatctgcattcgtttacttatattctcagagaaaacacaggtatgtgttaaatgctgcagatttcttgatagtctttactgatatttctttattggggtgaaaatgttcacaatttttgaggcaaagttattactttacacatattgtggtttattcccattaatcattttatcattttattttagccaaagttttaatgcccattgcaatttaatattcatcattacctccacctgtatgctttactggtttgaaggtattcagattacctttcgttgtcatctttttttccttagtgagttaatatatatcaagtacttagatcagagcctggcacaaaataagtacagcttagtattattattagtttagtaacttcagattacaatatgctattcacttattttagtaactagtggaatatggtggttcagactcagttactgcttcttgaacatgttataaaagcttcaggaatagtttcttacattaatttgaaattgaaagacatggaacttgttttgcttctgagaccgttacaatttgaaagaaccttaaagattttctgaagtccagcacctttgctttataagagaagaaatggattcaggatagttaaatgacttaccttgtttcacagctagttaactgtcagctggactagaacccaatttctatgtgaataatttttcccattatactatttcctgaagaatcatctgagggtacacttgggaagtcccatccacttggtttaggatgggtttttgcgttttaaacaagcatccctgaatgatacttaatgcatgctaaaattctaaagccattgcattatactttcatgcttttggtaatagttggagaaactcctttagccattttaagatgtaagctgatatactttaagtctcatgttcttactataatctgtttagctgcaactaaataccactaagatgatgtttctccaaaatgcttgcttttggtgcagaaattaggaagattttttagacctgccttttatttcctaaagaatgatatgatattgagccagatgctggaggcaagcaggagatgacattgaatacttaagttcagaaaaagttcagaaaagagggccgtctgacaccattcgccttcatagtatgtcccagtactgcaaaccaatatcgtatgttgtagggatcttttctcttcaagatatggccaagttcattaggaaggaccttctctccctggggcatctgttcattgaagtatctcaataatagttccttttctgaatgctctttgcataagcttattagccgtatggaacagttaattctacaaaccagtatatattgtcagggctcctatggtcctaacagtcaaacactcaagaacaactatgttcaaggacaactgtaaaatcccatgtgttgagtattaggctactgggaaaatctactctttatttaacataccttcctcaatcaagaaagcatttaaaatcagaaccatgatctttttttttttttttttttttggcaattatacagccaaacatcaaattaactgaatttccattcttagttatttttacaacagtattcatgtttttttcttcaggactgtagtaagggcattgttggtcttagaatattgcctgttaatatcttcctgaactatgtccttttattatatttaatggaacactctgttttctttctgttgtctaaagggggcgaacttgtatttccatccctagtctaggaatttggttgaaagcttttgtattgtgtggctgttcacagacttcatgctcagctgccgtgggaaaatatgacagcctctaggctatttggtgactaatccaacaacttataatgctgatattcaaaatggcttgtacgtcccaccctgttatttaatagttgtcagtttttaaaaaggtcctttaaaaatgtttctgccatcatattcacatagttttgtggtgtgtgtgtcacctagggaaaggcaaattgcccactttctgagttgccagaaagtcttatctgcatacatttttggcatgtaagagaggcaggctctccttaaattatcccatataggtccaaagctagagctagcatcaaccacacaaaatttaattctcagtttttttcatgtagattttttggagactctctgtatctcctctgaaatggagagtttccaggaaattatcagcggctcctaatacaaatttttaatacaattgtggaaaagaagtacctcagagaaccccagaccataaagtcacaagtggcaaaactataaacttagtgtaaaactacccatagataatgtatgtaaaggtataatttaatgatctagttgtacatttttaagtgaccttaagcaagttatttaatttctctgatctgtgttttctcctttgtgtaatggttaatctctagtttcttccagctcttaatttttgaccagtgtgtgattatgaaatgattagaataatttaaaaaatactgtaatcccagcacttcgggaggctgaggcaggtggatcacatgaggccaggagttcgagaccagcctggccaacatggcaaaaccccatctctactaaaaatgcaaaaaaattagcagggcgtggtggtgcgcccctgtaatcccagctacttgggaggctgaggcatgagaattgcttgaacctgggaggtggaggttgcagtgagccaagattgcaccactgccctccagcctggaaggcagaatgagactctatctcaaaacaaaaacaaaaaaacaaaaaaacagaaaaccaaaaacaaaactgaggatatcttacatttggaccaaaaggacaatcatgagggattttttttttcttttttaaatttgagacagggtcttgctatgttgcagatcttgaactcctgggcacaagtgatcctcctgccttggcctcccaaggtgcaggattacaggtgtgagccaccatgtgggaatttttttttttttttttaaatcacacattctttaacccaatccttaactaatcacttttgtcttaaatgttttccaaggtgttttgttctgggatattaaaatcaattatattagaatctgcttttttctttcatagaactgctgaatcataggtcatatgtgcattttagaggggatgtgtgtctcatgccaccccctcttgagtgaaaataactgtatctgagtcttaccactctttctgtctactacttacactcatttctcttttgttcattcgtattatattgacagccaatgataatagctaagtataagggaaagattatggagcccagtgaattagggttttaacctagttttgccaactaccagctgaataattttgattcatttatttagaggctgtttcctcatttgtaaatttgggatattgatgcctgttacaaaggttgtttgtattaactagagttaggaaattctagcctataataggcattttaaatgcaatagatataattctaatctcattttaaagtaactcagaattattaggcccatcttaagacagtatgaatgagtgattttagataatgatttttaaatggtcttggaagaagctatcagttatatcaggccacagtggtactcatttaactttccatgtcactttatgtttactgcaagggtgtactaatttattcagtactcagttcaacaaatgttcattgaactctgtgctaggcctcagatatgctgaaatgaaagtagatgagtctctgcattcaaaggctcatattctagtaggaaaggcaattattaaaccagtaaatcagacatattctcaagtgttaaaatacaggtaaacatataggtgcttgtgaaaagataactttcagtgaaatggacgctaaattctcctttctaaggaagtttttaaagaatattatattatttttacactgtgggaatgaagatatatgcattatgtatcagaaatataggcttgggcgtagccattatttctaccagtaaatttggaagggctaccaataggtgatctcttagaaaaaactatgtattgcttgtagttctaagttctgtgttgcttactgatataaatatgacttagagctgcttgtttttgcctgtaaaagagaaagtttccatagtagaaaattaaaagagagatgtcatttgatctttgagaaaggcctaggtccacctcagggatctacctgggtacctacaatttaggcagttttagatattccatattaggttttgattgtggattttaacaagagtctagtgatatgtcgctagttgaccaccagaagagtaaatgtgtacactatttacggagttgtccactatatatggagttgtctactttatccagaaaaagtttcagggtcaccaatttcagatgtttctagtctcctaggctgctcaattttgtgatattagcctgtggctttaatttcattcatttattcatttagtaaacattaaatgattatttttccctggacaaattattgcatcaaatttggagggttttttttgtttttgtttttgttttgtagagatagggtctcactttgttgcccaggttggagtgcagtggcgtgatcatagctcactgcagcctcaacttcctgggctcaagtgatactcccacctcagcctccagaatagctgagaccacaggtgcgagccaccacacctagctaatttttaaatttttgtagagacacggtctccacaatgttgcccaggctggtctcaaactcctggactcagtgaccctcccacctcagcctcccaaagtgctgggaatacaggcatgagccactgcaccctgccaaataccagataatttttgaaagttaggtatcctttttgccctcagcatacctagaatctagttaaatttaaaaaagcaaacatatacagatataatcacaatacatgaatgcagtatatgagacatgttatcagataccattaatgtgctataggagatcagagagaggaatacttcttgaaaagtgcctgtctgaaacgtaatggtgtttccttggtgagacccatgttgtaccacaggtggtatcaatagtctattggcaagaacagggatagcttcagggagccattgatatgctttccagccttgtagttatttttttactttcacaatacgctcagcccttcgaagatcatagaattgcctaaggattgccagagacacatcagtttgcaaggtaactgatctggcagtaatccaggttaaaaaaagaaatttcattaggactgaaaaacataaaatttaccacagaatatgaaaaatggaagtattcagtagtatatgaaccatgtggaaattgaaacaagtagtatttctgtttaaatatttccattcagccattgaaagtgtgtgttctcccttcctgcctctttcatttcatacagtgatgtagacattttgcttccattctgaggacacccaaaaccctatcactgctgtggacctgagcaactgggacagtgtcttaagtgtacatatgaagtcttcaaagaaagttagttgatggtgaaaatgcctttcataaagttcagggcagagaatactcttatgagcacatttaaaatatctaagtttaaacctaactcagaagtcagagtaagccaaaatgtttattgtattgatcttctttttctgtagttggcatttgctcctgactgagtcattagtattcatatatatatttaagagttttgaaagcatagttgctgggtgtagtgactcacaactataatcctggcactttgggagatcgaagcaggtgtattgcttgagcctaggagttcgcaaccagcctgggcaaaaccctgtctctaccaaaactacaaaaattagccaggcgtggtggcatgctccttgggaggctgaggtgggaggatcatctgagcctggggaggtggaggctgcggtgacccatgattatgccactgcaccctagtctgggcaacagaatgagaccctgtctcaaaataaaataaaaaacctagtcactctggggttggaatttggggttatggaggtataaaaacgagtcagacttttcacatgtgatttcagtgtttgtactgaagatggttgcaaaagatttctctaacagtttgaactaattataataggaataattggggtaaattgtatagcttcacagttggcctttatggttaaatacgtatttgaaaggataaatttggcttggcgctttcatttatgtgagatacgtgtgtatgtgtatgtttcttttactgtgtagagtatgaagtaccttgggagtggcacatctgggaagtttttgctgaaccccttctctgaggcagaaaaaaaacatggtggagaggctaagtagttaaaaattatgaattattttattgcttggaatccccttgaagaaagatagattagtagaaaaacatacttgaactggagatgtcctgttcccttttgatttatgtaaaaacagcatgtgatcaaaaaatttgtaatggaaccatttagaggtcttttctatttatactccagattctataactatgggaatccaaaatcttccaaaaataattgttctcattatagaatattagtttagggaggaattttagtgagcatgaggcttgtgccctttaatttgcaagaaaggaactggagtccccaaagagctagcatgctcaaagggcctgccatcatttgtgatgcccaggagcctctccttgcccacctctgtcttagacatcacctgtcactgaagtaagctcctcagtgtcacatggtaagccagaggcacactggaaacctctccagtgtttctgctggagattcttaaataggaaattcttaaataggaccatctttactggtcagtgactttcctctactttatgaaatcctttaatccttactccccatacattaagaaaaattatgggaaggatacagctgaatgtgtacgcttgatccctttgttgtggttgatgagctgtgtgcatctgctgcactggtgactctgcagtacttccttttagcaaattgccttctgatacagatacttggaggcttgtggctgggccatgggcagatcacggtatagggtgatctgggtagactgaggattcccacttcctgttgccttctcctttcctgagcatggcatctttatttttgggtgtgcttgttgtgtgttaccttccttgaaatttagtgaaaattgttacctaccaacccagtaagcctgcatgaatcactgtgaaatccaggtttgtgtaattccagcgttttctgacagcagatgaatgatgtgaaaaatggaagagccttctgcttgtcatgttcttccttagggtaagatcctggtcgctctgggaaaagcagaattgtaagatcccctttccaatattctttatcttttggtttctatgaaaataataactcaaggaaaatgtcgtatgttcagttttatttttgacatcattaatttctttctttgtcattcttcctccttgttttgctaccaaaaatttgttgtgtttattttttcccttgaatcaaggggcctgaagacaatgggttggtttggactccccctgccatgctgggctagagaagaaccaaggggtaccacctcagccacccacaggcctcttgcaattgggcctaggcctggtccattctggagaggatgcatgatgagaagcatcagagcctgtgtagtgtgcagtctctactttgtgggcaacaggacattttctctaagaggctcaggaattttttctctcattccaccccgtgaaagccagaaactgtgggaagccacagactgacttgtcagcgggagaggcatggaaaaaacatatgtccatgcacgaatcccttactttaaacatttgtagcaaagattccaacggtaaattatgctgttggaacatagtcccttcttccaggagatgttactcttgtgcatttccaaagcaaaattgagcctttaatctgcaaatatgtactattttgtatgctgaacgttgtaatagaaaccagggatgccatggtgggtaaaataagacagatttcatccctcaagaagctctattgggagaaacaaagaaatgaaccaggagttgacacctgggtcgtgggaactcagagaaggaattttccattgtttaggcctatctacaccactgtcccttctactgttcccttctagtagcattgtaacatcaggcattaagtggaattctgctgaaatgtttcactcaaaggattttccctgttgacagcattgcttgccttaaaatagggggtcagacttttcattccagttccagaaagtgatgcgtgtatcatgattgttttgctatgaaacagttcctgtccctattaccctcgtagtcaacacaataggctatgttccttcccaggagtcattaggtttccctaatgggatgatggaaaggagggaaatagagctctggccctcttccttcattagtgctgaaatctggtgctgtatctgcttcacatcaagctcagtggattgtttttcccttgtctgagcctgctctttcctccttgagtgaggaaaaggatttaaatcctggctttcctgacatggaactttcctgcagtggctgttgcagctgaacgcattaaaaggagtacctgcaagctgtgagaagaaatattgtttgaagattagcatataatataatgtggacaagtgctcttaggtttgcttttaaatcgaaagactgtgttctgtaggatttgaaaaagaatagaatttgtcattggcacatcccacccgtcatagccccacaggtttctttgtagccactggagggtcttaagtgattctggcagtagtgaattcaggtgattgacatttgctcctgggtgtcagagttaccgtgtatctctacctactcactggttttggtctcatcttggggagctactgtgcttctagctgtcccagaaggggggaggtgggaagctcatcagtgcctaacaatgccaagttttctttgttttattcctaatgggaacttatactgccatttgtctgtttcttggcataactctttgggaaggaagaggggttaaataaaaacaaaataatgcataccttttatgaatattatctctgggctgggtgaggtggttcatgcctgtaatcctagcactttgggaggccaaggtgggaggattgcttgagcctaggcattcaagaccagcctaggcaacaaagtgagaccccatctctatttttaaaaaaattaagaaataatattatttctgaattagtcttgctgttttttaaaacttggagtcaccctattggttagataataccaaccatctattagcaaacaaacatcaagctgccctgaaatatgactgatgtggagtgttgccttgatccttcctcttttattaaggctggtttgtgggagcttggagcaggaagaagggaggtagcaaaaaggacagagaaggtgaaggagacctttaatgtgggggttggggaagcaaaaggataactaaacataagcctcttgacagcatctgtgaccgaccatgcaccaaagccatgatatggcaacagctgtgtaaaggcccaagatgtttaattcttttagcagttgttcctgtaacttcttgtggtgtatcaccccagcatagaatggggaagatgggaatagcttagatttaaaaaaaaaaaaaaaaaaaggctagcttactattcttcctctgaaaagcgttttatcacataaccaactagtttagtctaatggtggaagataatagcacaaatctaaataaattaaaagtacgaattgttaaatatttttaaaagcaggcttttacttttagatatacacaattacttggaggaaatttcaacagctgctgctaagtagaggcactgctgggccatttttaatgtagtagacaggactttaaatattgacatccattttcacaacacaaatgttcctttaggaaattctttttaataaacaaatagtaattaaaagatttaacaaatgcatgacattaattttaaatttaacaagatagccttttaaaggaatatattcccctacccagccccaaaaagcatttatgtcctgatgaccacaatgaataactgagctgaagaaacaacttgtctttgtcagggagataaaattcttctgccacgtttttaccttccattccttagcattgtgtctgtggctcttcctaatatcactttccccaggagtgggaagaccctcttacaattattggaacatttccactgtagaacctgtgacaagttaatctttttggaatggcagtcagatagctggaggtaaagccttacgtgccagatcttctactttgacacctttgctacactatatttctaaaatatccatgtacttggctgacttcttaaatgctgagcaaaatttatccttgatggctcagaattattgttatgagggtatctattactattatgtattaaaatgtacattaatgggcactaatccgagtaataattcaggaacttgcattaaaaagagttactcatgtcagtttaccatttgccctggtctttcaaaaatgcaatgagacttattcagccatatagtcccttaggaagtacctttcagttaacttcattagcacataggtcatcaaaagtcttttcctaaataattttatttgcccttcagaaaaccatctctgtttattgttcttgctgtaattactcttaattcaccagcatcattcataatgttatgaaattgtttagacctaatctcacatataactaaaggcattagctttcatatagtctgttaagttagaaagctctcacccaagattctatccttttcccccaaaataagaaaagctttttttctctgagacagtaaatttaacttatcacattaaactgccaatttagggaactcatactctcatcttctctcacctgaattctttgtgtgtgtgtgtgtgtgtgtgtgtgtgtgtgtgtgtgtgtttttcttccagctattcttgtattccttataacccatcagttctcaaactctttggtcttaagatctcttcacatttttaaaaattaagagccccaaagagcttttgtttatataggttatatctagaaatgtttactgtattagaagttaaaactgagaaatttaaaaaatgtttattaattcatttactacaataaactaatcattattaaaattatatttttataaagatattttttctacaaaaaattacttttctacaaaaaaatttagaggagtggtattgttttaatttctgacttaatataaaatatttggattcttacatctttcatgcattaagcctattgcaatatattgttttagttgaagtatataaagaaaattaagcaaatacaggtatatgcttagaaaagggagaactaccttaatagttttctcaaataattgtgatattctttgatactagatcagaattgacaaacagtaggttcttaaaagctactttcggtatgcaatctgaaatcgtatcattgaactttttgtactctgtctcactctgtcatccaggctggagtgcggtggcacaatctcggcccactgcaacctctaccacccaggttcaaggcattcttgtgcctcagcctcccaagtagctgagattacaggcgtgcgtcaccatgcccagctaatttttgtatttttaatagagatggggtttctccatgttggccaggctggtcttgaactcctgatctcaggtgatcctcccgcctcagcctcccagagtgctgtgattactgatgtgagccattgtgctgggtctggtctatctcatatatatatatttttttgaaacggagtcttgctctgtcacccaggctggagtgcagtggtgcagtcttggctcactgccacccccaccttctggattcaagtgattctcctcctgcctcagcctccccagtaactgggattacagatgtgcaccaccacacctggataatttttgtatttttagtagagacaggatttcaccatgttggccagcctggtcttgaactcctgacctagtgatccgcccgcctcagcttcccaaagtgctgggattacaggcgtgagccactgcacccagcctatcatactttcaatgaatcttttactcatgcataattttgtaaaatcctacattggtcatttggaaaatattgattcactgagtaatacaactcttccaaatgttgaatgtttcattctacaatatcagaaactcaaatttgttaatgttactactagtctcatcagaaatgtctttaagtatttgttaactggcaaactcatagtgacgactacaggctttccagaattttcattttcatttgaagtctgaattttatcaactataaatactgtcagttgtttcccttgagaagcaggttctaagaaaataaccccaagttctgaataaccattatttgtcagtcattcttttaagtaaagtgttgtttcctgaaaaaagcagtttagctcacaacataaaataactgtacaagtgatttttctcaagacaggcatcacatcacatacacagaagtattatgtgtttgcttcccattttgtcacacagaattttaaaaaggtgtgtactcagagtatggcagtgaagactataatgactcctgattcattctggcaccaatgccttggtttgtgctaaggcaccatcagtgcagatgtcaacacagtaaaaaggcaagtaacatcttaccattactatgaaaatagttttgatcacacagacaccctgaaaaggtctcctcaaggttttgcagaccgcactttgagaaccactttgtctagcccatgttgcagattcttgctcaaagtaaattaaatagctccttggtttttaaactttgtgatgtggcatacatggactttacagtctgtctctgaagattacttgtacagtcccatcagctatactttttcaccccacagtccagctgccagcctcgccagaatccccttattatttgaaatttattgttgtattcactcaatgtattctgtgcctgaaatgcatctctggagtcaacatgggtaccctttccttctttaaagcccttccctgatgtgcagtgttacctgtggtgtcctcttcgctctctcaggcctcctgttatactcttctccttccccacactggaacagacccagtggaattgcagtgtatctcatgtgcctcactaagtactgcactgggagctctgccgcctcctgccagtgactctgcttcagccatgttttcatgcacagtgacttgtcacatttctcacacatggcagacatttataatgtctgatgtgtgttgagtgtctcaaaagaaaaagggacacaggaagaacttcagcaaggttgatatctagttagttgacagttttttgttaagtattgcttcagcgagctctacataaggggatacagtatttacttcatttattattttctctccttcagggcactgacaaccttaaataggtcactttaaaaaaaataactatttcctatttacataataaatacatttgaagatttaagttttgtaagttgaggttgaaaagctgatttaatcactgtggcaggagttgcagctaaaaattaggtgaagaataggaaggtcctcattgataacccattaaaatgagtatttaggactgaaccaagagaggtgattcatctttctgtctgtatagaatttggataattgactcagtaatgaaatggaaccaatcaaaagctgctgctgctgctgctttttttttttttttaagttggagcctcgctctgttgctcaggctggagtgcaatgctgcaatctcggctcattgcaacctctgcctcccgggttcaagcaattctcctgcctcagcctcccaagtagctaggattacaggcacctgccaccactcccagctaatttttgtatttttagtagagatgaggtttcaccatgttggtcaggctgttcttgaactcctgacctcaggtgatccacccacctcggcctcccaaaatgctgggattacaggcatgaactgctgcacccagccttcaaagcttctttaggttcatcagaatgagagttagatgcatagagccattagaattcagacccaggaaaaccctacttatatgaaagaaagattaggaagatttgggaagttcttcttaacaataaaccatatgctaagctcttgaataccactgatgtttactgtaacatcttcatagggcagtcagaagagagatgttaataatctatagatggctagttggagggacaacttacatgtttcctgctcagtgctgcactaagagctcatgggtgcccctggtaataatttatgctcttaatccccatggattacctaatttcctagataaactattcccgacagtcagcgctttgcagggcttctgagccattaaacacacacatacatcccgttattttttgagaaattatcagaatgctttcatgaaacttcgtctcgaataatttaccattttgtggagaggatatttaaaagtttcactgggaacaattgtagaacattcatataaattccagagggagatatttgcacacttagaaagggtcttttgcagggacatggatggagctggaagccattatcctcagcaaactaacacaggaacagaaaaccaaacactgcatgttctcacttataagggggagctgaacaatgagaacatgtggatgcagggagggaaacaacacacactggggcctgttgtggggtgaggtgggaggtgggaaagcatcaggataaatagctgatgcattgctgggcttaatacctgggttgatggattgataggtgcagcaaacaaacatggcacatgtttacctatgtaacaaacctcccgagtcatgcacatgtagcccggaacttaaaataaaattgttttaaaaaggtactgggatataagcttataaataattgtgaacaaataatataaaaatcaatatgtatttagacatatctcaaggatggataattttatggaacccacccaaacttccatttatattttaaaaaagcattcagtcttcaagcttatcaagttgtgtactttaaatatacataactttttgtatttctgtcatgcctcaataaagtggattaaaatttttaaaacagcattaagggtagacagaatatcctccatttaatgataaatttctgatagatctcatgtatttataaggtctaactactagtaccatttgtttgtagtgggcagagtggatgccctttagtgcatatctgtgtgtcagatatttgtggtttattttacatttttaaataaaggagcttctgaatctagattttctgcactggtttgatctacttttttttttttttttttttttttttgttgagatgtagtcttgctctgtcacccaggctggagtgcagtggcatgatcttggctcactgcaacctccgcctctagggttcaaacaattctcctgcctcagcctcctgagttgttgggattacaagtacccaccaccacgcccagctgatttttgtatttttagtagagaaggggtttcaccatgttggccaggctagtcttgaacacctgacctcaggtggtccgcccacctcagcctcccaaagtgctgggattacaggcatgagccacagtgcccagcctaggtttgatttacccttgagcataggttcctttacctgaaagatccttttcagatatgcatatttatttacacagaagccatttgttgaatgctaagaaatccaaagaaacaggagatgtcttgttccacgagacttgtacaacaggcccctacttaactgtgataattgatggatgagtgctaacacagttctaatggagtcagaggcaagataggccagttttttgactgaggtgtttggtggaggcatcatgggggtgactacagttgaagagatcttaaagacttttccggttttgcctagactgggaagaacatcatggcagggtcaaggacatggaggcagccaggtgtaaaataatctgagaacagtaagttgacttgtgtgactgaagtagaagaatcttgcaaggaaaggtgagagaaaaggccagagaagtggtcatggtgcaaggcttctttcccaggatcacctctcagagctagatgctctttaccccaatgggtcacactagtatttcagccttctgggtggggattgtttcggggacattttaagttcaatccaaattaggcacttggggattggccaggaaaaatctataaatatctgtcgtttcttctttccctttgcctcagatgaagaggcttttttctttttttctttttttttttttgagacttaactcttccatctgtgttcctagttctatcttggcttttaaagaagtacttctttgtaaaacagcttcagatacttagtagttcctttattcttagtttttgaggtagctccctaccttctccagttatcagataatcagaagacttcacttttccctctgctttcctttgtcatggtacaaaatagatccagaggggatatggtagtctgattgaaaggaaaagtgttttgttctttccattctgacttgagtcagaatttaccatagttacttggttttattttatatgcacccttgtaggctgacttaaatacctccttttaaaaaataagacaaaaatgtaacatacattaattcatttattgctcacacctttttttttaaccatttgcctttatttttatccccattttgtaggtgagaaactgaggaacagaaaggttttaaaacttgcgtaaggcagcctagctccagagttcatgcttttaaccacgatgctagcttaatagagtcactaagctactcatttgtcccttcatttcctttgatgtttcctgtatgagacatctctgctagtatgtatttaagtaaaggagcattctccactctttaaacatatttttgtgataacccttccaaagcaaatgttcacagtgtaatctaaggtaaacagttacattgtactttcttaaaaatttccagaacattaaaatatgtgttctagttaagtaaaattctcaaaatacaagctccagataatagtctctgaatgaacagaagcaagtttattgctttgaatatgagtgaatgccaaaattaacctggcagtagtgttgacaaataggctttttcatgaagaacttctttcttttcccctttgctttgtttttttggacaattgataaaaagagcaagttgtacctctgcattttttggagcgcatgactgtacaatggtgtatatttgcctggagggatgagggaagtcttccatgggaagctgagtcattttttggcttgtctgactgtgtgactgtgctagagctattctttttttgaagagaaaaataagaagtcaagtaatttcctaaagtaatacatttttattttatgtgggattcatattttccttgggttgtggttattttgagcaggagtttttgtgtctggccaggagtattcttctaatacagaaactacttcagacaaaattattttctctccttgtttaataactaaatttggtcagccattggaagtcttagggttgtgattgtggtggtaaacgaagacattattagttattcatctcaccttggatgtatcataccatttttggcactctggagaaatttaagaaatggctgttgcctttaaggcaattattatttgcttagaatcagaccaacatgcagtagcaatgaacaacacagggcaggacaccatagagtcagcaaggcagagtctaagccccatagtggttcaaaggagagcgttttaaggagggttagagtaggcagagagagctgaattgggaaagtagaattaaaggatggactttgactaaggtggataggcgagagagggaattccagaaaccatgattgttctgagagccgggggccttgaagtaggaagaaccatattctgattgtggaaccttgatacacaattaggctttatcttgaagaacaatagaaaatgagattggttaagggtcatggagtagtctgaaatccagacaagggagattagactggatgaagctaaagacttttgtactgcctttctgaatgacagcctaagtcatatcacttctttgttcaaacatcttcactggctccctattgcccctgaatagagtcttaaactctttagcataacacatacacttttttcatttttaattgacacatagttgtacgtatttatggagtacagtgtgatattttggtacatgtatacaatgtgtaatgatcaaattaggataattagcatatctgtcacctcaaacgttaattatttcttaatgatgaaaacattcaaaatcctctcttcccgctagtttgaaatatacaatatattattgctaactatagtcacccttcggtgtgatggaatactacatttgttcctcttatgactctttacccattgaccaacctctccccattctcttctccccatccttgtcccagcctctagtaaccactgttgtactctttatttctgtgaaatcaacttatttagattccacattatcagtgagatcttatggtggttgtctttctgtgcttggtttatttcatttaacgtagtgtcctctaggctcatccatcttgccataaataacaggatttcattattttttacagctgaataatattctgttgtgtatatgtaccacattttctttatccattcatctgtcgatggacacttaacttggttctgtaccttggctattgcaaacagtatactaaacatgagagtgaatactgatttcctgtcctttggatatatacccagtagtgggattcctagatcatacggtggttttcttcttgcatcatctgtttgtataacctatgctgttaatgcttttcctacctgatgtcatagcagtcccttgcatgaatctgatgcatgtaaccagacattgtgctattcctctgtcatacctggcattcattaacatctttaccttcactcacactcttcatatgcaacacccacctcctctcttccattttctctgtttccttccgtttattttaaaacagcatcttttctttcttatcacttcagccagagatcctcttccttttgctgaaattctgcttttcatctgtactacctacccaagctgtcttgtgtttgtgtttcatacagttgctcctgctgtattttctttgaggactcaaaaatgttttatgtatttgtatatctctcataacaccttacagggcaactcacctaaaacagacacttaaatatttgctgaatgggtaaagaaatttggctaatattcattagtttgctactaattgaccgtggcatgctgatgacaacgagatcccattacagaattatggtcagtaaatgtcagcattgtttccttttacctcattgcctttgttttttatggaatgaagtttgttcttatttccatagatgatcatatggaaaaggagtttctcacttgttgcctcttcccttctttttccatttcctttccaaaacacttgtccaccctgcctctctccttcagctatatgaaacctttgttcatattcctgaccaagacagcagtacgtgtattcaagtgttctattttggtttctatggcaggatctctttgacacaatcaaaagtatacaaaaggatagtcgtgatgcatggaactcacttcttggtaatggtccctttttctctgtcagtgttttgttttcttcttaaagttcttaacaatctaaattatttattgtcaggttagtaatcttatagcaaccattatataaggattcacttaaggcattttctctaaaggaaaaaaatgtcttaagagaaaactctgaagagttagtatacagatagagcttaagggccgggcgtggtggctcaggcctgtaatcccagcacttcgggaggccgaggtgggtggatcacctgaggtcaggagatcaagaccagcctggctaacatggtgaaactcccccgtctctactaaaaataaaaaaattagccgggcgtggtggcaggcgcttgtaatcccagctacttgggaggctgaggcaggagaatcactagaacccgggaggcagaggttgcagtgagtcgacatcgcgccactgcgctccagcctgggcaacaagagcgaaactccacccccccactcccctcccccaaaaaaccttaagttttcccctgtgaaatagtagaatatttaaatccagttttcatcagtctacaactacgccagaactaccctcaccaagatctatgaaatatttgcctagcaaaatccggatcttgtatttgcatgacgtttttacagcatttcgcactgtttactatcctttctttgaaatactttctccatttagtttccttgatgccacttctgtgtgttaattcccaaatctgaatgcccaacctcagccattcccctgagttccagtcacacactttcaactgcctaccatggctctgctcagatatctctgagataccatgtctcagattcactgtgtctaaaagtgaattcatcatctgatctctcccctgccacctacttctgctgcattccgccctttacctagttgttcaggacagaaacctagtccatcgtcacacttcttttacttctgctcccaccccaatgcccaatatcctgttaatgttaaatatttttggactctcggtttcttttcttgagctctgctttcagcagctgagttcacactgccatcatttctcacctgacttctctaacagctttctgactcatctgtctctaagcttgctcccttctgtcttttgagcgtattccagaaaaatatatttttgaaatacagatgcgatcctgcctttcccttgctaacaactcttcgattgcttttcctattgtagcgacaatacacttgtgaacacaagtaacatgttcagctggggctggcctcatcctttgtctctgtgctctttcttccctctgggccttatgcagtcttctgcctgaacgtagacacaggtcagtctctctagctttccttgcctgcctccctacagcaccatccacacatatacaccctttgcctggttaattcctattaagtcttccatcaagtctcagattagtaatatactgtaagggccagtctcaaacatgattgtaattatttaatatccattttgttcactgccgtatcctcgatgccaagcgtacatgtttaataaatagttgcctaatgattaaactttactgaaaagcttattgaagatttagggcagtgacatggagttgtactatacagtcccaataatgtcacagattttccatgtgaaatttcctggttgttgttgaaattgttagttactctatttgccatgtttagtgttcttggccctcaggttttaaaagttctaatgtatcttaaaaacatgttaggaaaatttgacaatacatgaaacatttattatgctttgaataggtgcagtttattatgtgtaaattatactttagtaaacctgtttaaaaattacctcataataaatacttttcaagatctagattaccatctgaaatagattttttttactggtggttttgtctgaatcacatacgcattttgcacttgtatatataccaactatttgggtgggaaaaatagcataaggttgtgaattcatttgaattgactatttgatggtatagttatcatgtttaagtagatcaagcgtggtggctcacacctgtaaatcccagcagtttgggaggccgaggcgggtggatcatttgaggtcaggagttcaagaccagccaggtcaacatggtgaaacaccgtctctactaaaaatacaagaattagctgggtagtagtgacacgtgcctataatccccagatactcaggaggctgaggcaggagaatcacttgagcctgggaggcgaaggttgtggtgagccaagattgtaccactgcactccagtctgggcaacagagtgagaccctgtctcacaaaaaaaaaagaaaaaaagaaagaaaaagtaaatgtggagagaacatattcttcttaccttaatgccttaaaagggatgctattatttatagtaattttactcaaaaatttgcacttacgggcttcatgaaattggtaagatttctacatgtgagaagaagttcttgtgtcattgtactattatgaagtagcttttgtttttgtttttgtcagtgctggactgtcttatgttcttgtggtcatgctaaaaagaaatgttgttagaagattcaaaactatgagtaaatatggcttatagttttatcaaatacaacagtctttaggatctggttttaaatagacaacataaatggttatcaaacagtacactgcatgagtagtgtctcatttcccttttggatagcattatttgataggttgaataggagaatgccatacatttagtatgtattaatttcaggaagaagttttattaattattctgtattgtatagaagatggaggtatgggactcagaattcagttggctttgtagctgatagaccagcattttacttaatcttaggagtgctggggccgggtgcggtggctcacgcctgtaatcccagcactttgggagtccaaggcgggtggatcacgaggtcaggagatcgagaccatcctggctaacacggtgaaaccccgtctctactaaaaatgtagaaaattagctgggcgtggtggcgggcgcctgtagtcccagctactcaggaggctgaggcaggagaatggcatgaaccccggaggcggagcttgcagtgagccgagatctcaccactgcactccagcctgggcaacagagccagactccgtctaaaaaaaaaaaaatatatatatatatatatatattaggagtgctgattgatggacagatgtcctaccaggggaggcttttagtgatttaattctgggttccatcattagccttgctcttcagatttatgaatgatacagagtttggagaaacagctgttacttcagtgatggaatttaggttcactatactctcttaaggctaaaatgataactttaaaacaaatgagaatttatttgagagaatatatctatacagaaagctataaagtaggttttaaaacaaaatcacaagattatagtttaaaggagacctgatactgtaagtcacactgaaagaaaatatatgggaagtaagtttatttcacaataaacttattcttctagcggtgtaatatgtgtgtcaagaaaaccaatttgatcttagttatcccagtgtgcaccatgtcagaggattttgtttggggcatccacatcacaagaagtacactaactagagagcactcaggtattctgttgtctgaggagccgttgtgggaatcatgattcgaaagagaagcctgaagagggtggtgaagcacgacggccatctttaaatatctgaaatgctgccaaaagaaataatgaatgtttgctccaaagagaaaagccagatcagtgtatctgttcattttcaggaagacttgggtagcaatatccagagatcttttagtctgtatgtttggtttgttcattctatttttgtaagatattactatagagagaaacttttaaaaagtggaatgtcaaatattgaaatgttggcagagaagttgagtccgtttaatgtaaaattaagaatcacttggcatttttattttttaaaaaacatctttttctgtcctttagcatttatgtaaaatcaaatgtagggatattgattatgagtaatgaatcccaagttttctttcctcaaatactaacttttctctgttatagtttcatttcttgggggatttatcaagtggcaaaattagatgtagtggaaagactgatttacacaactgagtttaaagcaaatctgttttattagctgtgtgatgttatataactgacttaaattctaagtgctacttttcctcatctgtaaaatagacagtaaaatttcaccttacaggtttttatgaggaatcaatgaaattgtacctgtggaagcacctggcaaacaggaggtattcagtaaatgttgtggttaataaatcttgctccagaagacttgtcctcaagattaaactatcctgtcactttttcccaactgaaattttgattctgccatctccctttcttccttcctccctccttttatttcacaaagctgttggtaattttagtagaatttaacatttgtgtgtatgatccatgagaccttgttcctgtaaagagcacaagtttacgaagatacttttttcttatattgttccatattagtttgttgttattttaattgttgctattattgtcagttagctgctgccagttaaattgtcttaagttttcttcttgcaaagatagtaaagggttaaggaaaggagctgttggctactgcttgctactaatttgaaaagaaatggtggttatagccttctaggtctctccttctcctttacccttttactgtcttgtaatcttcaaatctgtatgttagtgaatgctaggagggaacagtagacctgcttctcctggagccatagtacaaggaaagcctaattggagacgatcctttgcagccattgtaaagtattttcttctttcacctctcaaatattcatttgtcttatttgaagcagtctattatctaagcagacaggagttgctcaagtggaggctaaatgttttatctgtattctaatacattttaccaccaacatatgtgtaactctggatggatcactatatttaagtttagattaatgaaaattgttgactgtggtaaacttttccttccttcccatttcatgtgaagaacaaaggtagaaagtgtcattatgcaggaataatgttttctgcaagttttaagagaatgtctcaattcctttttctttctcctctgaaactaccgtatcccatgaactatatggcatgtgataacttcctagtctcagactggcagtatataatattagagcaagaaggatcttcagatatgacctagcgttgaatctctaatttttccattctggaaatcttggtccagagggtcaaactagtatctcccaagttgctcagtgagataatggcacacctaggaagacaaagaacccttgattttcacttagtaccttgtgttctctgcagagagtaaaattgatcattgatgagtcattaaccagtgtccattcacatgctgctactttatgttcactttggggtttcaggaaaaaatacatagtagcagaagatgagccctacccctatccccacacccccacaaaaatattcactggcctttggtgttctgtttgggtcttcagcatcccccactaggtggtgtcctaattcagaaactttgctgtgagactccagatgggcttctgccctaactggaactaaagcagccacagtgttgacccataagaatgcttaaacaatttggtaaggtgctagatcttgtagttaagtaaatcaaatgaaaatttaattcatgaacacaaatgctatagctaaattaagatgtataaaatatttttatatttcattttctggaatctttaataattgcatgttggccctgtggcatgagacagattaaaagcactggttgtttttaaagaatctgggaccatttgtgtggatagagggcaggatggaggctgcagaaagaaaggaaagacaattaatactgtaagtaactactgttaagtagtatggctgtaaataataaaatattttactacaggttccccaaattaaaagaaaagggaaataaactcagaacctcctttaaatttgtaactctcagctctggtttagatatgaaatgattggttgctgtatttcaaaatcctggcagaattactgttcaatggttccagatgtttttgataaaaacttggaattgtcacatcaactgcaaaagcacaagactgcagattctgtcttctgttggggagtgctgagcagatccagaggggaaagcaacacagactcttttttccacccagagcatttgtttcccacccagggtatttgtcctccaacaaggaacagaatatgtaaggaattgtcctttaatatgcagaaagagcaggaaatctagctttccagcctgtggcacaaagccagaagttagaaataaaaaggttagtctttatgtctcaaacagtaatctaggctctttcagaaaattatattattttgaaacaagtttctctctcctaaaaacttcctgaagacagacaccttgttacctatttattttgcttgcctccactagaagtcacaaaatatctgttacattgttataaattatctgcatgtaagtcactggacagggatagggtagaaaagcttttttgttgttgttgttgtttttgttttttgttttttgaggcggagtcttgctctgttgccaggctcgagtgcagtggcgcgatcttggctcactgcaacctccgcctccgaggttcaaacgattctcctgcctcagcctcctgaatagttgggactacaggcatgtgccaacatgcctggctaatttttgtatttttagtagagatgggggtttcgccatgttggccacgatctggatctcttgacctcatgatctgcttgccttggcctcccaaagtgttgggattacaggcgtgagccaccgcgcccagccggtaggagggttttaatggtgattaaaccatctctgatccctagagagacagatgcctgggaaccttggaagcaggaatcatttgattctaattaaaacagaagggagtggcagtgaggaacaaaccatattgaggacagaggggaggcagctctgtgttcaaaaaaagaagaagggcgagttctacattctagcttggtgaaagcttttacagaaaagataataaagtatcagtttatctatacattcaagcctaaaggctctttctgtctgtgccctagaccacatagtttggaagtatttgtaaatctctggtcaagttcccatgcttttgataagcctgagcaagaattttatttacaacttttaaatctctgtcaaatcgtcttgtttctactgttttgtagcctcatttgtaatgaaaagcaacatctgtttcactgcacatgttggtaccactacagagccaaggctcacttggggcacgagaaggggaggggttgtccgccttcattcctcggatgaaccagtgaggaatagggagataaaaccttatggcttttatttcagaataaagcctgtatgtagctggggtgtattaatagaaagttgaggaagacgtttacagtcttcttagcagggtttgctgtatttccctcctttaagctggtcagcaacttgaatatctggcctgaggacacagcaactcatctataccctttttctatatccgttttttagctcctgaaaaaccttttcaccaactttgtttgcaatgtcaacagaaatgtaggtgttaaatctctcctctccccttctgttgtggtatttgagccactgctttcacagcctagctaaggactactctggacaactcaaggaaaatgtcagcagctcctagaaagagaaatccttttttttttttaatccctttttcttttgtttcttcactcctttctgctttttgcttccctcagttcctcatccttttccctcccaaatcattcatgatccaagtaagagaatgtctcaggtgagagaatgcattctgaagtaagtctgtccctgagaatgttagatagagtggggggctagaagggtctggaatagtaagaaaacaggcaaatgaagtagcagacccacaattcaagacccagttagtgtgcatagaaacactgaagaagtcccagccaggcagctatacttagtcgcaacaaatattaacatacacagaactcctttgttccactccttttctttttcattttctttaaatcaactccatcatcccttctccctccccaaaaataaagcttaactcttgataatttttaaactttatcagacacatttatagccacgtctcgatcctagagacataactgcaatatttggctgacatttttctcgtgttaaatcattgctttgcatttggcagggaggtatagtgtatgctttgggtagtttcaattttctgtacctcacgacaagtccattgtacacgcttgtggtgtttagtataacaccccccttcctttattagcatactactctgacatcaaagaactgagctgcatcttgcaatgcctgacagagcctttttcataggggtgggaggaggaggaggaggaagaagaagcgggttggaaaaggaagccttgtttttctcttcgtctcggtagatgaatcatgttcccacaactgcaattgggttttcaaacctccaaggctgcgggtgcggagctgaaagggcaagcagtgacgttcttgagagagaaggaaaaagggaggaggaggctggctagggagggaaggagggagggagggagtacagcaggagtggtcttttatttttttcccttttactctgctgtccttagagattttcaacttaaatcaaaaccaagccctactgcctggtgagcaagagagattccaaagactttactttgaaaagcatctcccagcttctacttttttttaaggaaaagtagattttctttgtctttgtttttgttttaagcaagaacagaatctaatgacttttttcatgccatcgctttgaaatagcgtcgtcttcctttctttctctccctcttcctggcaaagtatatactggatttttattgccttcttgggtttttttccctacgtgtatcggccgttatgcttagccagtttattctttatttttttactggagtcattgccagtgatggaaacggtgtttgcttctctttcagtcaagatctgcacaaagtatagcattaggtggtatttattgtttatattatgagttctacattcatctttccagcactctgaagttatcagcaagttctcagtcagttcaaggcattggattctgcttgatttctttttaattcattgtttttgacccctttgagagttttaatagagaggagtctggaaggcagagatctccaccacctaaccgtgagaaatttggaactaaggacttgcactggtccccaagttaacagtggatatacttcctgcattttctctgttctttcttgcatttgggcaaaatgtatgaacggcacaagaggcgctacagcctctgtgacatctccaaggtggacaggactgtggacgtggtattgctgaaggtaaggggggctgcacctcatgcattctgaagctctgcaggctgttttagcgctttgaacccggtagccatgtccctggccctcctgtattgggagaaaggccgagaaatctgtgcacagtggaggatgaggggtgaatgtaagcctcttaaaggaatatctgaacaggaagcaataggtgcttggtaatcagcattggaccacttactgttgaaatgtaattttactttcattaaaatggattcttatgcttgggagaacctcatactgttgaaaatcacagagagagaaattcaccttccaagttgctctgtttgtccttctgtctctgtcacccctccgcccccagactccacccccatctgcctggtctctttctctgtcagtctctctgcctctgtcttttaagtatttctgtcttttgtctgagtcttttctgtttttctgctactgtctcgttcaattctttaggggaaggataggcaacatttatttcttttggaaggatttccaataaacctatctattaaggtggcagagctgaccttttggcttggtttgactgcttttcagaggtagcttctgactttgttgatagctgtatttgtttgtgttctccgcattagtgatgtttggtgtctaagcaggatgagggcggagactctgaatagctaattgctcacagaaggcatccttgaatctaaaattagtaagaactcctccagccggtaagatgagagtctgggaatgttggacagctcaaagagcactttttggaaatttagcaattttctggcaaaggcaggggaaattggaagtcaaccaagcatttcatagatgacagaaagaacctcagtaactgaacttgtgagggtgtatgtggaggtgagggtcattttaagcaaagtggaaatatattgccttggtcaaggaaatagtggacctattttattgatttatcaattcagtttattacttgggtcttttcgatttttttctttggtcaagtgaggctaaggaatgggctcagaaggctagacacaaaaaccaatgaaatgccatgttgggcagggcactaggtagaggcgttgtgatttgtggtagagtgttgtcattgtctctccataatcactgtcaggtggttgacttgctgggcctcggctgccagcagttggtaacttggtgttttgaaattgttccaagatattattcattttggtttctcagaaatgtgattttctctgtgagatcacggtgatgttttaaaatttttgtcctcatataatgtatttaggagaatctcatttttaggatctttatgtccatgataccctatgattttgcctgcgggtggggagaaggataaaaagaaaatctgagtatcacaagaaatattgaacatttaaaataatgctaaaatatataatactttatactctaggtgggcatggaaagcccttgtgaatggagctaaatcagtacaggcttattggcctcagagttgctgttttatagttttaatgaagcacttccatatacgttacttaatttgagacttgccaggcagttactttttaccccatattcatatgaagagcccgagggttttctcgagcatggtaaggggtatgaagaatttgagtgacaagaatgtggttttttgtttttttgttttccccacaaacctacagctaataaaggtgtttgtctttgtgtatttgtactatcctgcccaataaataataaaagattttcagtggagaaaacttcacttctcagaaaatagtcattagtaaataaacactaggagtcctgaaaacaccctgtttccagtttgaaataagatggggacgtttggtgttagtttctttgctttggagatggagaagaccacatctttgagaactataaactcaaagaaacctaagtacctatcccatgcgagccacgggttacagtctttatcccattattgcttaaaggtagacaataaatagagaaataaataagtacaaactgttataattgatttgaaagaaatgagtagggtgctgtgtagggaataatgggcagaactatttcagatagaatggtctttagacagaagatcttttcgaggtgcagacatttaaaaagctgatctccagaggatggaaagacactagctatgctaaggaagagctctctagaaagaatgaacagtgaatacagggccctgaggaaggaaggaatggacagggccattgtggtggatgggagcaccttgagtggaaagtggggtagcaggatgagaaggccggagccagaggtgggacctggaagagcagggccttaacagctatggggaggatgccttacctctcagtgtacgtgttgaaaagattattctggtagtaatcggttagcctgccgttatgatagcacaggcaggataagaggattttgtggtctgaagtgggaagaagtgaatggatatgagacacaggcatatagtgtttacattcctactctttgtctcattttacgtacaggaaaacagattggtgtagttaataactttcccagtgtctcacatctcatatgtaattgataatagagtgcagtcccaggttggactgttttcaaagtccatgtttttcctgctattctagacctcttttttgagtcgataaattcctcttattacatgaatatgtatattagcttttattgatataagcgtatgtgttctttttctatcttagacttttgttctcttctttctcagtgcaggaattccttctacaatacttaggataggtacaccatgtcatataagttcattttgtcccatgatttttagcaaagttttctcacaattctaaaaaaccatttggtagtgttctccaattatttctacaaaattatttctaatttcagtattttctatcagtgttttaaaaactatagttgggtgcctgtgccacataaattctcaagccgtcatgtgcactttctccacttttatctgtggaaatttgcttttttgtactaaggagtttgtcatttttatctgttcattaatattatctaaacactcaaaacaacgtttgttggttaaatgaatttatctttgtaagtatggattcataagcatcatgttatataaattgtgtttaacagatgaggtgaaatatggcagtaattacagagtttaaattgtgagcctgtcactttggtattccacatttaacaactccaatccctcccattgacatcctaataattcactgtagattagcttcagcattctcattctgtgttatatacccacgctttatttggctgcttctgcattctgccctgcttcctttgttagttctgcatagtttcacggtagcttttctgtatcaagaccttcttgtaagatttccctgaggctgggtacgctagtgtcatcctcacatcagctcttctgtcccatcatcaacccccaatgcctctgaaatattacctctattctgaactttttctaagtaataaaacctaagttgatagtattccttggtcacccacctgtctgttctccagcgtaacatacacatacccattcctgttcctctgtatatgacattcccccagttctccttttcttgatgcatgcacttctgactcttacagtatgtggttggtaactatgaatcatatgctaaaaatgggatatgaaagaattgtaattgttggcatgggccctttggtaccaatatgcccattttcctcagcatccttcaaaaagctagtgttgacctcggaagttggtaactgatgggagctttcacctaactgagttcagtagccaactttagctcatggtgagcattactagaggacagcaggtatcagaaactgactgtaaaattagtgtaccaaaaggaagcaggtcagaatcaaggattaactgctgatttgcactgcttttagcctgggccattgctgttttactaattttataactttgggtacctggaaaaatactgcctgttaatagtaatgtgattcttcttgttactgatgatttatagagagtattttataggcagtaattcagaacattaattagctgaatggttaaaagatttgcaactgtgttttgtttacattgaatgaaaatatttacagagcaggacgattcccccccgactcacgacacttgggcaggccacacgagctcattggctaaggctgaggaggaatagtctgtctctaattatggtgtcattttgcagagaaacacacattccctaaaagtttgcttactgtaagagatgtccgcattgcaacaaaacaaaagacataaggaggctctggattgaagacaaccacatatatagccactcagatactgtccaattccctgaaaagactttgactcaagtgttggcttctatgtccggatggtgggtttttgcttccttttgttcagccttgtagctcaggcaggatctcctgagacagttgcagaggaagtaaatatggttagtggctgggaaggctgggtgtaaccatgagctgtattattaggatgttcagatacgaacagtaacagaaacactgccagaaacaaagacaattccctctccactgaaaatatgtacagctctatttctgactgatgggaacacattgtgggtgtggtttagggataatcacaaggggtccataggcttcatgtcagaaatttcagagtaacctggataggtctggcatttcttctgaggtaacttccattatcccatatttcatgtgcaccataattcaccagaagtttggatgttgaatacctgcggtgtccatgaactggttgtcatggagataatatggacaaaggaaaaccaatgactatgttttgtagctaaagtgtcataaatgtgattagagccaaaatgtatgttttggtgacttgtctctctaaaagatgtagatgtttaatggtaaaatctctgttttccacatttccagctacttgcttctctacatcacccattcactttcctacccatttagtcagttgccagtcctatactttgttcacagctgaagattccaaaagggtaaatctgaatagaaagatacataatcatcttcatttttctctttaaactcaaattatttgcattgccaacactgatgattttttcctatcccgtctcctaattctgctgatgatcagaatcttttgccaagcctagtctcagaactgactgagaagagtgttgatagtataaggatccaatttatctgttagcgtgaaaacctcagtctttgaatcacgtttggaaaagagactaacatgagaacaggatccctttaatgaaaaaaatgtctggtggcttttgatttcctgcagtgtatgtttcagatgtggccaggcacagtggctcacatcacgcctgtaaccccagcactttgggagattgagacaagaggatcacttgaggccaggagttcaagaccagcctgagcatcctagcaagacccccatcgcttaaaaaacgaagtttcagatgtctttccatgtatgtactcagggcctggcattgtatctggcctgtaggaagcactctgacagtgtttcaaatggagccacatagtgtggcgtttaagttgccttggttgtttgagtgagaaagaaatagtggagttgttgatgaatagaaccaagactagaacaaatgtatctgccacatcaatgattctgaaatagggcagaaggaggggggagatgttttgtaatcaactttacatctcttaagcagcttactttatagtaagcacaatattcttcacacatgaatatgatacgcttggtggtattgctgtttcacaggatgtggttgaaaatgctgatacatgttttgacattctttccacacacagtacatatggagcttgtcctctggttaatgacattgaccatgattggtagtgtctggcccagattactggctctgactctaactgtgtgggctgcctgactacttttctctaaacaagcttgcatatctctaactgctgctcattcatttcttaattgtgataaaaggtacataccataaattttaaccatttttaggtatatagttcagtggcattaagtacattcacattgttatataaccatcccaccagctgtctctccagaactttttcatattcccaaactggaattctttacctgttaaaacactaacttcccattctctttgcttgctagtttggcaactaccgttctattttctgtctctatgaatttgactgctctaggtactaagtggagtcatacaacatttgtccttttgtgactgtcttatttcacttagcataatatcttcaaggttcatccatattatagcatgtgtcagaatttcctttctaaggcaaactaatattcaattgtaagtatataccatattttgtttacccattcatccatcaattgacattgggctgttgcccccatttggctgttgcaaataatgctgttatgagcattggtatacaaatatctgtttgagttcctgcttgcagttctttgcatgtatacccagaagtggaattgctggatcataaggtaattgtatgtttaatttttttttttttgagaaactgtcatactgttttccgcagtgcctgcaccattttacattcccaccagcaatgaacaagaattccaatttcaacacatcctcgccaacacttattttctatctttttttgtttaaatgatggctgtcctgttggatatgaagtgttatttcattgtggttttgatttgcatttccctaatgcacacttacttttgtcctgtttgtgtttgtaagaagccagcaagtatgagctttccaaaccaccccatctgcgaataggtattatttactatgaatgccacctttagtgtgtcttttctttttgcaagctctgcctttgctctcctgcttgctcttttcgtctgttatctcaagaacaaatgaagctagcgccagcctttctctcaagcttccgaaaccttgtgtaaccatttgcaggacatattgttatttcaaactcaacatgggcaaatggagtacatcatcttcttccctctagatttcctatttctgttcattgtggatctttgacctgtttttctctcttacttctgtgaattttgccctttgtactagctctctgatgtataccttttatgtgcttcccagtccaggtatacactacctctagactagactagttcaggctcatcctaattggcttttgtgtctcagatactgtgtgtttccttcctccctactctcccattgtatctgtacacatctagagttattggccaagtatagtactgatctttttactacctttcttatatgattgacagggtccacccttgttagagaacaaagcctagattcattgtagctgtatctcctgttgttcttccttgctcagtttacatttctggatactgttgggctttttgtgttcctgaaaaacatcaaaagcaaaggtctttagcctgggttatgaggttatgcaaagaaccgccgattgtgacgtagtgtgcacgttcctggtgagggttccatggcttcctgcagattcttgaaggagtctgtgacgtgaaaggctatgaagtccagctctggagtgtcctaactgctttgctcatgcttttttcgtatagctagaattccctgccttaccatctttctcttgcaagcatattgtccgcttttaaagcctacctcatataccaacgcttttgttgagcttttcccagattcttgagcaggaattattttcatgctggggactttcttttgtggattttagctatttgtgtacctattgtattacacaaattaatcagtgtttccaaacttataggccatggtttgtggagctgtctcactgaatctgataatccgtagactcataaggatgtatgtatatatctatcatcttgggatgtcaagccttcgtaacccaaggcattttgtgttaaaattatacttataaaccgtggtagctactatgccaattgtaatcagaatcatctttttcaccttcttgtctattgctgtaccttaacctggtttcttgcctaaagtgagcactccataagtgctgctggctagttgtgtggatgagtgtcagtgtgtagctgacagcaagatagtgttaagaagccgccttctgctagatttcccaatcctggtgcagaagccccgaattatcggaaatgttactgttcttcagtatgggttttacttttaaatgtttacgaatgaagcctaattcagaagagagaacctgcccgaaagtgtgcatcatctcagatctgcttgagcttcttgtgttcttagagacagtgagcctcctcaggacatcattgttaattaactgctggtgattaaaaccacaggattctagtaattgacagagccaacaacaaacaaacagcagtttttttttcagttacagcattttgatatttaaaaaaattggtatccagtttcatattttacttgtgtcatttcagtaatgccttattttctaaatatttttgtctaaatcaacaatgactgttttccaataaatctttcttgaagatgtgaaatacactttgccaaacttattcaatttaatactaaaaaattgtaaacaattattattgaattctaagacaaatataagaataagaagagatggcacagtggctcgcggctgcaatcctaatgctttgggaagccgaggtgggaggattgcttgaggcttggagttcaagaccagcctaagcaacattgtgagacccctgcctctccaaaaaaatttttaaaaaacaactgggcatggtggcacatgcctgtagtcctagctacccaggaggctgagacaggaagattgcttgagcccaggagtttgaggctgcagtgaggtatgattgcaccactgtactccagcctggggtgacagcttcttcttctgaaaaggaaggaagtgagggaaggagggaaaatgaaaggagaaagaagaaaaagggaaaagaacaagaagagactcttgagggggaaatttgtggtggactggaagtgaggaaaccttgggtcctctgttttgaaatatttattactttcatcaaattactttgcctcctttggcctcaggttttttatgggtctagtaaagggaagcagggctgtaatcctcagggagtctctccacttttttcttcagaatcactgaggataatgaattcaaagattattcattaggcatccaccatgaaccatgcacttactactcattggggagatccgttaaatagatgcgattttgttctctggaagcttatggtcttttgagcagataaagctataaatacaatatagttcatctacatgtatgctctccacaaatcaccaagcctcactgagtgtgttttcttcctctctaaaatggcaacatgccttctcaggggtatgtaaaaaggtcaaatctatgggatggtactttaaagtatcatgaatctagaaatataatgagttcctttacagcctttttttttttttttttttttttttttttttttgagacagtgtctggctgtgtcacccaggctggagtgcagcagtgctgtcttggctcactgaaacctccacctcccgggctcaagccagcctcccacctcagcctcctgagtagctgggattacaggcgcccacaaccatgtccagctaatttttgtattttttgtggagacagggtttttccatgttgcccaggctggtcttgaactcctgagctcacagttgccaaattcagtaacttctttttgttttgtatctgctttgacttctctgcagcagcttctgtgaagctctaatctcccgagttctctggctcttagacactggtgtgtgccatctctgacttctctattctctgttttttaacacatacacacacacacacacacacacacacacacacacacacacacatcatgaactaagatggaaaattgtaacacacacacacacacacacacacacacacacaaacacaatgaactaagatggaaaattgtaattccggcccagtgtctctgtatatataacatttgtgacccaaccagaaatatacgtagcacgaaaatactctatgcaatgtggtgttccattcactgtcattcccatctctattaattacagcatgcattgtccaagtgaacacacatttcattgtctactatgcaagatgctatggtaggcttattgaccgacctaacattttcacatctcacatgtaagctgtgagttctttgaggacaagctattttactacttctgcttttaaggcttggttggtacagtgtttattatatagaagatacttaacacagtttttaaaaaatagaaggatagaaacatcccagcatggcgagccttacatcttcacacaatcttccttttctagaaagtaacaatagattttaaaatagatttttccattaaaaaaaagaaactcaggatgagcacccatgtcacacctactgtggtagctacaataagaaagataacaaaaataggtgttgacaagaatgtagaaaaattgttgaatggtacagccactttggaaaacagtctgacatctccttaaagtattaaacataaagttaccatgtatgtaacccagcagttccagtcctaggcgtatgcccaggagaattgaaaacatgtccacacaaaaactctgaatgttcatagcagcatcattcgtcacagtcagaaagtgaaaaaaaaaacaaccacccagatttccatcaactgatgcatatagataagtaaaatgtggatatatccatacagtagaatattatttggaaataaaagaagtaaagtactgttacatgcttcaacatgggtgaacctcaaaaacattttgctaagtgaaagaacccagcatgaaagaccaaataatgtgtgactctatttgtatgaaatgtcctgagtaagcaaatttgtagagatagaaatacattcgtggctctctaggcactaggggacaggggatgggggtgaggcatgactactaatggatatagggtttctttttgtcaagataaaaatgtttaaaattacatagtggtgatggttacacaactctatgaatatactagtactattgaattatatacgttaaatgggccagttttctagtatgtgaattacatctcaataaggatgttaaaatgcaaaataacacacacacactttctctctctctctctctctcacacacacacacacacacacacacacacacacacacacacacacacacactaaatgcaatgtggtgatttggatgggatcctggaacagaaagagaacactaatgggaaaacaagtgaaatccaaataaagtccggagtttacttaatagtaatgtaccagtgttggtttcttagtattgacaactgtgttatggttatgtaagatgttaacgttggagaaaccagtgaggaagggagtggggataaacgggaactttctgtgctgtctttgcaaactaaagttatttctactttttatgtatactattttttgtatcagcctgaagttgttacaaaataagtttatcaagataaattttttaaaaataaaagaaatatataaccattgaagaaaatttgggaaactacaggaaagttaaaaggaatataagttgtctctttgtggtcgttcagacatatccacccaattgaaaatagattaggagattgcaccacagaagtgtaacatgtcaagagatttttggctgccactgtgtgtaaaatttttaatactatataatatatactaattgttaatgtggtggatcggaaattgttccgtacttgcaagctggcaagttaacttacatcctgacacagtttcatgggtgctggctgaagtcatggcattctagggtcagagacaggtaaatgtattactcattgcatagccagcagcatcagcatcaccttctcgttggttctccttgcttcctaagccctatgcaggcaacacgaaggggtccaggttgatgctgtgtcacagctgagaaatctaaacctgaagaaatctgaatttttatacagtggacagtaagcctgtgtgacctttgcccttgactgagacattatctttataatactggacagaaacaaacctgccctttgcttcggaaggaaacagtatttttatcttctaagggtgtttgatatacaaacagtcttgaaaagatagtctagaataaaaggaccatcagggcttttgctgataaaacctgcagaaatgcaagagggacatggagaattgttttccaacatgattatgttctcatcactgttattatgttctcatcactgttactcagaaattagcatatttacttaaagatatgtaactttaattttgttctagtagtatgtgtttattgtatataattttgtaaaatatgaaactcactttatgtaacacatgtacctaaaatgacaggaaaagtatagagagtcttagttgcttgcatattcaaggcaaataatgttcactttactcattggctgtggaatgacatgtggtattgagaaggtaatgaaaagtattctaagaaataaaatttttttttttttgaggcggaatcttgctctgtcgctaggctggagtgctgtggcgtgatcttggctcactgcaacctctgactccatggttcaagcgattctcctgtctcagcctcccaagtagctgggactacaggcatgtgccaccacgcccagataatttttgtattttttcagtagagacagggtttcactatgttggccaggatgatctcgaactcctaaccttgtgatccgcctgcctcggcctcccaaagtgctgggattacaggcatgtgccaccgcgcccggcagaaatagaattttaatagggttttctaaactgttggccccttgttgaaggtcaaggtaagagacagtaatatggtaattcgtagtagttcatttccacattctttacttatcactaaagaatcatctgagctcttttatttctgtaaactaaacttgttgctgtattcatgcagcctcttcttattacaggaataataggggcggggggggagtaattttttcccttccagcttaaaagtgtagttttgtattgcagtacagtggttctattagcagagaatcttatttcacagtaagtaaaatttggctcattgcaaatgaaatgccatttgaaattaagagaaaattctctgaatgactttttttttcttttttttttttttttttttttttttgagacggagtctctctttgtcacccaggctggagtgcagtggcacaatctcggcttactgcaagctgagcctcccgggttcacgccattctcctgcctcagcctcccgagtagctgggactacaggcgcccgccaccacgcctggctaatgtttttgtatttttagtagagacggggtttcactgtgttagccaggatggtctcgatctcctgacctcgtgatctgcccacctcggcctcccaaagtgctgggattacaggtatgagccactgcacccggccttttttttttaaaaaggaaaatgtgttgtttcaattctttgaaagatgtggatagggtgttggtaaagttacaaaatttgtggttacttccttattgtgtataccttaaagtacctttcagaaaggatatttttaaatatgtgtaatcccagggcacctgctgaagattcagttccattcaggattacttttaaatttttggcatcattttgtaacacaccaggaactgaaaccttgatggcccctgattcttgctgtttttgctctctgtaatagtaaaatagctgaacagagcaaatgataaagtgttttgtttcatgtggttctagtttgcctggttatttgcaagcagtttaattcctttcattcattttattgtcagttataatttgacaaaatgtctctagctttctgccttatgccacttagcatatacagtaaaactgttgatctttgtcagcagaagagtttaagattctcactaaagtgatcagaaatatattttagaggttattgaataaaatcaaggcttctgtctttgagcatacaaatattcacaactacttagtagtttgtttagatatttctgctcatattatttagaattacatctaagtatgtcagttttaatgattaaagggttataatgttaaggtgtgtgggaattgtgaagactaaaatttattttatattttatacttctgtttttgagaatgtatttgttttcagctttattctggtataaatttccatacaacaaaattaaccaatataagtttatagtttggtgagccttgacaaatatttaaattgtgtaatcactaccgcatcataataggaacacttctgtcagctcagaagttctgttctgtctccctgtagtcagtcttctccttcattctctgctgatcactaatgttttcttgctactgtaggcttgccttttctagatattgcatggatagaaccatacaatacatagtcttttgagtctggcttttttttttttttaacttaccgtaatactcttgagattcatccatgttgtttgtatcagcagttcatttcttctttctatgaatctataacattgtatggatatattataatttgcttatccatttaccatttgatggcaatctggactgtttctagtttggagctctcatgaattaaagcgctttaaaaattccagtgcaagtctttgtgtgacagtaggttttgattcttcttcggtaaatgaatggaatgctatgttgtatgtaagtatatgtttgacattatgaaaaactgctaaactgctttcccaaaatggctgtactattttgctttctttcagcaacagtactgtgttctagttgctccacatctttgccaacatttggtattatcagtctcaaattttgactcttgtaatggatgtctgctgctatgtccttgtgattttaatttacattttcctgtggattaatgatgttgggtatcttttttttgcttatctgcctttcgtatatctttttaaataaaatgtttattcaaatcttttacccatttaaaaaatcatgttgctttgttactgcattgtaagagtttcttttatttttaaatattccgggtaggagttcttagcagataattgttttataaatattttccttcagtttttagtttacctttttgttttcctaacagtggcttttgaggagtaaaagtttttaaggttgacatagatttatccttttttttcatgttttaaaaaatgtactatttaagaaatctttgtgtaaccgaagttcccataaaagtgtttccctctgtcttctttaggagttttatagttttaggttgaacatttagatatataaagtattctgagttcatttttataggtggtaaggtttggggtaagattttagatcttggggagttgtatttgtttacatattagtatccagtcgttatagcatcatttgttcataagactatttgttcctcattaaaatatcttggcatctttgtcaggaatcaatgggccatatctgtgaaggtctgtttgtggattctctcttctctgccattgatctatatgtctgctgtttaatatcaccccggtttggttagtgcagcttttatagtatgtcttgaaatcatgtagtgatcaatttgaggacaattaacaactgtattgagtcttctgatctcatggaatctctgtatttatttaagtctgcattaatttttctcaacaatgttttataaaggtttcagagtatgagtcttactcatattttcttaaaattatccctaattattttatatttattgaggcttttgtaaatggtattgcttttacttttaatttcaatttctaattgctcattgctagtatgttgactttgtgtctggcaaccttgcttttattaatacattatttattccagtatttttatagattccttaggattttctacataggcagtcacgccatttgtgaataaaccaagttttacttcttcctttccaatggtatgcgttttctttctttttctgctttactgcactggataggacctccagaatattgttgaataaaagtgatgagaatggacatctttggttactgatctcagaatgaaagcatttagtctttcaccaataaatataatgttaaccgtaggttttttatagatgcctttgtcaggttgagtaatttcctttctgttcctagtgttctgagagtttttatcatgaatagatgttgaattttgctgattttttttttttcctttgaggcagattcttgctttgttgtccaggctggtgttcagtggcacaatcacggctcgctgcaacctctgcctcctgggttcaagtgattctcatgcctcaggctccctagtagctgggattacagagacccaccaccacacctggctgatttttgtattttcagtagagatgtggtttcaccatgttggccaggctgatcttgaactcctgacctgaagtgatctgcctgccttggcttcccaaagtgctgggattacaggcatgagccgccgctcccggccccaaattcttttcatctaatgatgatcattagttcgtgagttttttggtcttttaataaactggtttttcaagtgctaaaccaaccttaaattcctgggatggacccatttgctcatgatatatattgctggattccattaacctaaaattttgttaaggttttttgcatctgtattcctgaggaatattgatctatagttttcttatatctgtctggttttgatttcagagtaatgctaggctcataaaatgagctgcattgtaaatacttttcttctgttttctgtaagagcttgtgtagagttgacatttctttcttaaatgtttggtagcattcaccactgaagtcatctaggcctgaagttttccttgtaataaagttttaaactatggactcaattgctttaatagaataaggctatttagattatctatgttttcttgagtgaattttggtagtttgcatagtgtcatggaatgctatttcatccaacttgatgaatttattgcagtaatgttcgtaatatttctttattttttcaatatctataggatctgtaatggtgtcactctgtaattcctgattcctgtcatttgtcgcttttcttttttgattagcctcgccagagttgtattgatattattgacccttttaaggaaccagcttttggtttcattgattttattgttcttctgtattctattttattgatttttgttctttattttctttatcctgcttgctttgggttaatttcctcctctttttctagtttcataaggtagaagtttagatcactgatttgaaaccttatgttctaatataggcatgtaatgttacaaatattgctgttagcactgctttagttatatccacacatttttatatgtggtgttttaatttttattcaatttaaaatattttcttctttttcttaatatttctactttccctgggttatttagaagttttttttttttttttttttaatctctgtcacccaggctggagtgcagtggcgcgatcttcactcactgcaagctttgcctcccgggttcatgccgttctgcctcagcctcctgaccctgagtagctgcgactgcaggcgcctgccaccatgcctggctaatttttttgtattttttttttagtagagacaggatttcaccgtgttagccaggatggtctccatctcctgaccttgtgatccgcccgcctcagcctcctaaagtgctgggattacaggcgtgccacgcccagcctatttagaagtttttaaaatttttttcaaatatttgagtttttccccagtatcttttgttttggatttctgatttaatactgttgtgatcacagagcatactttttattattttaattctcttatatttaagacttgttttgtgctacagtatatgtttgttttatttgaggtttgttttatgtgatacaatatgaacatttgttttatttgaggtttgttttatgtgatagaatatgaacattccaagtgcacttgagaatgtttcttatgctattattgggtggagtgttctatattgtgttagctcagattggttgaggtttttcaagttttctctatcttgctgattttgtttgtgtttatcaattaagagaggagtattgaaatcttcagtggtaattttaaaaatttaaaattcaatcaaagagaattataatattaagagggttgggaggtgtaaaggcaatatttaaattttttttaatttgtggggaagggggaagtatttgctttttagaataacacagacttggcattccagcaccagtcctgctgtttattacttcagcaacccctctgagcctgttttttttttttgagatggcgtcttgctccgcccaggctggagtgcagtggcgcgatctctgctcactgcaacatctgcctcccgggtttaagcaattcttgtgcctcagcctcctgagtagctgggattacaggcgtgcaccaccaccatgcctgggtaaattttgtattttagtagagatggggttttgccacatttgccagacttgtcttgaactcctggcctcaagcagtcctcccacctcagcctcccaaagtgttgggattactggcatgagccacaccaaatatgtattttaatatttagtcaatttcatttgttaacttttttaattttacccttggcctacactatggccttcatcttcgtgtatcttttcttattgcttttgtatgcctaatttttattgacaacctctaaagatccttgagtatagattgctgtggtaatattgtgaaaaaaaaatttttttcccttgacataagtttgctcaccctgtattaaagaaaaagataggaatgttggtcagttgacataattttggcacctgtaaaattatctcacattacttcaatgtctgaaactctgtgttttctttttctttcagataaaccgagaaaactggtgtacaatagagccatgccctgatgcagcatctcttctggcttccaagcagagcccaggtaagctgagattatccattcattttctggagctgcagccccactctggcagatcgttttatttggagatctgcccttccttagcatgttatacagtaaatcagaggaagggatgtatgtgatctgggtttgtaggcattttgtcttacagttgaagatgaacacatgtaattaccgaattttgttttggtagcaacagacatcataggtggctttatgattcattcatttgtgaaggcatctgtgctgtgcatatacatatgacataggatttttaatctggtaaaagtataaatatactgttaaccaaacctgaggttctcaattttgaatgcacattggaattatctggctgaacaagctttaaaaatatactgatgcctgggtcctacctccagatattctgatttaattgggtggggtgtggcctagatatcaaaatctttataagctcctttgattaccctgctgtgtacccaaggttgagaaccattacactttggacacatggtcaggaattaagtctttccttaagtacctttgagttattcctaacaacacttgagggtacgatgctcttaagaccttgcttgttaatgacacagcacatagcttgtgattagttaggattcccaacttttaaaccaggtccagcctctaactctgtgtgatgtaaagtatgttccctaatgtctgtgtgctccgttgtctccctcccatctgtaaagtgttagtagcctgtctcattttgagggtgtagtacagatgacatgatgagtaatccctgtgcctgttctacgactgctaagtgaatactagtaatttgcattctgagtttttttagtctgttttacccagcaagcctctgtttgccttcccaatttttactgcccagctttaaaaattacctagtcttcatttgcaggtctttttagaaatagtttacatgtagataccctccagtagtattaaatttaaaaacaaatggttttgaatcctctaactccagagcagtttcctactgattgtcaactctctaactttactacaaaggaaatattgaaaacaaatatgagaagtgtttttctctatttttgtctcattttttgagagtagttaaggatattatgctatagttgtgttcagggtccaagttttacaagattggccctgttcacagatttagctgacacttcccccatgtagcctcctagaaccttctacttaaacgtgtaccacttactactgtgttttgggtccttaaactgtttggggctttttctaaaagtgtaattaaaaccacccaagagtgagactttctgccaagtaaaggttaaatgaggttggtcacagtttgaatattcataggaaggaaagatctccacacatcatagtttaatttctatatttagagaaataatttttgaacccctggatgttttccccaggacacaattttgaattctgtagacctactgtacaccctaaccccaagcataagcaatttagtctttttagagtaattattgtaaaatctcgatttaacagaattgcagatcagaattatgctactgagcttcagacctgagattttgattttaggcatagtgtttttgtgaatcccaggtactttgttttgcaggtttctgtattttactttatacacacttcctcaagagagcaatagcattagaccaaataagatattgtcttttggccgggcgaggtggctcacgcctgtaatcccaacacttggggaggccgaggcgggcagatcacgagatcaggagttcaagaccagcctggccagtatggtgaaactcccatctctactaaaaatacaaaaattagccgggtgtggtggcacgcctctgtagtcccagatactcgggagactgaggcagaagaatcacttgaacctgggaggcggaggttgcagtgagccaagatcatgccactgcactccagcctgggcgacggagcaagactccatctcaaataaataaataaataaataaataaataaataaataaataaataaataaataaataaataacggagtctcgctctgtcgcccaggctggaatgcagtggcacaatctcggctcactgcaagctccgcctcccaggttcacaccattctcctgcctcagccttctgagtagctgggactacaggtgcctgccaccacacccggctaatttttttgtattttcagtagagatggggtttcaccatattagccaggatggtctcaatctcctgaccttgtgatccatccccctcatccttccaaagtgcttacaaagggattacaggcatgagccaccgtgcctggccaagatactgtcttttaaaatcactttgtatactcttcaataatggataaattacaagatagaattatgattagtgtgacataacagagcccaccggatttcagcagtgtgttttcctgcccttccccaacaacagtttgttggcatatatgttgttttaaacctaaatgactagataacaccttttaaaaagtttgtattatgttagcttctgaaaagctaatagctcagtacacaaaaattacagacagatttacatatgggtcataaaatgggactggccctacctgtgtccacctttaaggtactgtcatctggatacttactgaatcatacattaaaggttaatgaagccttaacttcattagacacatatatcacacacctgctatgtgctggaaaccagagttctggttactgtatgtataaattattcctgtcactatgactcctttagggaagtactaatcatctcttgtcactgttatggaaatggcaactgagaggggtgaaattacttcttgcctggaatttttcttctattaagtagtcagacctagatttaagcctgatcagtctaactaaaaaaccagagctctttactcttgtttacacttagatatgccgctcccctttattcagtaggaaggggacaaataggaagaaagaaaagattttattaattttgaaaacttaccaattcatgtgacacagggtgtggattagctctgcctttagggattccccccacctccccccgccccatggcgttagggggttataatggtttacggtccctctctctccatcttagcccttctttctgtacttttccctctttccctcctcaacagtcagctttatctcacagagcagactctcgtcccaaacttggtttgttatcccttgtggtgctggcttgaatttattttctgggtgaggtattcctcccagggctgaatctggatcttccccatgaattttccattcgaatatcgtgagctagtttgttttccagtctggaatttggacgtggtctgttagagggccagctggacagcgagcagctcagcgtagttgctgtgacagccctttcttttcttggccagcccccatatttttccctcaaccatggaaaggcatttttttattttttcaagcagggaaaggagaaggaatagatcacacccaccaactcctcctaggttactacatactctaggaaacgtgaaaaaaaaaaaacctccagaatacccatagtttccagtctgttaaaggcagggctgttcccattgaactaacacactccaaaatagtttgaaccaagactgaaacagactaaggtgattttttttttaaatgaaagattttcagattcatccatgagccctctctcacttcctatggcattttttttttttgtaattctttgttgaaattgtcttctaatatgttcatttctgctacaagacagtaaactgcttcccccccaacactaaacatttctttttatttggttactccccagtatttagccagatgcttaactagtagaaaaagtaattttattggcaggggatttatgacctataccaatgcaatgcaatgcagccttgacccttgctctaagctaccagcgcaaataattcagtgattatcactaattacttaactgttaattagaagaactatttcttcccactttcaacacacagagacaacataattaccatccaggcataaaatctaataatcaaaggagacgttggaagttatgtagtccaaccctcacttccctctctgtgcagataccttttctgtaatatcttgacatagtcattctgtgttccaaaacccttctggtaaagtgatagtcattactttataggccacccaacctattgctaagaagccccgttttagtgaagctctgtagctcacactcactggtctttgcccctggaacagtacagagggaatctgtgacagtctttaggcacattttcttcaagctcctcggcaagctgtatgtatctcagacggtttgactgtcgtgaccccattactacgtacacatttttgtttatcagtgttctacttgagatgttatttaggaacaagtacagtcccgagggtgtggtctggatggcacatagcgacaggactgtccccgttttggatgcccgtgtactatttactaatagagactaaaactattagtgtttctttggttttgtcatcaccttgtactgtcagttccttttgaatttgcttcccccaaaacctccaagtagagttctctttaactcctagatagccaggtttcttgccctgtccctcatcatttagtgtcacctacaaatttgataaagcatgcctacctggttgtccaaataacacattaacttgcttacaaaaacagagatgcatgacttttatcttctttttttttttttttggaaatgaagttgctctctgtcacctaggctggagtgcaatggcgtgatcttggctcactgggctcactgcagtctccgcttcccgggttcaagcgattcttctgcctcagcctcccaagtagctgggattacaggcacctgccaccatgcctggctaattttttgtatttttagtagagacggggtttcaccatgttgaccaggctgttctcgaactctggccgcaggtgatccgcctgcctcagcctcccaaagtgctgggattacaggcttgagccaccatgcccggccatgacttttatccttaaaacttcttagggccaggcccagtggctcacacctgtaatcccagcactttgggaggctgaggcaggtggatcacatggtcaggagatggagatcatcctggctaacacggtgaaacctcatctctactaaaaatacaaaaaaaaaaaaaaaaaaaaaaattagccaggcatggtggcacgtgcctgtagtcccagctactcaagaggctgaagcaggagaatcgcttgaacccaggaggcggaagttgcaaaaacttattgaaggaagctcatatccactcagtaatggacttgggttcttggtttcaccatccacaaatctctttaaccgtgttggtacccagtcacatgtcacttttgtttacaaagttaatagcctgggcaacatgccaaaaccccatctttacaaaaaataaactggacttggtggcgtgtgcctgcattctcagctacttgggaggctaaggtgtgaggattgcttgagcccaggaggtggaggttgaagtgagctgagatcatgtcaccgtagtacagcctgagcaacagaacgagaacttgtctcaaaataaacaacacaaaacagaaaagcaaagttaataagagagaataccttgcttatttcaagctactaagtttttaggcttcctcaatgtacaaaggtagtatttctgtcacagacccctccctctagcttgccagggtccctgttctagttattgaaccgaaaacattctaaatgataaatttttccactttggcatattatgcccccaatttaagagctatttatggtaagaaaagttaaattatatttctgttattactcagtagaacctataagtttaaaacaaaccccatcacatagttgctagtaaaagactttggattttgaagacaaaagaaaaaaaatgccctcactaccatgaggaaagcattaccattcaggtatctaaatagaagtagaatatgcttctaaatcatccttttatctttctgtacctaatataaacgtggcagatgcatgattgtcctgtaggagctatttcaacctagaattggagtagcagagctactaatttgactgtgtccttttatagcttcttaattttgaaaaaaagaaataaggagggaaggaagagaaaagagtgagagagagatttaaaagactggttgctggggtgaaaaggaagtggttctttttgttttttggtttttttgttttttttttttcaatattggtgaataaattctctttttcagaatgtgagaacttcctggatgttggactgggcagagagtgtacctcaaaacaaggtgtacttaaaagagaatctgggagtgattctgacctctttcactcacccagtgatgacatggacagcatcatcttcccaaaggtactgtgtggaccttcctttcatttttgtcacacggcttttgtgttcctatttgggcttcccaaactcttttccaactttttccccctcttgtgctctcctgtttccctaaatatgtaactcctgctagtaagttgtgatccagctagccttgtagggcctcactcactctgagaggcatgtaaatgttctttggagaaggaagcgccagattaccagggtttagaaaaaggcactgggctgggcatggtggctcacgcctgtaatcccaacactttgggaggctgaggtgggcggaccccttgaggtcaggagttcgagaccagcctggccaacatggtgaaaccccatctctactaaaaatataaaaattagctggacgtgctcacttgaacccaggaggtggaggttgcagtgagtcaagttcgcgccactaaactctagcctgggtggcagagcgagactctgtctccaaaaacaaaaaaaagggaaagaaaaaagcattggccaaagttatttaatgtgaaattgtggccagttaaatacagattttgaagctcacttgggagtcagaagaaatggaagttcctttagaattaattaagtcagatgacagtgaacacttctcagtgggcagcaaggaccgcagctcagactatatgatgtcatatttataaaccagctgtagagtcatttctggttaatgtgtttaggcctgaagcttcctgctgagtgtggtcatatcactcatcctcatctagcctgcctaattggaactttctagatctctgcaatagagcccttccacatgaatcagctcacatttgcatataattggaggctgcctaagggaggtggggaatgggggtagtttgctttcttttgcttatatttgtttctagtggcagcaagttctgttttgctcacctgagaagaatagagggctttccccacagcagagatggcaaatgctactcaattatatgccacaagtggttttcttaatggtaaggaggtgaagaggcggaaacactgttgcatctaccaacacggttccttctagttttataatgagctcggagaagtggtgagagcagttgtgttagtgggtgattaggttgtccaagatggtgaatgatgctgtgtagaagttacaagaataggccgggtgtggtggctcatgcatgtaatcccagcactttgggaggccaaggcgggtagatcacttgaggtcaggagttcgagaccagcctggaaatggtgaaaacccgtctctactaaaaatacaaaaaaattagctgggcatggtggcgcgtgcctgtaacctcagctactctggaggctgaagcaggagaattgcttgaacccaggaggtgaaggctgaagtgagctgagatcacaccactgcactgcagcctgggcaacaggagtgaaactccatctcaaaagtaaaaataaaataaaatagaagttacaagaaaagagacctaaagatttgggaatcaggagcatatcagtgcctctgtgaatgtaccctgtgtgccttcctttcatttttggccttccctgacttttttttttttgaactcattgtcttcccaaggtctttggaaagacttatttaatatgatgcaaacttaaggatttctatcattgtcactcatagtgacttgacaaaaaattctatgaagtaaaaactccacatttaggaccgggcgcaatggctcacgcctgtaatcccagtactttgggaggctgaggcgggctgatcatgaggtcaggagatcgagaccatcctggctaacacggtgaaaccccatctctactaaaaatagtggtggcgggcacctgtagtcccagctactcgggaggctgaggcaggagaatggcgtgaacccgggaggcggagcttgcagtgagccgagattgtgccactgcactccagcctgggcgacagagcgagactccatctcaaaaaaacaaaaaacaaaacaaaaaaaactccacatttagaagatctgcctttctctttacttaggaaaagagaaatcaatagttttatgttattttattttttttttaataatatcagaatttaggtaatttccactgcgactttcgaggttttaattgtaaggaattctgttccccgcaaggggaataccattctgaagatatgtgtcgctaaaaacatactgagataaacagattagatagtatctctaagttccagctttaaaatgggatcattgataatcattgaaactaggtcatggatatacagagatttgttaaacatttatatatgtttgaaaattttaacgtaaaaagttttttaaaaatggaagtgtctttgttaagaaatacttccttgcaacctcctaggtgcatgacagcttgtgcctggatgttaccatctctgcagactcagagttacttctggtcacttaattgaatggttttcttagctaaggagaattagaattttctatatttcgccgtcttattttcccagaaccatttacaaaattgctcatataaatggcctgtgctagatttggaagattttttttttcaagaatattagacatataatttttaaaagttgaaggaggccaggcgtggtggatcttagcattttgggaggctaaggcaggaggatcacttgagtcaaggagtttgagatcagcctgggccaatataatgggaccttgtctctacaaaaaataccaaaattagccagacatggtggtgcacacctgtggtcccagctattcaggaggctgaggtgggaagatcacttaagtgtaggaggttaacgctgcagtgagccgtgatggcaccactgcactccagcctgggcgacagagcaagaccctgtctcaaaaataaataaataaataacacctacattttatactagactgcttagggaaaaccagaaatggtagcttcactttcacctcctcatgcatgcttgagaatgtctgcatggcctgagaagagatggggaggatttttctcttagtgtttttgctgtaccaaagtagcctgtgaccaggagaggctttgcaataaatgtttgctctagcattaataaaaccaagggctgacttacaaaaaggagagagactaatattgacaggatacttactgtacagtaggtactgaactaaatttttaaaatatttgatctcaatttgtctgcccagcaaccctgacaagtgggtggttttatgctcttgaggaaatagaggcactgataggtaaagaaatgtatccagaattacttagtgggtgagcagccaacttgaggtttgcatctaggcctgactctaaaatctgttcattttttattttactctcaacctccccaaacctgctctaatagccagtgattaaataaaagcgtggcactggcagataggccatcagctgcttccttaaaagtcttcctcagtggtcacccccagagtgtgctatgcaaaatatcagaatgtcttgcagtttgttcccaggttctaaccctcttctccatctctaaaaaataatctgtaggcgagacattgcaacatctttttctgtgaaccatgagtggtacatgaggtcacttcctgcagccatttgtgtctctggcctcacagaggtctttaacagcccgtaacgtttgtcgtgaccttttcaccttaaccctgtctttccattcagtatgcctcctggtaaatgactctttagtgagtgttatgagcttcacgtttattctcatgaatatgtgtgggttcctaaggtctttaatcaatagcataaaatttagattttatttttaaagtgaaaagaaatcctaggattctttttggcactagctaagagagaaagtacgattataaaatatacatgatctaggccactctactatccaaaaggataattaaagtctacaggaaatattaatagttgctgcctgtcttcccaaagagaggtaaatcaaggtccttccatgttatttttcttccccaggttagcagatgtatctacaattgatttaaaaaaatcagaatgacttatataagatacaaaacctaaagggaacatccttctttcatgtgttgtagtttttctcaggtccttgatccccaagccaaaaaattacttaaaaaaaaacaataaacctttttgagataaaaataaatgtaagccaggcatgctggttcacacttgtaatcccaacacttcgggaggctgaagtgggaggactgcttgagtccaggagattgacaccagcctgggcaacatagtgagaacctgtctccagtaaaaaatttaaaaattagccaggcatggtggcacacgtctgtagtcccagctacttgggaggcagaggcgagaggatcacttgagccttgaagttcaaggctgcaatgagctgtgattgtgcaactgcactccagcctgggcaacagagggagatgctgtcttaaaaataaataaaagtaaatgtatttacagaatcctaattaagaaaatgacaattgcggctgggcgtggtggctcatgcctttgagaggccgaggcaggcggatcactggaggtcaggagttcgagaccagcctggccaacatggtgaaaccccatctctattaaaaatacaaaaattagctgggcgtggtggcaggcgcctgtaatcccagctactcaggaggctgaggcaggagaatcattcgaacctgggaggtggaggttgcagtgagctgagattgtgccaccatactccagcctgggcaacagagtgagactccatctcaaaaaaaaaaaaaaaaaaaaaaaaaaaaaaaaaaacaacaaaaactgcaattgcctgtgcacaagtgctgaaattattaaaaacttaaaactgtgaaccagtggtaatgcttgtaatcaggtacttttcttaaaatattgaacataaatggattaaatggttggcatgtgttaggtgtttaaaatgtgagccattattttccaaggcacatagtagagtgccttgtgtatcattacaaataataataataaatgtttgggaataaatggagattaaaggactagtattttggcaatattaagcatgatttcttcaagtatagtaataagatataaagtatgcagcagttttgtaattttatgtttataatgtttatacctctgtatatacttacgtatccatacctgtataatgtaactctggctaagaaagccaatcaggcatttttcccaacattttattaagaatatattgaggcatatagaaaatttggagaattgtacagtgaacacccgtatacccactacttagatcctacaattaacttttaattgtatttgctctattatgtaactatatatctgtccatccttctgtccacccagtttgcctgaattctttgaggcaagttacaaatatcgatatacttcacctctgaacacttagaattcagtatttgtttataggttggttgggtttttcggtgaagtttacatacagtgaaatgtacaatcttgagggtaccagtcagtgactttttaaaaaaaaatttaatgactgcttcacgaatgtgtgcatcatccttgcacagaggccatgctaatcgtctgtgcattgttccgattttagtgtatgtgctactgaagtgagcacccatcagtgacttttgatagaagccttcattcacgtttgtacgcagcctgcagcagggtacagactataagcatcactttggagttgcctcatgtctcttctcagtcggtctccattcacaccctctcaaggcaacagctgtcttaactgttttcccaccgcagattagttttctgtttcagaacttcgtataaatggaatctaaataatatcatttctcttgagaaatacctaggattcgaattcttagattatatggtaggtataggtttagtttgctaagaaacggatcttttcccaagcggttgtaccattttacattttcaccagtgatgttttgttttcctttttcaagtaataaccaccaattcatagtaagagctgcatactgcagtaaaaataatgagtataagaatattattctgtgtgaactttattcttaccagatatgcaagactgtagaaatcatgtagtttcagtgagatcagagttaaaagcacatattaggaagaaaggctttgtgttgagaatatattctagacagatctctttgtttttaaaatgtgtataaacaggccaccaaagattttcccaccttattttaatgactctcaaaagggtagatggttgttttataaacttcagattcgttaagtgccagagagatagcaggcctttttttcaaggcaaaatccttccaagattggatgccagagtgaagaagcacctatataactgtctgtgagttgtttccaaactgagaagagctaacttgtaagaaggctatatggtaaattaataaatggaaactttaactcaaaatttttgtttgccttgaagtcttttttgtgtgttttagaacaggcttgttatacattttgctttattggtgttcattctgtttgtcccttggtattattttgagaattagacatttaggcagctaagcgtgagtatattagcttcctagggctgctgtaacaaattactggaagctgggcggctgaaaacaacaggaacttacttggtcccagttctggaggctggagatcctaatcaccgtgtcagtggggctgctttccttctgtaggctctgagagaaaatggcctctcttctagtctctggtgcttgttcagtccttggtgttccttgggttgtagacactgcactccaatctctcctctgccttcacgtggtattctctcctgtgtgtctttttgtgtctcttctcctcttgcagggacaccatttgtgttgggatctggggacattttggatccaccctactccagtataacctcatcttaactaattacatctgcaaagaccctctttccaaataagctcacattctgagaaggacctgtatctgaggaggacattattcaacccagtacagtgagaaagccgagatattcacgagaccatttacattgtccttgtccatggaaagttgccccgtgaataggacccctttaggaaacccctgagtccctcactcagaaagcatagtcagttatttcattttaaaataatacctaccacaatttagaatttactcagtgaaccatagttttattttacagagtgacccagtgaagggacttttctgatactgactttgatatcttgttcttacagggttttttaaaaagatgattgagataccagaatagggcaatttgagttgaaatcagcctgggttcaaatcttgattctgctgctcatgcctgcgtccgttggaaaatctggacctcagtttgacctgtccagtgatccccttgcatcttttctctcattcccatacattacttaaaaaacaatctaggaaactggattccacggaactggaaaaagaaagccttcttattagcttatgagatcaagcccaaaaggtaggaagggtgcttttagaaggtagtgtgcttttgaactattacatcaaacctttaaaaagagtctccttatagtatagagatatagagcttgttttctattccaaagctgaaagattttcataatttttttctctttcttgaagaaccataatttttttttacccttaattaaaacattgagtagactaatttggaaaatattgtgaaaaagggaaaaagaattacaaaatgcccttccctgttccctgcccccatcccgtaagagtgcaaaatagctattaagacagtgtccacatcttaagagtatgatcaaacatctcttagacacttcttttggccttttgggtaccatgaagctcatctttccctcacccatcaaattctgtgttctggtatctccttccctcgctccctctcaggttcaagagattttccttcctcagcctccccagtagctgggattacaggcatgagccactgcgcccagccactggtatgtttcaacaagtagaaaatgtcaggctactagaacagagttacacagaacctgttaggcactagaggttagccaggaaagagcatcatcactttatcaaagacctcattgccaggactgattatttaatgtatgatttggcctcataatactcagccagttctcagtgaaatgagaaaaatgtatagctttcttccatttagatatttgtaacaggtacttatgcatttgtggcaaactttaggtggggtcataagctattccacatttttcagaaggccactaaaaacaaccacagacttccttttggaatattaatttcagcatattattattgtagccaagcagactgttttgttttcagttaaagcttataaaaaataattaaacctaacacatgataaattttgttttcatatacaaaaaacccagagacagatggattcccttcattgcagttggtgatatttactgaaagaactaacataaatttgatatttttcctcttgaagaaaaaaatgggctggtcacggtggctcaaacctgtaatcccagcactttgggaagccaaggcaagaggatcccaggagttgaagaccatcctgggcaacatggtgaaaccctgtgtctaaaagaaatacacacaaaaaattagctcagcatgctggcacatgcttgtagttccagccactcgggaggctgaggtgggaggatcacttgggcccaggaggtcaaggctgcagtgagccataatttcaccactgcaccccagcctgggtgacagagtgagaccctgtctcaaattggaaaaaaaagaaaagaaagaaaaaatgatgtacttctagtgtagtacctctagtaagaggataaaaagaggatagacctaggccaggcgcagtggctcacgcctgtaatcccaccattttgggaggctgaggtgggtcgatcatttgaagttaggcgttacagaccagcctggccagcatggtgaaaccctgtctgtactaaaaatacaaaaattagccaggcgtagtggtgcatgcctgtaatcccagctacttgggaggccgaggcaggataatctcttgaatccaggaggcggaggttgtggtgagctaagatggagccactgtactccagcctgggcgacagagtgagactgtctcaaaaacaaacaaaaaaaagaggatagatctagactgtttctcttctagagtccaggggggatttgaatccaattgtgatcatcctattaaaaaaacaagtctctgaggccaattatgatcttacctgcctggaatccactgagaagccattggcttgatctagaataactgaggctatctgattggccctgctggcttcaaccatatgtgctttctctccattacagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggaggtgagatgggaggcggtttgtttagtgtctcagtgtctgcttgcttttgagaagcttctgatttgtattattgttggtaaaagaatttaggagaccccatagtatagaagaaagaatataggctttggaatcaggaaaatctgtgttcagaccccagctccaaaatttactatgtagatgaccttgggcaagtcacctgacccctctaagctttaatattctcatctgtaaaataccttcattattatttttaataatacaatgaaatgtgattgtcatataatgagtgtttagtaaatgggaatgtttattcttaccacattaatgaaacttatgaatgagaaaatattggaggcagtagtttcatgtcaactttgaattaagaaacaaacatgaagtcttacagtcttaacacatcaaagtctttcagagtattttctgagaattaaaaccatctgtttctaatacagaaagttttgataaagtctaaattatcattgtttaaccctcaagaggatataagactcattacattcattttacattcattacataccattaaattgttgggattttcccatgtgggaacttgtattaagtgtgacccagtatcagtccttcaatttggaagcaggctatatgaaggtatgtcgaatttgacttcttttttttttcctgagatggagtctcgctctgtcacccaggctggagtgcagcggcgcaatctcggctccctgcaagctctgcctcccgggttcactccattctcctgcctcagtctcccaagtagctgggactacaggcgcccgccaccacgcctggctaattttttttgtatttttagtagagacagggtttcactgtgttagccaggatggtctcgatctcctgaccttgtgatccacccgcctcggcctcccaaagtgctgggatcacaggcgtgagccagcgcgcctggcctgaatttgacttctgactgctggctggctagacaaatgtaagcagatggttttagctttaaagaatgagtatggtagtgcctactatatttacaagagtgtgcttattccaaagctactttgctaataagtaaaacagataagggatgaggctgacagttgttttaaaacaattgatgtaatctcatgagcccaggagtttgagaccagcctatgcaacataggagaccccatctctacaaaaaagaaaacagccgcgcatggtagtacatgcctgtggtcccagctactcgagaggatgagatgggaggattgcttcagcccagaagttcgaggctgcagtgagccatgatcataccactgcactccagtctgggcaacagtgagaccctgtctcaaaataataataataatagtagtaataataataattgatgtaaacagctcagcaatagcaattatttgctcaaatttctcaacctcctgataatattatggctgtgtaatcacattcattcacttatttattcagccaacatatattgaacactcactatgtgccagactctgctctaggttctggagataggtaaacaagacaaagtccctgcctgcatggagctcacagtaataccttcttacactttcctaatttgctaatcttttcagactctctttataacacatttctgatataatttttcagtcctctccatgagtcgagtggtattatccccatgtttgcagatgagaagactggtgcaggtagtttgcatcatttatccaaggtctctggtctcttagtcaaatgccgtttctataattccatattattctatggtggcatgtaggatgctaaccttaaaaataagcagcatgctttttctgctagcttgtttttatatacgtttgagaccctagattttataaaaagtaatttcccagttttgctcgtggtgtactctttttttttttttttttttaagcattcagagcaacagaaaatgtaagagcatggtgaatgatccctacagccagagcttgaagcaaatgtaacttttttggcaggacagtcttatcttaaatgataacagcatcaaggaatgagggtttattttctatacaatccccttttctttataatccactatgggttcctttgtcacaactttgattttagagctacatgtgactgtgtctgtcatgtagctcagatgaggaaattgaagctcagaataaatgatttgcccaaaattacatggtgatctcagttcagttctagactgaactgagactagaactctacttcttttcatcctgcataatgtcatgggatctcctgtttgaatttactgctagggcttacctaggaccactgtcctaatacctctgaagataatggaatgagagtgaggttttaattagtttggctaattgttatggtattacctgcatgtagtataacctgaattttaaagtgttaagaaaaacccctttaaagctttgagtagtaatttttttctgattctttaataatttaataaactttgtaacttttgccatctgattaactccttggagcaaggggaggagcaaagtagccctccacagaaactgtcaggcccttttggtcctgatgtttttctcattccacattccttcattctcttgcctgtgccatttctctttgagcagtgtctctctccccagtgtggtgtctgtatgtttcatgcatttgtatcccattttgtttcacctgcaacactgacctcttcaccattcattttcagttcaatgcgagttcttggggatgttgtcaggagacctcccattcataggagaaggtacagagttcattaacttgatggactaaccatgtcacctctgagcatatactaacaagcatctcattctgcttaatccatgattggatcatctacttttaagtaatgtcccatctaattcaggcaaataaaatataggtacttattaattgctagtgtccattttatatgaaatggtttctttaatttgaagttttatgctattttatcttttttaaaaattatttttaatttttttaaatcttgtgcttattgttgttcagatgactgtgagaatagggtctcacctagctttctctaggagagttcgaagaattgtctatgtcgtgcctatttaatggaccctggggagtactttttttttcttttccacaaaagaaaaaccaggaatgtgtgtgtgcttgtgcacaggccctaaagtattgtcaacacattgtttaataatgtaatgaaagactttattactaggccacctggcattttccattccattgtggatatagtcatttcttaaagcaagtcagaggcataagttcattccttggcctttgaattccttaattagtatttgtcaggtaatattttgaagctaaaaataaacgatttataagctgagaagtaatttctagtcagattgctaatttgcttcaaattttccgttggattttctttagaagtcattagtgaccttccattgtttagaaaaatatttagaaatccaaaaattagggttatattactgttagtttctcaggaggcatttgtaaagaagtatttttaactattagctgaacctgtttgttggcaagtgggcaaatagtgatctttcctactttgtctttttcaagtggatgctttctttaattccagattttaggcaagaaattgagctgaaattcagatattctcatgaatttcagataatcatgattcctatgaaattgttcttccagaaaataagttgttaaataagttttaaccccatctctactaaataagtttttcagtagaaggttctttggagatacgtttgtctgggtctttattaaagctcttcaatatgagcttattaaaaacatgcacttgatgacaaggtgggagacgacagattgctggatgcagtctgagttagtgtatacatggagtgtcatcaacaactccagccagtttcatccctagtgaaacttatttttgtaggaagaacgtaatgtataatttaaaattttataaaattgaaacattacaacaggtattataaggcaggaggagggacatttgttgttttttaatctagaactttacaaatctcaaagccaaagaactactaaatattatccctactaattgaggaattgaggaaatgacgatgctttccaaaatactcttaattatgaaaggagttttctgttaccagaaagggcagacgttgtagaccatctgcagcttccttcctggtaccttagaaaagctgttatatcttggccgagcacggtggctcacgcctgtaatcccagcactttgggaggctgagccagatggattgcgtgagcccgggaatttgagacctgcctgggaaacatggtgaaacctcatctctactaaaaacacaaaaattagctaggtgtggtggcatgcacctgtaatcccagctactcaggaggctgaggcaggagaattgcttgaacctgggaggcagaggttgcagtgagctgagatggtgccactgcactccagcctgggtgacagagtgaatctaagtctcaaaaaaaaaaaaaaaaaaaaaaaaaaagcttttatgtctgtcttcctatctccctattgtttttcactctcttcgtgttaaatctcctcacagtcttccacatcattgtcatatcctggaagtaaaggaacatttaaatctgtagaaggagattatttttaagaatgatggtttggcagtgtatgttcagttactgatttgccacattctgtttctaaaaaagaagttggatatttaggtaaaaatatgcctatttattaactggcgatttaaaatttaagttaataatgtcaaagaatggacttctgagtcttatctgtgtttgtaaaatatatatcttctcctcacacaagtaaattatgtcagtgtcatcccacttaccagaccagcgaagtgtctccactatatttttactttctgcttctgcacttgtaagctttataccactaatttaatctgatttaaaatgttttatactatttagttttaaatgatatggtaaagattttttaaaagagccataggggtagctcttacatcctcccacccattttccttgtctcctttctccagccaaaaaccccacttgacaacaaaacaaagttattagatgtgtccagtataggtgtttttggtgccaggccttcccatctgcaagattctggagggagccgagtggttttattgagccgagtgtttttattgtccacaagctctgcttttatctcttctcagaaaacaaaaacacatcacctagaactttatggcccaggtagcagggtatttttttaatgatagcttttgttaataaaaatcccaacatttccatgcagtttcctttatagaacacacaatattttgaattgattattgttttagctagtggtgtttacttagcatttccaaccccagattttctgtccttgctacttgataatggacaccgctactgggatattcaaggaagtagatgatcagatggattttttttatcttgtaggaaaaatggaaacaaacttgaaattaaaaagatacatttctaactcagtgccatagaattccttttttttaaatttttattatcagccaggtgcggtggctcaagcctataatcccagcactttgggaggctgaggcgggtggatcacttgaggtcaggagtttgagaccagcctgaccaacatggtgaaagcccatctctactaaaaaaaatacaaaattagctgggtgtggtggtgcacacctgtaatcccagctactcgggaggctgaggcaggagaatcgcttgaacctgggagacagaggttgcggtgagccaggatcgcaccattactctctagcctgggcaacaagagtgaaactccgtcttggggggtagttttcattatcattaaaacataagcaaatatataatcagtgttatatgctttatctttaacgtaacagcctagtgagtagggtttgaagatggatgccagtgttgactaagtatcttatcatgcagaatctattaatgtctggtttggttggatccgtaatggaaacacatgaaaaaaaaaaaaaaaaaccggatgactccatgagcccaccagagcacagtttgtcactgtctcttttaaaaagtctaggattagagatactatggtaagggtgatgtgggagtatgcgatgtactgagagattgtacccagtggtggagtttgaaatacctctcatgtctgaagagcaagccataggtagttgccacagttcactagaaggaatttttgggtttcaggttgaactggtgatactgtaaagaacccacagtctttttccacaatgctgtctagacaagaagaaaatatttttaagtttctatgattttttattatagcctttttaaaaattgtcagtgttacattcctaaattttttgttgatcgcataaatccgtctgtctctaactatgcccttcgtttttaaacctaataaccccattcctgtttcctcttttctccctgcatttctgtttctgtctttgatgtcatccccagtatgagctggtgcccctctggtgtgcagtactctgctggcctgagtgctgactttaattacagaaggtatgatattgttatgtgtcccgccaccaaatggggaaccataaaatacgccatcagggcttttggcttggagctggcttctgtgtggctgggatgcatatgggcagcctgctttgtctgtgagcacagcatttcattgcctttgctatgggtgtcactaactcagctgaagggatgcagcctaagagtcgggtgatgcatcctgtatgtctcaaatggccatagatttgatgttttctgcacagatttatctctctctgttttggtttgtcttgattttcagatcctaaaaattcttggaacccgaagaaaacaatcaaagaaccaaggcagctaataagatgcactgatttctattatgcttctaaatccaccattctgtgtagattccaaattcagagactcctcatcgtttcatattcttctctcaactgaacagccagatttaattactaaaacattttcagaattaagttttgcagtaagcatagatctggttttcttaggcttttcaagtaatttcttcttcacttagcccctcctcttatccctggtattgaaagtgagttttacaggccaggcatggtggctcacacctgtaatcccagtactttgggaggctgcggtgggcggatcacctgaggtcaggcattggagaccagcctgaaaaacgtggtgaaaccccatctctactaaaaatacaaaaattggccagacacggtagcaggtgcctgtaatcccagctacctgggaggctaaggcaggagaaccacttgaatccgggagatggaggtagcagtgagccaaggtcgtgccactgcactccagcctgggcaacagagggaggctctgtctcaaaaaaaaaaaaaaataggaaaagaaagaaaatgaggtttacagagtcatttacttgtagttagtcatgatttctattatattgaagaaaaacatatccattgtttagtttacctactagagaaaatagagttatatggcttcagttcgttaagttatttacaaaaccaaaataaataaataaataatttaaaaaagcaaatacaagtcctggactggtaggtatgaacttaattggagcaattttctgtacagttttccttgagtggaggtaactaagtagcttcagtataccttcagattgaattccagctcattgttagcggagaacatggtcagctacagctatgtttcgagatcttggttattttaaagaagtttccgctgcagttgtaacagatgtgaattactctagttagcaacccaaggaggttaaatcgctaacctgtctctgtagccttctgcttactgaaaatgcttttcattctgcaaaccacagaatctgtcttggaggaatcctctttaaaatgccaaatcctgactgcctttgttccctttaccaatatccaggcaaaaaattacaactctttctactcttagaccaggttgcttttcagcatttgttcattaaggtgttatatgtgcctgttgcaactaacaattctcgagaagtctgtcagcagttgtttggccaggtgtgcatagatggtaacactcatgagtaacacttgggttttcttgggtgaaagcatacctgtaaaattataaaggtcaacttgaatgtaaaattataaaggtccacttaatggacataagggcaagttacccagtttgccttctgaaagttacttaagctcgtattttctctgtgacatttaattacttggcattagtagagttagattcacaaagattaattagatcaaggaaaaaacacatatataaaatatcagataactatggtctgtccatatagtgtgtagaaaaaaatctgagaagtgatcttaggtggttcaacatttggataaatttaatgcggtaagaaaatctaagtgcagtattctttctcagtattccaagatctgtgggggaaaggtaggtagtattctttgtgccatgcccttttagacagttttgctagctgacatagaaataatacacaaacaagggagatatacccaaagggattttgtgtcctcctttgtttttgagacccagaaatagaatgaattaacttttgtgccctatgttcagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcaggtaagtcttaaatatgtctaatttggaaaaaatatatttcacaaaatatgaacatagaaggcaaggcttctggtagtataaggctagtagctatgattacttacccattatatgatatacttaatctagcactaaaccaagtgtttagcacctaattaaaaagggccaggcatggtggctcatgcctataatcccagtgctttgggaggttgaggcaggaggatcaattgagcccaggagttcaagaccagcctgggcaacatagcaagaccccccatctctacaaaaaatttaaaaattagctggacatggtggtttgtgcttgtagttccagctactcgggaggctgaggtaggaggattacttgagaccaggagtttaaggctgcattgagttgtgattgcaccactgcactccagcctgggtgacagagcaagactctgtctccaaaaagaaaaaagaaaaaataaagactacgttaatctgcatagatttaaatattccatcaaggcacactttttaaaattaggaaagtatccaggatattaaattgagtttttccttcttatctgagaccatcttttaccctctcaatagtaaactgaatcttgaaatacgctacatatcgttattaattttcccaattctctaaaacatatcccaagtttctcctttgtaggaaaaaaattaaaaacaaaactttcttactacaccttccaggaaatgtcagttgattctctctccttcccatccctaccagaattctttttttaaaaaattattatttttacactttaagttctagggtacatgtgcacaacgtgcaggtttgttacataggtatacatgtgccgtgttggtttgctgcacccattaactcgtcatttacattaggtatttctcctaatgctatccctcccccagccccctaccacacaacaggccccggtgtgtgatgttccccgccccgtgtccaagtgttctcattgttcagttcccacctatgagtgagaacatgcggtgtttggttttctgtccttagcgatagtttactcagaatgatggtttccagcttcatccatctccctgcaaaggacatgaactcatccttttttatggctacatagtattccatggtgtatatgtgccacattttcttaatccagtctatcatggacatttgggttggttccaagtctttgctattgttaacaatgccataataaacatacatgtgcatgtgtctttatagtagcttgatttataatcctttgggtatatacccagtaatgggatcgttgggtcaaatggtatttctagttctagatccttgaggaatcgccacactgtcttccacaatggttgaactagttcacagtcccgccaacagtgtaaaagcgttcctatctctccatatcctctccagcatctgttgtttgctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatcctttacccactttttgatggagttttttttttcttgtaaatttttttaagttctttgtagattctggatattagccctttgtcagaggggtagattgcaaaaattttctgccttctgtaggtcgcctgttcactctgatgcctaccagaattcttaagagagcatctatgctccctgccttctctttttaaaattttatttatttatttacttatttagagacagggtctcactctgtcgcccatactggagtgcagtggtgccatcacaggtcactgcagcttcaacttccccagttcaagtgatccttctgcctcagtctcccaaagtgctggcattacaggtgtgagccactgtgcctggcctttgccttctctttatcaccatctaatcatctcttaatttctgctgctaccagtctcttgaaactcctgtcttgaaggtcatggatttccatgtcagccaaatcaaagtgacttcttagttctcatcttctggatgtcctcattatcacttaccacttttgacaatcccttggggagcttttgagttgagaattcaaattatttgcttttatatcattgtacctcactgcaagtcttttctcttcctcttgggtcagaagactgattaatttacgaaagcattctgggatgcatcttatttcctccaaatgaaacacttacaatttaaaaaaaaactgtttttgaatagatgactggagtttgaggcaagaatctaatgatacatttctaattaaacaaaaacattgacaacctcttccttgatttgctgagtaggactttgtgtagaagtttaaatttttattgcatcctactatgaagcactaacatgaccaaatataaacttgacactgaaggattatcttagtaattattgtaacacttatgcttgtgtgagaccagacaaataaagagatttaggcataatgaaaatcagttgaagagtgaattttgccccttttaaaaatttttctacttgttctgatacttcagaaggagttagaaaaaataagaatatgaagaatatgcttgttgaagcaagtgatttagatttactcagcctaatggtaacagagaaaggaagaaaaaaataggaacaattcttggatggctactgagcacagctttgctaagggtaaataaacagtgaaaaaatctttaaaataaattgcatttcaaatttatagaatcctttggaaatcatttacaagatgaggtaaaataccaaaattgtggatttgtaaacagaatcataggccaagactgacatatcccttcagatttagctccagctcatttaaatgacttgcctaaggccgtgtaagtggctattagctgaacagtattaaactcaagagttcctggctattaatttctctgcttttttccaggtttttggagtaggtgagttttcaaggaggaaataagaatgatttaattttcttaatattatttatgtgataccttttctaagatggatatttccgggaatttgacagataaccctgcattttagtaagacgttactactactgatgtgtttctaaaatggactgtctttctgaagtggactttctgattcagtctttctagataaagttgttgttttagtgccttgctatgcttagccttcctggaatctctacttacccatagtttttatcttgtatggaacctcagagtaggcatttgagctgcttgtttcactctgatctagacgagttgcctgtagccaacttcctgttaaaagtctctgcctttcactgaggtcattttttagacctcacagttgtatttgaaacatagcaactgtttgcctcagctgccatggttacacatgaaacaagctctaaataatcagaagtctggcctaagtgagtcaagttcatgctagtaacggatttttcactgcttccctttcaatatgtgagtcataaggaggcagatttcattctgtgaagggaaaggattaatgataaagtcagttaacaattggaatgggctcttatcaccagaagtgtgctagtggacactagatgactgtctttcagggatgttgtaccaggaacttctgcaggtggttggattacatggtctcaaagctgctgtgaatttactgagagagttaaattatcaaatttcagttacctttacgttcatgtagaatcactatcatcttagaagaggatagggaagagatttaggcttctttccagatacactgttgttttgtttgtgatcttaagacactttacttgaatctcaatttccaattatttaaaatcagaggccaggcctggtggttcacacctataatcccagcactttgggaggctgagatgggtggatcatttgagcccagggatttaagaccagcctggccaacatggtgaaaccctgtctctaccaaaaatacaaaaaattagctgggcgtggtggtgcacccctgtaatcccagctactcaggaggctgaggcgggagaatcgcttgaacctgggaggcagaggttgcaatgagccgagatcatgccactgcactccagcctgggcgacacagtgagactctgtctcaaaaataaaaataggctgggtgcggtgactcacgcctgtaatcccaacactttgggaggccgaggcaggcggatcacaaggtcaggagttcgagacctgcctgaccaacatggtgataccccatctctactaaaaatacaaaatttagctgcgcgtggtggcgcgcacctgtaatcccagctactcaggagtctgaggcaggagaattgttggaacctggaggcagaggttgcagtaagtaaaccaagattatgcctctgcacatcagctgggtgacagagtgagactctgtctaaaaaaaaataataataaataaagtaaaatcagaatactattactgatattctactatatctgtatgaagaaatatttagattttcaaagaacaagtattgtatgtagtttgatatttccagtgaaattatttttaagtgattatgcatccagcagatatttattaagtacttactaagtttgaaacattgttagatgctatgagggatacagaaccactgtaaagaatggatactctaatgatccccattttacagatgagaaaactaagcctcagaaaagctaagtaacttctctgaaactgagcagctgttaagtagcaggagcagactttaacctaagtctgtctgaccacaaggcctgtgctctcacccgcttcttcactgccttattttactatgtgggtctaattataaggttttatgcttatctagaaatatgagagtatatgcttacaacgtgttcttcacttttttacttcacagatatgtcacagatctaagcagcagggatttaattactgtacatcagccatttcctctccattgacaaaatccatctcattaatgacaatcagccatcctggattggacagtgagtatactactttttaaaaaaattaaatatattaaatcttaaccactcttcctattatttttctcactttaaggccccataacattacctgccaaaatttgcttactacttctttgagtgaatggctcagcacttaaacagaaaaggtggcatagagtttatcttgagatcttcttccttttacctaaaaatatccctaatacattaagtttattgtatttgtgggcatgaatctgacacactttttaaaatttttttattttgaaataattttagacttgaaaaatagttacaaataatattcactggggaaaaaattgcaaaaatagtacaaagtattcccatgtattcttcacgtccagtcctcaaatgttagaatacttgtttcgccagcctctctccctctctttatcactcccctaaagattttttctgaaacacttgagagaataagttatatccataactctcctttacctctaatttagtgtatatttcctaaaaacaaagatattgtcttatattaccatagtatatgggtaccatatactggccttctctggctactgagtgctagcattagtatataagagtaccttatactcttatatactgtggtagtactgtattacagtagtctaattatccaaatcaggaaattaatatcgataaaattgtgttatctagtatgtacaccttattcagatttcaaattttctcacttatttctgggtccaagattcaatctaagaatatacattgaattaagttgtcatatctctttagtccactttaatctaaaaagttcctcagttgatctctgtcttccataaacttgtcagtggagaaacctcgcacagtaactgacctgagcttttcaacaatgtcaagctcaagaaggacaaagcaagactgagacagagatttagttcagtgagggccagtaggattgcatctgaaaggggttagtggacctgtatgcggattcagatcaactggtgttggaagttatgtagagatgtcatggcatccataagcgcagggccttgtgatgctcaaaaacatacttggattggatcagtgttgtttgtcacaaaaaaggcaacttgttctttgagaagcctcattttttattttttaaatgttgatttttttatgagtagttgctgtgtgggatctggatataaagattaaattctcatcagagagggagtgagtgatacattatgttctttgctgaaagaccatgtgtctcggaggctgaagcaaaggaaataaacacactctcctggtgtttatggggtttcctcattgttccctgatataattcagtttaagagttggtgacagaagcagatgccctatattcatgggatgttccatctcacttcatgacttactggaatcctaatttttaaaattttcacagtggaattaagacataatggatgactctagccagacatgctgacacatgcctgtagtccagctgcttcagaggctgaggcaagaggatcatgagcccaggaggtcaaggctgcagtgagctgtgatggcaccactgcatcccagcctgggtgatagagtgagacactgcctcaaaaaaaaaaaaaaaaaaaaaaaaagagagagagagaaagacataatgggtgattctgttaacttttttcttgttttcatgtgattaatatttcaaatacaaatctagcgtatttgacaaaaggtgtctaacggagacttattttcaaagatatgtcccccagaactgtgacagaaatagcttttcctgtttttgcttgtttggatttttttttttttttaatttggctttgagttagatgtttggcttgtatagaatggaaagtacaattgaatagtttgcagtgaatttgataagccagaatgctagcactcagtagccagagaaggccaggaaggcactctaagtgagacatttcagctcagcgtcccctccttccgtgaccagcaagtgtcgtgacatagtggatattgtacttctacagcaacagataactagtaccaacagaatgtgtcccatagagagacctttttcctatattttgtgacatgctttctttccttgtggatgaaacacttcattatttttccttcacaaaacacggtgctttttgactgtgttttcagttgctatccaaacactataaataatacagctaactccccaaagcgctattctagaggttctgacacatagagcttttcttcccgttgctgagaatttttctgctcaactcacctagggaacctgattgcagtagtagactgctgtcaaaagtggagcttcaagcaagagtttattcctttcatccaaatgtaataccctcattctgatttgtagtgtacgtttcatgcaggctggaatgatagctagccccacgtaccttcctaatagcatatgctgcaacagaaggacccatcaaccttaatgtcactatttctccttagttcctcctatatacaattaaaatagtttcccacctgtatttgttattctacactagaaacataatacatcattttggaaatgttaaaattctgactaaagagaagactaaaacttgtgttaaagtgtgtgtggtatgccttaagcatcgggataactgatacttcataatttgctccaggctcaagtgttcaattccaagtcacttaaatactcagcatgattcatctatggtcatagtctccctaactgaaatagtgtcataaataaaatcctcagtgatttttaaagcctaaaatgtttggtacactcaaaatattttaactgatattttaagcacacttagtagctgtattactttgagcttgttactgaaactctctgcatcaattcaactgttaaatggggatgataatgtgatgtggcttaaatctgacttcatttgaagtccatagcatattttctgtcatataatgagcacatgctgtcattgtggagtgtgattgttcacaataaccagaacagtgccagggtccatttttctctgcccagagcttaagcaaggttaaacattgctcaccattgctaggacattgtcccttgttgtcttgcacttggctgtttattatgagtgtgcttgtttaggaacagaatgttttctaaactcatcctaatctcactgctttccagcttttacctgtgctctttttccttctaaagaaattattagtttcctcaaccacagtttatcacagctgtcagtaaaacttgagcatttctggaaatgtatttccactgagctgttgtccagaatgtcttttgttgggtcatttgctagattagaaaaacagacaaacttgtagcattatttctaagctgggatctgttttttaaaaaatctactgatgtaaaggaaaatactgaatagagagggtgactaaaatatttctgtatcactttctggggtggagagtaggcaagcagtagcttctttaggaaccacagaggacgggaaaagctgcagtgtctcctgtcttggacttcctgtcttgattcgaagggtgggatatgatgagcgtgacttgccggcaattttttagggggtcgcagtagcacaggtgctggctgtgtcatgaggcttggtgcctgggaggactgccctgagagaaacttctccatggaatgtgttcacagcatttctcctccttgcatcagagaaagattgtgtggagcctttttctcccactgtgctgggaaacatagatggtttcttgatagaacttaaaaataaattttattttcacatgtatagaattcagttattacagatgatccctttctttctttcttttttttttttttttttttttttttggggagacagaacagaatcttgctctgttgttgcccaggctggagtgcagtggcacgatcttggctcactgcaagctctgcctcccgggttcatgccattctcctgcctcaacctcccgagtagctgggactacaggtgcccgccaccacacccggctaattttttttttgcatgtttttagtagagatggggttttaccatgttagccagaatggtctcgatctcctgacctcatgatctgcccacctcggcctcccaaagtgctgggattacaggcgtgagccaccgtgcccgacccagatgatccctttctatggctgtatttttaaccttttcattgctcccacccagaagatgcttcaaataatagagaatctgcttgattgcatccctggaaacacattagtggtgataatgttgaaaggggaattggacccgttagacgttttaacttcatatgcttcttaatgagatttcattttccccttcattttgcatggtttgttacaggttgagcatccctaatttgaaagtctgaaatttctcaaaatctgaaacgttcgagcaccaacatgatgccacaagtggaaaattccacatataaggccttaacaaaattatgtaacatattatataaaattaccttagagctatgtgtataagctgtatatgaaacaaatgaatttcatgttcagatgtggttcccttccccaagatgtctcatcatatatatgcaaatattccaaaattcaaaatctgaaatacttctgaccccaagcatttcagaaggaatactctgtgtgtatcacaaagaagggcactttcccttggggttgtttttacacctttgcttatggcatgtgagtttgccaagtttcttaagcatgttgtgatgggagtagtagcttgtagttgtatggcatgcattagactatgacagctaaggccatcttgagagctgaactgtggcagttacatatctgtaccagatctttaaaaaggtaaaggatctgtgtgaccaaagatcaaggtgggcctctggaaagttaggcatcagtgctattgaggatattttatctctgttttctggatttcttctctaactatgatgggaatttactgaaatatgtatgtgtgtgtgtgtgtgtatatatatatgaatatatgtgaatatatatatatattcttagcacagttctgtttggaaaagataacattgacaaatacatcagaacaaaaatgtaatcagacttctttttgacatttttattaaattgtaagactggaaaacatgcatgttcattaaatgcatatataaatataaactttaattcaattaccttgtaaaattgaattgctctgttaccagaacatttcctttatatcatatatatgttggaaatttccatatgtcagggatactctagacactcatcacgtaagatttttccttatgatccatgattttgtgacacatgaaggagatgttcttagattctgagtaataggggcagcttattttcattttctaaatctgtttgacatttggaggcacatcagaacacacattacagtagtatcttacttttgcacaagactctgcctgagaaactagtgtgtatttgtaccaacatttctttgatctgttacttggagtagctgcaacagcaaatagtgatgtcacttagcatttatctggggtatggagtggctttcataataggtaggtacagggctttttctctcatttcatttaggacattgagattccagaaagtctgataaagggaagttcatttattaatgtgtctatccagtaaatatttgagtacctactcttttccgtacaccaggctagaccatggtaggaggggggtgaactcacaggtagggttcctttcctcaccacatttacagatgagagcaagtgaatctaatagaaaatggtaaatgcagcaacttaaacatctgatgttataggactgacagacctaaggggtcagaaggctgactaaggaaaagtaatattaaagtttggaccagaaggaaactgggaattagctgggtgaattagtatgtggaaagcaagactgaggaatttgggcctcttgcctgagggaattggaatcatttacattgattaagttggtcgaataatgattagaacacttcaggctgaccatagtgagaatgtattgggaggagagattggatcagtagaaggctttttttttttgagaaggagtctcactccatcgcccgggctggaatgtagtggcgctatctcggctcactgcaacctctgcctcccgggttcaagcacttctcctgcctcagcctcctgagtagctgggattacaggtgcccaccactatgcccagctaattttttgtatttttagtggagacggggtttcaccgtgttggccaggctagtctcaaactcctgacctcatgatttgcccacctcggcctcccaaagtgctgggattacaggcgtgagccaccacgcccagccagtagaaggcttttgcaggattcaagttacagtagtagacaatgtcctaaaccaaggcagagagcagtggcaataggggaggaatagaggttgagctggaagacaaagtgaagaagcctgagtgaagtgtgatataaggattcaggaatggtgcccaggtttccattttgattaatgagttagatgttggtaccactcactaaatgaaggaacacaggaggaggaacaggtctgcaggaaaagataagttcacttacctgcttttggagctttagctgcctgtggaacatccacccacaggtgagcagggagaggaatgagcctagatctaaacagagatccggcttccagattagaaagatgtgagtcaccagtgtgttgtatgcagatcgttgttaagaggtggagtgaattaggagatttggggtgagggagaagagagccagatataaaatcctgaggaacatcactactagatgtttttagtatacttttaaggaagagaaccccaggtatgaattgtgatcattcttattttcataatctaacaggtatgtatttattagccaaattttttagaaactgcattagaattctgtatattcagaaatggagatgagaatgtaaacaaattattacatcattcacctagacagcatttcccggaaccgcataggccattgacattatgctgtttccccatgtgctgaaggccctggcataatccgagcatgctctaatgtcttctgtgaacctccttctcagctcagcagcagatgcggccagcaaggcggatctccatcagcatctctccgctcctccttaagtctaaaactctcttttctcttggctcttcttattcgagtgatgaggaggaggagttgcatagtaagtaagcaactttggtgtccagtgactgttcttgaaggtctgaccagctcagaaaatgctgtaggcttggtactaagaaattgtatgggggcttttagcctcttgcatgccatcctttgtaagtcatttgtctttatgcttgcctttgagaattggtttggatagaacatttttttgtcttctgtatagtactaacgctgagctactggcctcctgattccagggcacaagataatctttctagcacacagataccctcaaaggtgtagggggtgtgttcccatcccattgtgtactctttctaataatactgtatgctaatttcacaaaactttttatttgacaatgtaaattttattttccttgttgtgttgttctgtctcatgggacagatatctagatgttcatctgtggtgtttaaaagctattgttacactttttttcttctccttttcagaccatttctttaaaaatacctttcctttaagattagaccccatgaattagagggagggagttatatacgttttgtgagtgtgtgttgtgttttttttttttttttgagatggagatggagtctcactctgtcgcccaggctggagtgcagtggcgcgatcttgcctcccaggttcacgccattcttctgcctcagcctcccgggtagcctcctgggtagctgggactacaggcgtccgccaccacgcccagctaattttttttgtatttttagtagagacggggtttcaccatgttatccagcatgatctcgatctcttgacctcatgatccgcctgcctcggcctcccaaagtactgggattacaggcatgagccacagcgcccagccggagttatatacgtatttatctcctactttctctctccttttgaacttttatttttacttctttggataagctgtaggcttcagatgaatacattcttacttgataatgccttgtataaaaactttacaaggtatcaattttagtaaacttggaaaagaaagaaattcccccttcatgaaaattacagtcttcaattgtgcaagatttctagaatattccaggattgcttttaatggagaaaccacttataatagaaagttaaataaaattgtttttatataactagtattatgagtctgagacaattaccatacccatatgattaggcaccctaattccctaccacttgctgattctaagtttcagcaatattaagtgtttctcaagctggcattttcacactattcttaaagggaagtgccttatgcacaataagacagtttagttaatttggttttaaatggtggccttattaaggatttggtatatttttcactaataaaagatgtttgaaaaatagacacagaataagatgatcccagttgtaatagaaggaaggttgtgaaaatccactctaactttgggtattcagaaattttcaaagctgtttcatttcagagtatttgtaataggctgggtgcagtggctcacacctctaatcccagcactttgggaggccgaggcgggcggatcacttgaggtcaggagtttgagaccagcctggccaacatgacgaaaccatgtctctactaaaacaaacaaacaaacaaattagctgggcatagtgatgggcacctgtagtcgcagttacttgggaggctgaggcaggagaatcacttgaacctgggaggcagatgttgcagtgagccgagatcatgccactacactctagcctgagtgacagagtgagatcacttcatctcaaaaacaaaattaaaaaaaaaaaatcaaagtatttgtaatataccgggaagtagccaggtcagcatggcaaataaaccaaggtcccagtcaggcacagtggctcatgcctgtaatcccagcacttttgggagactgaggtgggcggatcacgaggtcgggagttcaagaccagtctggccaacatagtgaaaccccatctctaccaaaaatacaaaaaaattagccgggtgtggttgcgggctcctgtaatcccagctattcaggaggctgaggtaggagaattgcttgaacccaggaggcggaggttgcagtggccaagatcatgccattgcactccagcccaggcgacagtgtgagactccatctcaaaaaaaaaacaacaacaaaaaaccaaggtcctgctaatacagaattatgatcctataacagcactggtcattcagttaatccgacacaatggaaccctaaaaatacggaagcttgcagaaactttttgaatcaagtatcttctcaaaatgtgttccttaaattcaaaactactagtaagaattatgtgtgggcagggagaaccaaaagaagggaggggttggttcatggccaaatattagtaaatttaggaaactctgggttaagcaggtttaaaatgctaacgttgtgttacgttgtggattttcaaggcagtgttcaatatactgtttctcccaaatgtattaactagaaaaccacaatatgtgcagcactgtatacaacatttcatgaaactggtgttccacggaacacactctgaaaaatatcaactgtgtccatccagtagttccaccctgaagttcctggctgtagtataaatctgcaggttatttcatgccttgaaagataatctagttgaaatatattatttacccacaataatactttgcaggctaactttaatgacaagtttcgtttcgtttcatttattttgtccataattttgtcatggaagtagcattggttgttttctacccttaggtgctctgaaaacttgatgatactttaggaatttcagaggcattggtggattaattactgtgttcagaaccacatctaaaaggtcatcataacttaactaaaatttttagcagtggaaaagttgaaaatattataggagtcatagattctcctagtactcaatcacatatgtgttcagtctttaatttattccacacatatctgctggaagcttatgattggccctgctttgtgttggttggtatttttctgcattatgaattttatttttatttagttcatattactagggtggtaacttactaggtaattgcttaaatgtatagtagaatccaggcaagcttagaaaatttaatgctgctcctatcactgaagtttccttgggcagaaaaggttttaaaaccactgatttaaactatcctcttgattttttttttaagtacactaatgcatcataagattaaaatgctgatattttacacctagattatgcagaacctggggatggatcccagatattcttatgctgctaatctttccctcttacctggctgttgttaccatgtgttgtaagtgaaatgaacagaagaagaaccctaaactgggaaaaaggaaaaaaatacggaaggcaatcttttgaagacttagaatttgttttaaggtttcttatgtattattcctacctgttggcaatttaaatttagccaggtgcaatggctcacccctgtaatcccagcactttgggaagcggagacaggaggattgcctgagcccaggggttcaagaccagcctgggcaacatggcgagtccctgtttctaaaaaaaatttgtaacaataatagataaaaataataactacagttttggatttctgttcagaatctggaacagtttgagagttgaagagtttcaaatgcgggtaatctgggagtttttttgtttgtttttgtttttgagatggaatctcgctctgttacccaggctggagtgcagtggcgcaatctcggctcactgcaacctcgacctcctgggttcaagcaattctcctgcctcagcctcccgagtagctgggactacaggcatgcgccaccacgcctggccaatttgtgtatttttagtagagaaggggtttcaccatgttggtcagcctggtcttaaactcctgacctcaagtgatctgcctgcctctgcctcccaaagtgttgggattacaggcatgagccaccgcgcctggcccaaatgctggtagtctggtagtagaacatcttcaaatctctatcagattaaagttttgcttacagtaatctcagagatccttgaaaccaacctcaaggaaaaaggaaggtgttttgtctaaatcgttaaaatagtgttacagagtaacctttgtttccctggaatatacatggaaatagttctataactgatgtcctgaaaattgaaaatcatttatcactgtgactgaggtcttgctctcatctaagtcttcagtaactcaatctttattaacatgtggtagataaaaataataatattccttctattttttcttcatattgccctatctgacatagtcttagaattttaatgacctgcggcagtttatggtccagtggttgtggaaggaagaagtacgcatctgcctcattcatttttatctctattagcctggaaaggactttgccatctgttttatctccctcatttcacagatgaggaaatgaaatccaaaggtctcatcccaaattagtgacagggcgaagacttgataagccagctctgatgctctttcctgtttgctaatctatttctagcaattctcatgaaaatattagagatgagctagatcttatagaaacatataaaagcagtattaacggataaaatatgacatttaatttcctattctatattcttcctatgatgtcatctcagaaggatggtttgtgcaaactgaagattgataagaactggaattaaacatgcttcatatgtgtttaagcattagaaaaagttatttggagtctttttagttacttgaatcctggattaaacttattttcttcatgagaaattcactacctacttctggttctaatttgagggtttcaagtttaatttttccttctttcaaacctttagaaggaggaggtaccatgtgctgactttcacacgctgtttttgctttagctgtgtcattgtgaatttataaatattctacccggcatcagtgttaaattttttggttctaactttttttctgccttgttttctagattcacggcccttccacagtaccttccacaataccagtgctaatctgactgagaggtactataaatttgttactcctttttccagaaataaaatgaagaaaatttaaaatctcttaggccatttaattacgtaaactaagttaattgagcttattgggttcttctttgagtgataaacttggaataatgattaaaagtggttttgtcatgaaggctataccttaaagttaatgtcttcagtagttttattaattatactgtcctcatgataaaaattggttgtatttattgatgtgagggtacactattatttgactttatgaacttgtgcaccctttgcttatgggatttttaattcctaaatctaacagtctaaacaacattttgtttcatattagtgtctgtgtgtgtgtgcaatttataatagtcttagctattttaagctttaaagctgttttcttctgtatacatgtaaatgatacatagctctgtcgaagtaaacgaattgattcttttttttttcttttgagacagagtttcgctcttgttgcccaggctggagtgcaatggcgcgatcttggctcactgcaacctctgcctcccaggttcaagccattctcctgcctcagcctcctgagtggctgggatgacaggcatgcgccaccatgcccagctaattttgtatttttagtagggatggggtttctccatgttggtcaggcaggtctcaaactcccgacctcaggtgatccatctgcctcagcttcccaaagtgctgggattacaggcgtgaaattgattctttacttgacagcaagcaaaagatttctgttctgactcattatttttatttaggttttcatgcttatgagatagaatattctacttgaagtttaattggggttcctatggctgccctgcagttttttctgagttgccttctttttcacagaggcatcagttatgattctgatttagaacccttgcaatgaatgcttctctttgcactgcttttatagcttattctttctcctttctacagcagtggttttcataccatttcccccttatcttaaaaacagactgctgtattttgtaaacaatgcatatataaataaactgactgttgacaggaccccttgtggtgctgcttctgcctgccacctgccctctcacagaggccctagaggcaatcactgctgttctgtgggaaatgtctaaaatattttagaacacctaagcaaagtagtataaatggatgccttttctatataacggattgtttatttgaatgcccagctgctcttttgtttgtttgtttgttttgagacagagtcccactgtgtcacccaggctggagtgcactggcacaaacaatctcggctcactgcaccctccacctcccgggttcaagcgattttcctgcctcagcttcccgggtagctgggactacaggcgcgtgccaccacacctggctaatttttgtattttttagtagagacggggtttcaccatgttggcgaggctggtcttgaactcctgacctcgtgatccgcccacctcggcctcccaaagtgctgggattacaggtgtgagcaccgcacctgccccaaatgcccagcatttaagaaaatcaaccattgcaaattacctaagttagaacatgcccatcttggatggacttagattttatgtaggtttcttgaacaggtagatcactgaatctacataaaactcctaaaattgatctttcaacactgtgcctcaattctgtctgctcctcagtaagttccctcctaaaattgaacctagctgcatggaccagtccacagtcctgattgtcccgtgtgccaaaggctagaaaaaagttgtgatctctaccgttaaggaacttggatatgtggtcagtcataagattccttggtttgcaactcctattaacaagtaccctgtcattctgctacatatatgggtttcctttcaagcacccatttgttacaaaggagtttgtagattgaatgctattgtagatgaatagattccatataaaataattactgaataattgacaggctctttttaacatgaggtcactgaaaatccataattaaaacattaaaaatgggccaggcggtagctcacgcctgtaatccaagcactttgggaggctgaggtgggaggattgtgtgaagccaggagttcaaaatcagcctgggcaacatagcaagaccccatctctacaaaaaaatttgaaaaatagccaggcgtggtggcatgtgcctttagtcccagcttactctagaggctgaggcaggaagattgcgtgagctcaggagttcaaggctgcagtgagctatcatcacaccactcagagcaagactgtctccaaaacagacaagtgaacaagaaaacattagtgacggatctaaggaaacttagccaagttttgataacagaacctgggcgttgtggcatactctataaaaagccattcagcagccttcatctaccttttattctgcttcacttttatttaacttctgtagccctttaaaaaaaatcaatcttcttgtttttatttagtataacagaagagaactataatttcctgccacatagcccctccaagaaagattctgaatggaagagtggaacaaaagtcagtcgtacattcagctacatcaagaataaaatgtctagcagcaagaagagcaaagtgagtatcactgtgggcattgcttgtgatcacctcagtaggatcctgtcacagcctgcattcacaccaaaactggttaaatcatggggacataaatggaaataaattcaggattactctccgaaatcgcctaatatttaaaggaaaataataagaagaaaaatagcaagaagtggaactaccagttactgagttttcactatatgctaagtgctttccatatattatttaaccctttcaacaaccctgtcaggtaggtgttatctctcttttctaaaagtgatgtaccttaccgaggatactcctctaatgtgaagaagtagttcaaaccagatctctttggtttcaaatcccatactcttaaaccacagtgcttaaatctgtaatatcagtttaaatgcaacagaaggattttatgcaaagatcaaaggattgaaaatatttatatttggctttagagggaaggattatcccacagaagattacaagaacttttaagactaatatgatttcttagatctatttctaattaggagcatttggaatatattctcttagtgattaagagattaaataaatgtttaaaccgtgtgtgtgtgtgtgtgtgtgtgtgtgtctgtgtgtgtgtgtgtgtaaggctccactgtatcacccaggctggagcacagtggcgtgaccatagctcactgcagtcttgaactgccaggcttaagcagtttcctgcctcgcaccgtagcctcccgagtagccagggctacagtcatgttgtgccatcgtgctgagctatgtttaaatttgtttgtaaagatgaagtcttgctgttgtgtctaggccggtctaatgccttacctcaaacactcttctcgctgcaggcttccgaagccctgggtgtgatccaccgtgcccagcctaaagtaacattttttatctaattatttttcacatgctcattatggaaatcttcaaaatctaaaagtaaaagaatgaaaatctcctggaataaccccgcttagagataactacacttaatgttttggtttatatatttctaatcttttttaaaaatgtattttcaaaagaaagggagaaaagaagttcactttcttatactgattcccagtgctaaaccaaaactgattccatttcaagtccgtggggaaaaacttttcgcctctcacaccctgttcatctacccacaacaccctctaacaaaataaagacataagtaaataaaaatttgaaatcagttaaggaactcttgcaaggaatcactgtgtgtgtgtgtgtgtgtgtatgtgtgtgtgtgcacgtgcatgcatgtgtgtgtgtgtgtggtatatacatgtacatacagatatatacacacgtagatacatgcatatttagaagtaagggaataaacaaacattgaattcaagaatattgtcataaaagggcattgcctcctccctcacaaaacaaggtgcactaagcttctcaagccctcacttcagtgggctgatggaaatatagccaaagtattttaccatgttttgtaagatctcttggtttagcaaatacattcaaagaaatttttccaccaaacgtgccacaagaattgtgttttcatttctcctgtgcaagtacagaatggagagaaagtaggcaatcagggagagatgcaaagagtctagcaaattatttctagcataatcacacatttaacttcagactcagccttgttttataattccaaaaaaaaaaaaaatgaaggtcaaagaatactgctttaccagtattctacgtatttacatattggcagccaggcttaaaatagagccttaccttttttacttaccactgccggcttggatactagttggtatcaacaaaagaaaatccccttggacagagcaatataaattagccaagtattattaaatgctttgtatagtcttagcattccactaggtgttaacaggcacctaagagaactaaagctcatagtcctgaccttgaaaaactttatgatctagtttggatgaattcaaaatgttttcattgttttttattttgctttaaaactactgaatcttgtcttcaaacaagcttttcgtggaagaccaataaataagtggagattccccctttctagccatctccccaatgtcatggagttttaggacagagcagtgaatgtaccactcatctcatggataaggtaaaacatacacatgataggaaaaaaaacaacgtaagatggaatttagaaactggaccctgacctttaaaaaagtctcagccctcagcctagcctccttattttacaaactgaggcacagagatgtatgcttcatgtcacacaacctcacacaacctcacacaacctcctgttatctgacttccaggaagtagtactcatcattttgtgtttaaacaaaatgttactatacagcgtaatttttttcttttaacttttttaatctgaaaggactggagtttgctaggaggagatgagcagaaaggacaggagaaaacatattttgtgttagaccgaaatctgtgatcactggtagaaacttttagtatcagttgacctcttgtctctgatcatctcctttgtcaaaatgacaacacttttttgcaattgagattggttcctctttcagacttggcttcaagatttgatctcttggggtcgtgctgtctttagcagtggaaactcaaaaaattacaaatttgtaaccctgaattgtagtccatttcccattaccaagtgtttagagtgccctagtggcaactgtaagtcaccttttatagtgaggtgttactagctcacttttaaataaaattggaacagcttggcttttgtcaatgtagcaaaagatgattttttaaaaggtgggggtggggcacagtggtacacacctgtaatctcagtactttgaggctgagatgagaagatcacttgagaccaggagttcaaggtcagcctgggcagtatagtgagacctcatctctacaaaaaaattgtaaaattagctgggcgtagtggcacacacctgtagtcctagctactcaggaggctgaggcaagaggatcacttgagccgaggagttcaaggctgcagtacgctgtgtgcactccagcctgggcaatggagcaagaccctgtctcttaaaaaaaaaaaaaaaaaagagagagagaggaaagaaataggggaaatagtaaagcagtatattttgtgttaaataccctcactctgctatgtatctgcatagcattttaccatgcagaagtactgtattttctaaatggtaacataaaaattaatgaatattaaattttcttaacatagtgatgctaactctaatcttgttcttaactattgaataatgttacttctccataatgttaacaaattgaaagtgctactatggatattgacactgatttttctgtgaaaatgataaattttcagtttttaaaaattattttttaaatagatgctgtgagagaccgtctgatccaattgttttattaatctaccatacaataaaactagacctacatcttttaaaggaaaaatttaagcatctaccgaatataatattaaaatgccacctgtaactcttagagaagtgtctaaggattatttgaaaatgtctgctttccttttgcatgatatatatatctttatgaaaataggttatagtgattaacctagatatattccattcagttgtataattgtgatgataaacagttcttaaacatgtccaaagaagccaaaagccagtaggcagtaaactgttcacattcctaggagggtaacatattttgtctggatcactgggttttgtatataaacttaagaaattgagtccttgatcctatgtccttttgagaattatcaccgactggcataagtgattagattagataaatatattgaatgtgtttgtggaagatgagaggggatgctaaacaggaagtatagcaggaagactggcagtttctgcttttgtcttagtatctttgagagatagtgctgtttcctgctaagtaattttgcgtgttacagagtatttaaacactcatatgcatggtgttcgagttcacaaagggagtgtggaatgaccctcttcaaaccatcctatcacactggttttcttttttctaaaccacagttacttttgcaccaacctaatactaagctttcctctttgtagacaaacaagaggtggttagaaatgttttagacaaatctatttgatttgaagtaggtatttttgagtgcacaggttaaattcctgcacagctgcaagtatactacatgactttgtaacaggacattcagttacagctcctaggtcctgtggtctgtataaaaaagagctgtacccataggcctttcagaagtgcctcctagagtagtgtttacaaagacttaattttaaatgtaattctcattccttctttgattaaagatctgtaacatgacagttgtttgatcatatcatgttttcacagttgtccagagtgttctttttattgtaattacatgtataaaggggtatttttggaaaagtgaagaatcacctttgatagtgtcctagtgcagttgttacctgcatctatccctgttaaataccgttagcctgtttctccagcacacagctaaagcattttgccagttgttaaacatggaaaagtcaaacttcagaaaataactagtcaccactttacaccaggcaacttcactgaaaagttttcttatgaaactcactgcattttacaaaatgaggagtctattttaaaataggtaagatgtgttccttaacttcccgtgtaaaaacttggcctcaaaccttgctagagttcttatattgctgcttaagcactgtccacacacactgtttttggggggagtgaggtctcgtttcatttcctgtatcctttgtaacaagggttgttggctttagcagcagcattcaaacagttaagactgtcttaaggaaacaagcagcctcagccctccctccttccctttctcagccagtctctggcttcctcttacgatttcactaatggcagctcaaagctgctgagctctgccctgacggcatgcgcccccgcttctgtgagagcacgcttcctggcatgggggtcgaatcatgtcgataaaatgggctcggtttcatgaagtaccccacataacagtgagattcataggaccaaagcatggggaggtaagagcctgacttctttaaagcactaaattctagtaaacacagaaagagccagtggagttggttgttttgttttgtttccatcctgggaagaactaatttggattgttgcaaagggaagctatttcttatttattcaggtttgaagagcattgcaaggcttgagaggataagctggttgccataaaaagattttttaaacgattgaagtataatttaactttcctgagcaaaaaaatcagatgcttttccatttaacattttatgcatggaaaaacctttagcaaaatttagttaaaagaaagaaattatttgaaaaaacccaaatttagttgttgattattactaaagttttatgtactttagtgattaccaattttcactcagaacagcttcctgttttgtaaagtgaaggagtttttctcccttcctctctcattattttttatagttcaaaagtgtagtaatttggctcttagatgttcattatatgtatttgattaacaaaagacttcacatgaatcatagatctagcaattatttaccatttcattacagtggttgggttctgaacagaaagtcagaagacctgggttcccattttgactgtgctgatcatctgttgtgtgaccttttgcaagtcaaccaacctctccagtccctggcagcatagtgcagtgtatgagagctgagctttacagtcagccagatctgaatcttaatttcagcttgagcagttattggcgtgtggcctcaaatgcattattaaacatctctaagcttcaatctcttcagatgtaaaatggagataatacctagtattatcattgggttgttgtgagaaaatacatgtaaattgcttactacagtgcttagcacgtagtaactgttcagatttttagctgttatttattatctttatcctctacgttgtaaaatgggaagcataatgctcaccctgcccacttcagagttattgagtcagacgaaatgatgtatgtagaagacattgattcaaaatgttaaggcatttagtagttgtcatgatcactgacttgggacacccattttcctggaatttttttaggacataacaatggtattgacaataggtaaaacctcttaccttgtgaatggtaggtctttgtagtccagttggtttgaaaggaaattatttcattgatactgataagccagccaagtactctgccaaacagtgcttctaaaggaccttttatggagagcatggttatatccccatggtcctggcctcctaaggatggtgtccacctgaaatgtccctgactgctttagatatttcattaaggacccaccactcatcagtagttcttcaagttttcagtgtttgaattcctttccgttcctcttcatgactgtgtaagctttgacaacagcctctcttagattgaggcttgatgtcatatgagtcctctgctttcagtctgtctctagaacatttctgacattcctgcagtattcttaaggtgacatggccaacttaatctggcacttagagctcctgactctcagcccagtgcccccactgttcacccagtctcatgtctcatttgctggtgtcccctgtgctttgtacctagcccggttttggcctgctcagtaagtagaagcacctgggcagtggctgggcacacaggaagcacaagatgagtatcagtttctgttgccactctgacaagtgagggaagaccacaggaaagaaaggagcttcacaaaagaggtcagagagcacggcgtaggaagcttatctttccaacctagggacactgcctgcttttcctgccttcctgcacccctaggtactcagggtagaggagtgagctactaagccttgggacttcctttccctggaaccccatttttttaaaggaagtgaccctgttggtatctagcttgaggaacaacaaaggtggtttttgagaaaaattattaacaaggctccttcctgtcatccgtgcattctcctatcctccctgccctgcaccgttgtcctttagccactccccaatttcttctatcttccctgctcacatcaaaacttcctttcccttactgcaagcaatacctttctgtgttggcttaggagaataatgagctaatgaaactcatttccagtaaattatgagtaattaataatattgctaagcattattgtgtattcactgtgtgccaggcactgtgcaaaatgctttagaaatgtattatctcacctaattgtcatatgttttaaaaaacatatgagatgggtacttttgtgattactcccatttgacaaatgagaaaactaaggctcagagaaataatttacctagggtcacgctattactgagtagtagtagtggtggtggtggtgatggtggtggtggtggtggtggcagtagtggtagtagtggtagtagtacctgaatctgaaccgaggtctggtaccatcgtccgtattcttaaccactgtacggttttccagcctccccttcttatcagtctcctcttgccggtttgaaaattagggcaaagttaatatttacaaaccttaaaattctaattagcagaaactgaaaatgtatatgtggggcatatttaatatttctaactagagtaaaggaggagactttatacatactccgtcacttagggatatgcaattgatgtgagaaagagaggagcctcggtaatttttcatgccacccaggcatctttttttccctcaggctgatcccagaattgctgccacccttttttctgccctctgcctaaagctggccctaaacccatgactctcttcctgtgtggactgtgctgtagcttgctgaggaagggctgtactgaggtgtcagaagcctccttgcagtgctggtccttgggtattgtgtctgttggtagaagtaaccaatgaataagccactgccagaactgttccgcctgcccagttttcgtgtgaattttctaatgtagcttgcgtgccaacgccttaatttaaaaaaacaaaacaaaacactttgcccagaactttgtttctcactcctttccaaaatagtcaccagctgttgttaaccacatgccatctgggtgcccaggtaaggagaaagccctccagtgttcaattaactgtggattattttcttttcttcggcaggaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaagtaagagacatgcttcttcctctcgtaagatggaactctcttggctcaagaaagctcatttcttgtttcctgtccccactcattatctgttcctcatttatgtggagaagtaaccctttttatatctttctttagacatgataaaagaaagaaattctagatgtataacatacagcctatatttttttcagacagccccaatttcaaatacagtcaagttaagatggttcagcctagctttttaactttacagtggttcaaaagcaatacacgttcagtagaaactgtactttgagtgctggtacactcatttcgtttttcacatttagtgcagtattcaataaattacatgagatagtcaacactttatcataaaactggctttgtgctagataattttggccaactatagtctaatgtaagtgttttgagcatgtttaagataggccaggctaaactatgatgtccagaaggttaggtgtatttaaatgcatttttgacttaatagtattttcaatttaccatgggtttatgtggatgtagcctcattgaaaggatgaggagcatctgcactctgttctatgatctctaaaccactgcacgttttaaaagtctgtgtcagcatcaaaattatccataaccccaaaccctaaagctactcagtggtcttctgttagatcatatgtgctcatttttattctattactttggtatatgcttcagccattaccaacattaagccatagtgacggccaagggagagcacctccgtgctcagggacattctgtgctgacctgctgaaagccaagtctgctaactgagcattgttcctggttttgataagacactctcaggcaggagttgcttaactttttctgtacaagaccagataaaaagtatcttaggcatcgtgacccacatggtctctgtcacaattcttgaactctgcagttgcagtgcaaaagcagccgtaagcaatacataaaccaatgagtgtgattccaataaaacttcacttatggatactgaaatttgaatttcataaaatttttgttatgtaatagttttttgatttttaaaaactatttaaaatgtaaaaattattcttagctcatgggctatacaaaaataggcttcaagccacatttagcccacagaccataatttgcacgtttttgctgtaaggcagtgcatctcaaaattttgtcagtgcacagatcaaaagtagtatttgtagagcataccagggtaaatcaaggaggctgcttctggtcagaggtgacagtctggagttccagccagtccagggccagtccagtcacccggaaggctgaggtaattaacatgatactatatctataaccaattcagatgttatagtgacgaattcagatgtcaaggagcaactctcagaccatgatgtcctgaaatcttgttttcagtcatttatgttggatatcccaagtaatttcttactaaaaatagttaacttactgaaatctgattttttttctttttttttttgagacagggtctcactagttgcccaggctaagtcttgacctcctgacatcaagtgatcttctggctcagccagcctcctgagtagctggtattaggcatgcaccactgtgcctggtagaaatttgaaatgtttaaaagtgtatttgggccaggcgtggtggctcacgactataatcatagcactttgggaggccgaggtgagcggatcacctgaagtcagaaattcgaaaccagcctggccaacatggcgaaaccccgtctctactaaaaatacaaagttagctgggctttgtgacacgtgcctgtaacctcaactactcgggaggctgaggcaggagaattgcttgaacttgggaaggggaggttgcagtgagctgagatcgtgccattgcactccagcctgggcaacagagtgagactccatctcaaaaaaacacacacaaaaaaacgtgtatttggacagattggaagttacttctgtgatgattttcactcactttcttgcttggaagaggaggagtggagttacagctagcacacagcctgtctaatctgtgctacagttcctgtgactttttgatatgactgactttatgacacacattcatgtaaaatgatttttattggatgttacacccccaaagtagtcagcaacactatttgttttactgtcctattttttcaaaagtaaccaaaaaccatgagagctctcacccgaatcctcatgcatccctgtgggcagagatcacacacattaatgtcatccttcatttgtgacttaccagaccattgagagccactaccacataataataatttcatgtaacctctaggaaacaagagactgtcactgttcagtattcctccagtgtttattttggaacccaggttctaataggactcttctgggacaccagtcggaggtctatagtttagttttttagccattggacacagttagcttcttagtactggaataacctggttgcctagagcagtaatcaccaagcattttatagcatgttcacctattattaaaacatttttagcatactcacataggatacatacataacataaaaattacatacaagtcctactgtgccatactttccaagagctcattctaaaaataagtctcagaattgccattttcttgttttctggttagttattagtatgattagtattgtctttgattcatgacttctttgaaggaatttgtgtaactctcatcattttcatttgattttagtggaaaccaggtaatataatccataagcccactttattggatacctgtatgtttccattcatcacaacatgctgaaagtaaacaaatgtggattatgcatgcccagcccatctcctgagtgaagaataccccgctcccttaagaaacctctagtgtcacatataaagtgaggctgcctaacataaagactgagcgaggcacccacttatcaattagacattaactcaatttttcttctacgttaaggagtcattttaaataagagctgtaaaatcttcctcctgtgttccaagggattgttttttacatccctccttgcagtgtgccagttcttcttttggagagcactgatctcagaaaaacgggaagaggctgtatttcttgattggcagtatgaaattaatattcagggaacttcatcagtaaagcagactagatacctgccttctgctataaaatataaaatgctaaataaaatctattttttaaaaaattaatacatagctgaacctgccaaatagaaaattcctgagggaactcagagcagtaaagagcatgccccctcatttggggtcaagatatgcggcctcagggtatgtagtgggagctgggactgagacccctgtataagaaatgctgttttaagactaacatccatgatgaagggccttggaaaattctacccagtggccttcagaagcagaaaggaaccttacagtctccccaggtccctgagtgagaattgatgaatctggagtccaagtttacaccgtctgtatgtgctagaacttcaggctaagaaactttcacaagaggttacatgaaattccagtttaggaatgacagatccttgagggacccagcctgtagcagatgtagaactgctccattgggttaggttgacaaatcagtatacccaaggctacggcaggaggaataaaatcctatgaagccgagctcatgataaaagatacatagatgccacataaggaagtaaaccaccatgaggaagaattaggggatgtacaagcaagagatgttgaaaatcactaaaaggggccgggcgcagtggctcacgcctgtaatcccagcactttgggaggctgaggtgggtggatcacaaggtcaggagttcaagaccagcctgaccaacatggtgaaaccccgtctctactaaaaatacaaaaattagccaggcttggtggcgtgcgcctgtaatcccagctattcagtaggctgaggcaggagaatctcttgaacccgggaggcggaggttgcagtgagctgaggtcgcgccactgcactccagtctgggtgacatagcgagactccatctcaaaaaaagaaagaaaattactaaaaggatgaaacgaatagaatctataatggaagaaaaagacgtaacaactaatgggtagatttaaaaacaactgagtaaaatttaaagcatggaaatagtcattgaaaggtattcatggattttttcaaatatttcagcatattgtcctgatttataattgtttataaaggaataagatggcttctactctgttgtctgcattagtaaggggagagcttcagtctagaaagtcttaatgacttcacactggatttgttttttacatttaatcataaataattgtacccttaagtccttgatcttatatgaagtcaatcaacaaagttcatttgactgaattctgcaagctactgtgtttgatatgtgattcatacaaaagcagtttgtcaacaaatatttattgaatatcaatatgagtcaggcacccacagtggcttaaaaaaaggaattctaaaatgatccttcgtacttatttattgtgaacttgtttatattctggaaaaattgaaagcaatttaaatatccatccataaaatatagtatattttgtatagtatatagatggataggctgataataaagagagaatataagggccaggcacggtgcctcatgcctgtaatcccagcactttaggaggctgaggctggcggatcacttgaggtcaggagttggaaaccagctggccaatgcggtgaaaccccatctctactaaaatacaaaagttagtcgggcatggtggcagtgcctgtaatcccagctacttgggaggctgaggcaggagaattgcttgaacttgggagacagaggttgcagtgagccgagattgagccactacactccagtctgggtgacagagcaagactctgtctccaaaaaaaaaaaaaaaaaggagagagagaatataggacagatcagaggttgccaaactttttctgcaaaggaaccaatggtatgttaggctttgcagcccatcaggtctttgtcatgactactggactctgtccttgtagcacaaaagcaaccatagacgatggatgtgactgtgttccaataaaaatttatttacaggcctggcacggtggctcatgcctgtaatcccagcactttgggaggcctaggcaggtagatcacttgaggtcaggagtttgagaccagcctggccaacatggtgaaaccccgtctctactaaaaatacagaaatcagctgggcatggtggtgcacgcctgtaatcccagctacttgggaggctgaggcaggagaatcactcgaacccaggaggcagaggttgcagtgagccgagatcgagcccctgcactccagcctgggaaacagagcgagaccttgtctcaaaaaaaaaaaaaaaaaaaaaaaaaaatttacaaatacaggctgtgggcctaattcagcccaaggaccatagtgtgccaagccctgggagagatttgcaggtgcagacagagctctccaagacattttgatgagttggaaagtcagtaaatagaacaatatatacagcatgatcctagtttatggaaaacaaacagtttatataaatttacaaaaatatgccagggatggtggctcacagctgtaatccctgcactttgggaggctgagacgggcagaacacctgaggtcaggagttcaagaccaggctgggcaacatggtgaaaccccatctctactaaaaaacaaaaaattagctgggcgtggtggtgcatgcctgtaatcccagctactcaggaggctgaggcaggagaatcacttgaacccaggaggcagaggttgcagtgagccaagatcacaccaccgcactttagcgtgcgcaacaagagtgaaactctatctcaaaaaaaaaaaaaattctttttacaaaaatatctgaaaggctatacaccaaactgttaacaatctgaagaaagagaaataaggagaaaaggagttgaagaggactctttattttattcttttagattgtttgaatttttagagaatgtacttacatattatttgtatgtctaaaaacaaaatgtaaatattggaccactgatagtttcaaaggtttttctagttatttatcagctgatctctgatgaaggcacaaaataagttggtatttgatttgagaatttaatggacaaagcagaattactaccagaacagagtaagcttataagccttgaggagagttgttctaccactgttattgatagcaccagcttgaatcagaagtagtatagttgatctaccaactctcagttctggattgtgatgtgaaacattatcaggagatttaaggttgaaagttatagacagtctttttgaagacccaaagaatcttgtgctatagaggacaatagatttaagaaccgttggcttatggttataatgagtggctgtacctttccatgactagctccagataattttgcaattttaagttcaggctaaaagaagttgtctaatatatgccagtgtatatttagccttgtattgccattgacttgtgtatatacattatttctaggttacaaatagttgaaatttgccctctttggctatattaagtctttgtctacattagactatcactcagaattaaacctgtaactggcatataataaatttatcagatagcagaaatattcagttaatgtaggagaatgcacaggcatcctaagcccatttttgctttcttgatatgtcttcctgttaaacatgatagaaattctcttttactggactccctggatgatgaagcacacatagctaggacaccacaagttattagactccttatgctatcagtgtcgtatgtgctagaaccgcctctggagagcaagatctgggttacctcttggagacttccattgcccaacgatgccagaggtacccgtggagaatcacttgtgtagggtttggtattgactggggaaaactgtaggaaaggtttgagggtctgagattctcagccacacttctgtgtagtaattagtttaatggatagggcggtagctttcaggatgtcaggtgtttggaagctccacagatttctgaatttgtgtatatttaaaactacataaaaacgtaccttcttaaaggtataattcccaaattttaacatcaacatatcagctttagctatcagcctacctattcatttgtatttttccttccatctctaattaattgaagattatactgtgattgcaaggcaagccattaaaaaaaaactgctaatattggttatttatctacatgaagaacgttaagatgttctctgtgtcatgtactcaaaattaaataaagaaattagaggttgtggtaggtaagtgaattgcgaatgtcatgcacctctgacctcacgtttttagttcatcacagctgcttcattgttctcattaactttgaaagtaaatattaaaattgcaactcaaaataaatctgtactgttttacatatctgaacacagtatattaatatttcatataagactttttagagtttttctagtattttggaaaaccagtgaaatagtggattggctactggttctgtgctaatagtgtttataagtggaatgggactttttttaatatgaagtcacccaaggaatttgctttttctggaggcacgttatttcatgaagtccagtgtgttatcactagactaaagtcttttctgtttgggaagtctgtcggtggggacaggggtcataataacctttgctagttgttctttgatttttggtaatggcttgatctaatcaaatatcagagattatcttagttctacctgctcagcaaaaaccaggaaaaagagttaacatatttgaggggttttttttgttttttgtttgtttgagacggcgtctcactctgtcacctaggctggagtacagtggcgcaatctcggctcactgcaacctcctcctcccaggttcaagcgattcttctgcctcagtctcccaagtagctgggactacaggaacacgccaccacacctggctaatttttttttgtatttttattagagttggggtttcaccatattggccaggctggtcttgaactcctgactcaggtgatccaccctcctcaggctcccaaagtgttgggattacaggcgtgagccaccatgcctggctatatttgaggtttaaactgaaaagtatcagacagcaaaaaggaatagtttaagttgggcttgactgttaccctaatatgcactaagtttcaaaaatacattctttaatttgcataccaccctactccagaagtaatgtagaaatagtctcaacatctggtgatagcattaaggtttatgtaagacagtctgcagcctgcctcttataaaaagaagggggtaggccaggcacggtggctcacgcctgtaatcccagcactttaggagggcaaggcaggtggatcacgagatcaggcgttcaagaccagcctgaccaacatggtgaaaccccgtctctactaaaaatacaaaaaattagctgggcatgatggtgggcgcttgtaatccccagctacttgggaggctgaggcaggagaactgctcgaacccgggaggcggaggttacagtcagccaaagatcgcgccattgcacttcagcctgggtgacagagcaagactcacacacacacacacacacacacacacacacaaaaggagtgaaaaggattgaaagcaacaaaatagtatgtagtcatcttctcaaaggaaccaaagtaatgggctgattatcttcagcttcctgaagaagctgaatgtttgtatgtaggaagtcccatgtgttatcttggcaggaagtagaaaatatgagtaatttggggacgcagaatctttcgtcacttccctccatcgcgtctcatgtccaggatcttcccaggagtcgtaggaaatgtagcatccatgcagttagtcgtttacctcctaggaaacctttgtgctcttaggagacagtggcttcccattgtggttaagtgtaaccctgtttggctgacccctggatagagcttcataccctcagcactgcatagtcacctttgacttgtggttagaaagatcagccatatagtccatcatgatgatatgttatgatggtttatacaagaaactgggactttttatctcagccaaaacgctactcttgctttaggattaggtgactttaacagggttaatagaggaatgtcttttcaactcttatttctctattatgtaaagctgtccttgaatagtcagctgttctttccagctgccacaaataatttgttctttgaaaagcttagtgacttagtggggtctttcagaataaggaatttgttatgttcaggttttggggtcttgccagtggttctgttttgcttgctttaaacagatgtaaaatgatactgagattattgctgatttattttctgttgtgctagcagcatttcagtacttttgtggtaggttgtttcttttacataaaaaataaacaagtaaaccagctgcaatctaagtaggaaacataagaatttagaatgtgtgtgatggttagattttacttctgatttcatcagaaaagttgccctctagacagttttctggcatttatagttcattgcttatatgagagaataaaatacatatagttgattaaaggaaggaagtttattacttagggaaaaggaaggtaaaaaaagaccctaagcaataaaggcaattcttttttaagcagaatactttcattttatttcatttttgtttaccagtgttgttacgaaaactgctgctggggctacttcagctgagatgatttggctcttttttgtggctttcttcttgttctgtacatcagcactgtggttattacaccagctaccaagaacatctcacatgccttttgcatataagcactcttagtccagatagggcgatgtctcaaatcccccaaagattttatttattggccaggtgccgtggctcacgcctgtgatcccagcactttggaaggctgaggcgggtggatcacctgaggttaggagtttgagaccagcctggccaacatggcgaaataccatctccactaaaaatacaaaaaattagtcaggcgtagtggcatggaccggtaatcccagctactcaggaggctgagacagcagaatcacctgaacccaggaggcagaggttgcagtgagccaagatcgtaccactgcactccagcttgggtgacagagcaagactccatctcaaaaaaaaaaaatatatatatatatatatacacacacatatatttaataatttttttttgagagacagggtctctgttaaagattttaaacaagaagtttaaagttgcagaaagaattttgtagcatgcatttctaaatttgctcatatttaactgttttttgttttattttcattttcttggttagagttgaaatgataggagaaagttgtgcatttctatccttaaaggtaattcctcaacttgtgtcctggagaagaatcaggtcatttttcccagttagattttgctgctcacatctgtaggcagaacagtcagaagtcttcagcctattcccaagtgatgatcaatgaactgaagtactggaagaccttttttgtcagagccttggctgcatatgactcagctcccaaaggtggctcgtttctgtgtaggcagtcctttgatattctgtcatttcatttcagtttggcatggccactcctcttatcattgtataaagttgattttcttaagttagcctcgctaatggtttgttttatttttcttccgaaagataaaaaacacatagtatataaccattcgccaaagatctgtggtggttggtggcatgggttaaaaaaaagatacagcaatagatagatgatagtttccagtcatgtgggtttaacttcattttctttggtttgatgcctccttgtagcaaagaaagaagttgaaggctggactgtttgttttaggtacagaggaatccgattagggatcagctctgttcccataaaccactgtgctgagacctttttgaagaattttaaaaaatgaaagcatattgcctactgctattaggaaatctatcaaataaataaataaaaggccagataattattttctgatcttcataacaacatggtatggtttgtggcagagagcttaaaaatgtattagatttgtcttcaattcttgtgttcttggtaattttctgttttcccaaacagagagtaagattttagtctcatgactttggctgatgtcagtggggctgaagtttctaaatcacccacgcacagctctaaaactgtcactgtgaattgagtccaggacaacttggaaacaagttgagtgtttttcaagtaggtacttcagcatgttaaggagatgtccatgcaaactatcactaagagaaaactcatgaccataatatagagcgtgttaaacttccagctgggttgtgggtttggggacatgtttcaattaattaaaagtgaatttatgtgaaaagttctttactagaagcacattttaaatgatttttttctgcttctatgttcatctcagacactcaaacactggcctgagagtttgaatattgctgaaacctttttacgtgatagtgccactcccttaaaaatcatcattgcttaaatctctgtagggtgttggaactggttgggaagaaaggaacagaaagaacagaacttggaaacaaattctgcccatagtgttcttggtcacttttgcagatcagaattagtagctggttctccagcaaatctgccacctcctgtgttgcccttaggtgcctaaaatattatagattttcaataaaacaaaagaaaaaaaatatacttttttaactggattataagacaataaaatcttatctttaagttatcacaagatgcgataaatggattatgcaaaaggatatggaaatgtttataagcaaatccaaggaactttgaacgacattagagtgtgatgattttttaaaaattaaaaattttttttaattttgaaaaatgttaatacaaagtattatacataggtaatttatcacatatgtgtccatgattcagaatgaacacatagtaacattctgtcagacggcttcagattgtttcactttttaagaaaccattatggttaagttcagattcccctttgtttccctgccccatgcatcttccttcctccccaaggacaaggactgtcatgaattcagtgcattcgtagtctgtgttttataatttattttcatacataaacaacatataatttgtttttgtttttaacctacataaatactaccatacagtacctctttttgtaatttgctttattctcttcagcattatatattgaggattcagcacgctgaaaaacatagatctactaatcattgactttgccttttcatagtctttttatactttttctgtagaagggaaagagaaatggacttaaagatgatgtatttgaaagactttagctgagtggggatttgtgaagagaaagggtttgagtggggtgggctttcaagtctgtgcatgggaaggatatgatggatcaactaatgggagaggaagaaaccagaaaggagcatgccagctgcaagtcctgggcatctctgtggcagaggaggggaggtgcaccatacaccctgagtaagaatagtgctcgtgaggatgggcagaaacatgttttggcttactagaaaataaataaagccgtttgcctcgaccactttgttatgcttcttgctgtgggtccagcagcctgaaactcacttacccatctgatagaatcacagcagagggaacctgggggaaaatgtgattcctcctttttaattttatagatgaggaaacggaggcctgtcaagaagggactagggtcatactagtacatacatacatgcagagccaggacctacgtcaaatttagtttgacagctgtttgtccttttgtgttactaaattgatgtttgacatactgtaatcaaggctgtgtcagcgcattcatctaattttagtttaaataggcatagtagggccgagagaggagcatttgaataggatgcatgagctaggcactatgctggagagtcttaatttgaagattcagcagtgggtgaatggtccctgccccagagaggggatagagaaaaacctaagagagtctcaatacactgtgccagtggtattaaggaggagacctgtgaaccaagtgggtgttaaaggaagtgttacaaaaggcatggaataggcctttgaggtctgggattctagcagtctcctttctggtttccttccctccccatcatcactccagtcccccacaaatccatgtgtctgggctaaaagagatgttggcccaaaagagatgttggcccttaactggtgagttgatgtagacaggacctgtgatgcttcctgaatcagtctgtgaggcattgcctagtgaatggtatctgtggttgatttcctgagtgagcccttcccatgagagtgtctcctcgagtgtccccacaggccgatctttcatttgtttctgctttacctctggcttcctggaacagttctgttatgtgactttatagcagcgctgagagctgatggtaagccttctgagacacagaggcttgggtttttacgtcagtggcccttgtaggccaagggagtgaaaagtaaaggaattgagataaaatgctgtccttgccaaattgtggtttctgctttatctttcaagaagtctccattttctcttaagtcacagttcccagaggtgcatgtgggggttccagtgacctttcatgtgtggttcctgtctcagagaatggggtgcaaaaagcccagcgtagttaagcttttcagattttatattctgtgctttattacagtcatacaaattttgtaacccctgttaggggctttattaatgtatttatttgtaatttagacttacacattgatggcagacactttcacttttagttttggtagcctctcagcttcctgtctgaaaagttccagacttactagtttttgttgattagaaatcacatctgttgcttcctaagggccaggaaactcacccttcccatcagatcacttgagtcgttgttcctctcattaagctgtaatctgtctcctggtctccaaataaagacacaaacaccgaaaaaaaaaaaatcacatctgctcgtgtttttcctcctccaaataacatcacagacctgcttcctagaagaggactgcagtgtgtaatttcagtcacattctcacatgtgagtgacttcactttgaaattcagaggccacttgtggcagcagtggaaactcagaatctgggatctgtttgctttgtccatgtgaccttgggtttgctttcttttcagattgcagtgcttttgtccacaaaggctgccgagaaagtctagcctcctgtgcaaaggtcaaaatgaaggtaagactttctggctaaaacaaggcttaaaataaaagggtttaaaccagcaaaatcctcgggagttgggagagttgaggttgtggtggattttgtttattttaatcatttggtaccaactttgagaacaaattataactaaaaaatattttttctcttaagcgatcaatcttcttcttgagtaacactggagaattagactttcagaaaagaaaacgctttcagaacttcttcacgttcaatatacatttcttcgtgattttaatatttccgtattgctcttaaagtggttttcttcttaactacgtctgcaggcctaccctgctgttcatacacctgtcttcctccttcaggactatcagggcagcaggtggaggtcaggggcattgacctgctggtgggggtggggagggtgttatggttagccccagcctgtctggtagcacttttctcctcaggtatgtaatataggtggctctgatcacatgacgtaagaatagaaagtgcctgttttatggtggtatctgccctgagcatgtatgctatgtaatcatgctttcccagtggcccttaaaaaaaagtgtgggttaagggccataccttttaggtagcctgtgaggttttcaatgttctagtcgcctgtaagtgtctcttcattccttgtcaaaggagtgctttccaacttcgtcgacacagatgattaatgagctgtgtgcttcgtcagtcaccaaacacagttatctagtgccatgacctcaacctggaatgtgcatcagaatcaactcgagggcttattgaaagacaacttactgagccccactcccagagtctcagattctgggggagagtccaggaatttgcatttctagtaagttcccagatgatgctgatagtccgaggaccttactttgagaagcactaaaactagtgtcaaaatggcaaagaataggatagccagatcttctttagcctatggacacatattttgtttggctcatgtagtatttttaaaatgtgagttagtgcagctctttcaaaatcatgttttatatcagtttggattcttaagttctcctgaaaaaactggaagatttataacccttggctccctgatatttccctgtacccagcactcccagtttttccttttttccatagtacttatcaccttcttagagtctgtatttacccatctttatttattattatatagttttttatagtctgtatcttccccccactagaatataagctccaaactcattaagcaggctgagggcaggagttggctccatcagtggcgcctgagcacctcacagggagggagggatggctggagctgagtggtgctgcctcctttagacaggatatgccagttccaggctgccactgccttcccacaccccaccccaccccagcttgcttctgtcatttgttgcctgccggcaccatagtcatttgagtttgtgatctctgataagactcaattgttgtgaatgtactagtttatacagaatgatcatgatagagacatagcatctcccatataagagaatataacctaaaagggggaattttattttattttattttattttattttattttattttattttagagacagagtctcactgtgtcacccaggctggagtgcaatggcacagtcttggctcactgcaacctccatgtcccaggttcaagcaattctcttgcctcagcctcccaagtagctgagattacaggtgcccgtcaccatgcccagctaatttttatatttttagttgagacagggtttcgccatgttggctgggctggtatcaaactcctgacctgaggtgatccacccacctcagcctcccaaagtgctgggattacaggtgtgagtcaccgcaccctgcctggaatttcattttaaataggaagtaacctatttcttctaatgatttatctcagattaatcgcttcagtgtataatctctcaaagtatttttgctacatggctacaacgaaagtattaactaaaattagtattttacccaataatttagcaccttataaatgctagttactggaaatgaaatgcaaaagtcaaaagatgctgcccttaaggcaccagcaatctactggggaagacggacagttactataaatgagaaaggtgccagtcactgccttgggtgaggagaggagagaagctatagatggctttaccaaggaggcaacccttaaatcgtcttaaaggggaagaatgccatgcttctgaaggtgagaaaagcattccaggcaggatagacagcatctacggcattggagtacgtggcaggcttagaggatggcaattgggggcgaccgtggctgggacacagggtgcttagggcagtgcaaaaagcagagtgggaaaggaagctgaactgcttgctcccttcctactcggcttctcagggcttgtcagaggtgaattgtcaatggacttactttctttctctttagcagcccaaagggagccttcaggcacatgacacatcatcactgcccacggtcattatgagaaacaagcgtaagtagctcagcccacctctcaattccctttctgactttctggttctgaatgtaaaaatgctgttgtaatattcagttattattcatagtcaagatatgaatacctattttgtggtaagtgagagaaggctgctgttttatcctgcagattcctttacccatataacattataccatcaaaccctcttggaaggtctctaaaacagtctgtgtattagcttaaaggcagcacctttgccctgtgtgtttaagcaagtgacccctgcgcatctcaacttcctctttaatagtagttgagaattaaaagacttgtttttagtgccttacaatcatacaaatcaaatgagatctggcttgttaaacttttttttttttattatttttttgagacggagtctctctctgtcgcccaggctggagtacaatagcacaatctcggctcactgcaacctccacctccctggttcaagcgattctcctgcctcagcctccccaatagctgggattacaggcacgcaccaccatgcccggcctaaacttctttctaaactgagaagttatagaaaatagttctttttttttattatttctaaggacctcaaatgttattcagaattgagtaaatcacactcttccattcacatcaaaccattttcaccagtgcatagaagactccactttggttttactgatacttttcccttttcactccccattccctgtctcattcctactttagtatatttaatgtatgtccttctaatctgccatatttttagacatatgtatactttgaaaaaaatgtattattttgtgtgaatttaaattagataatatgacttatgcttatatgttctgcttatttttttcactcaatattgttttgagatatgcatgttattgtacgctattgtttcagactatggcatggtattctttcataagcatatttcacatttaaagttcccctagagacagaatatttactttgcttccagctactaccataaataatgcaatgattaatatcttcttagctggctccatgggagcctctgtgagacttttcccaggcagtgttcttgaaaatgtagttttttagaagtaaagattcttgggccccaccctgatctgtgaatcacaaaccgtgggatgggaccagcattctgtgtttttttgtggtgtgtgggagtgtgtttaatagagacagggtcttgctttgtcacccaggctggagtgcagtggtgtgatcatagctcactgtaacctcaaactcctgggctcaagaaatcccctcacctcagattcctgagttgctggcactccaggtgtgcgccgctatgcctggctgattttttaatttttttgtagagacggggtctcactacgttgcccaggctcgtctcaaactcctggcctcaagcagtcctcatgccttggcctcccaaagtgctgagataacaggcatgagccaccgcacccagcctggtctgtgttttaatagatcctccaggtgattctgatgcccactcaagcttgaaaaccgctcctttatgcccagtttctctgagtacttccagatagctcctgaatggctatactagtctacactcccagaagagagtgattccctttagatatatttaatctggtttttatccatcttcacacgtagatgactagaagaggagcttctccaggttgatacccacttttagtctgtgatcttacccattccacatactttttatgtctagcttcctaaaatgctttttttcttgtgacattatctgttgtttcagaagtctgttttctttcttattttcatgtctttcttaaaaacaaatgcctattatgtgcaaggttcatgagtattacctttgatccccacaagtatttttttttttttccttgagacaagagtcttactctgtcacccaggctggagtgcagtggcacaatctccactcactgcaacatccgccttctgggttcaagcagttctcctgcctcagcctcccaagtagctgggattacaggtgtgagccaccacacccagctaatttttgtatttttactagagatagggtttcaccatgttggctaggctggtgtcgaatttttgacctcaaggcatctgtctgtcttggcctcccaaagtgctgggattataggcgtgaaccactgtacctggccctcccacaaatattcttattcctgttgtactccactgaggcaacatagtggtgtagagtacagattgtgaattctaattgtatggattcaagtctgacaccactgcttaagagctgtgtaactggacattaccaaacctctctgtgcctcattttcttcctctgtaaaaggggacgataatagtatcatagggtggtagtcaggtttaaatcagatcatacctataaagtacttagcagtaaacattccttaagtgttagctttcactgctatgatcatcacaaataaggaaacagcaatattgagtcacttacttgggtagaatatggattggttacaaataaggaaagctgttattttcttcccccctatgctggcttttagatacaagttattatgagctctgcctaacatcattctgcttttccagccctttcactgattccttctacctgcttcatcttctactctgtgtctcccttttacattaatactacataattacttctgccttcattccatggttcttctcatcagaattgtcctctcttttttcttctgacccatccacatccttgcaattcttcaagaactagtgttttcttcctccatcagattttatccgctcagtgacctcccttcagaaacattcaggttatgctccaggccctttaactcttaagctcattctcttttctacccacttgctctttttctcttgggtgggggtgggggtgggggcagaggggtagggccacatcccataatccttgtgtactttctgcagctagaatctggtcaggttttagaatgtcgggtttctgctattttattgtgtcatcatcttgtaaatagaatttgaattggaaattaatgattatattaatgctcattgagtcaaagacatcctgaaatactgtgaagtcataactaccaccccagtcttatttccttcacctcttgacactcctggggatggacagataatgcaacctgtgaatgggacagcaagtccattaccagggaaaaatgttcccaagtgccagcgtgaccactttagcaaattagatctccagtttcctctttagtcatgttaatgagaaatatgcactatgagaacaatttagaattgacccttgaataactcggatgataggtgtgccagccccacccccatgcagtcaaaaatccacataaaactttttgactcccccagaacttacctactaatagcctactgttgaccagaagccttaccaataacataaacagtcaattaatgcattttgtttgttatgtgtattatatactgtattcttacaataaattaagccaaaggaaaaaatgttattttaaaaatcataaggaagagaaaatatatttactgtttgttaagtggaagtagatcatcataaaggtcttcatccttgtcgttttcacattgagtagaccaagaaggaagaggaagaaaagaagggttggtcttgctgtctcaagggtggcagaggcagaagaaattccacatataaggggatctatgtagttcaaacccatgttgttcaggggtcatctgtagttacaggtgttaaacaagtgttaaattttcctcatctgtaaattaaaggaaatcatcaaaatctatgctcgctagcagggagcgcagaagaatcacttgagcctgtaagatatgtagactcttgggttccacccctagaagacaaggggggctgagattccatatctaacaggcactccagatgtcttcatggtgaacggtcctaaagaacgctgctcccagttatctctcaggttccttttacccttaaaattctttcaatcttggggccaggtgcagtggctcacgcctgtaatcccagcactttgggaggccgaggcgggcagatcatgaggtcaggagtttgagaccagtctggccaacgtagtgaaaccccgtctctattaaaaatacaaaaattagccaggcatggtggcgggtgcctgtaatcccagctactcgggaggctgcggcaggagaatggcatgaacccaggaggcggagcttgcagtgagccaagatcgcgccactgcactccagcctgggcgacagaacaagactgcatttcaaaaaaaaaagaaattctttcaatcttatttgcagcttaaatattaaaatatgtaatactcccacaggattctttatccccgttgcctgtcccaccccagaggtaaccactcttcttagttttttttgtttattttcctggagttcgcttgttaaagtaaatacaacttggattatttttctttcttttaagcatgaaagatagcctgttatatactttgttctgcactttgattttcctccccttaatagatcttggagatagatctatctgtgtcagtacttggaaagtgtccttattttttgtaagtggcattgtattctgctgtgtggtgtagtataacttattcaccagtcttcttgtgatactcatgtcattttcagtcttttgcttttaccaatggtgttgcattgaataactttggacataacatcatttcacgaatatgcaggtatatcttgtaaaataaacatagcctaaaagtgaaattgctggatcgaagaatataggcatttacaatttcaatagttatcaccaaactatcctccatggagtttttatacaaacttacagttccagggcaaatccactgtaaagcgccttacttctgcttgttatttgtcagatgggtcagtaccaggtggagctggatgggtgatgcttcagttagtgtcctctcctccatggagtttttatataaacttacagttccagggcaaatccactgtaaagcgccttacttctgcttgttatttgtcagatgggtcagtaccaggtggagctggatgggtgatgcttcagttagtgtcctccttttgcagcctcacagcccaaggagcgtcctcggtccgcagtcctcctggtggatgaaaccgctaccaccccaatatttgccaatagacgatcccagcagagtgtctcgctctccaaaagtgtctccatacagaacattactgggtaagtggagatatttaaagatagcacagttggcatctaggtgaccagagcataataatcacatcatatgacaaaaagcttttttttttttttaagaaataaatctataaggtcatgggttggtgcagacaaggacgatggggattatgtttctgatgcatgtcatgatggtcattctgtcgcaaggatctcctttaaatacccttagcaggctggttgctgtaggctttttgtatatcatcagccctacttttgaagaatctgagttctaaaaagatgattttttagatcaaaataagtaggaataggaaaaagggtgatttaattcagaattttgggttgcaaccacttacagatgtcatgcttttctgttgttcaagtaaacctggttgttttgtttcttcttacctctgttttacatctttgccttttaacacttaagtcagtttcatggaggtgagtgctgagccaattattactattaggttctcactcactcgtttgcactgagtttcttttctggtctcctggccaggccttggctgtcaagtggttagcagggggctgataatgatgttgctgactattttgggtaagatgcctgccttcccgtcgggtgaataagccatttcaaatgtaggactcagagtatctctttaacctatcttggagcaaaattcctaactaaaggatgcaaaagtctccttttgtttgtaattcctaacctctgtgctggctaatgttttctcctcctctaaaaagtttcaggtatttttgttttgttttgttttgttttgtctttgtattctcattatttccaaaagtgtacttttcaaaagttgtaacattactaaagtttgtatgcattgtaactttcaaaagttggtctttaaagtgttcttgctattgtgtctactcacacatcaattgggtgcctgctgtgctagctggtgagttgggattgagaaagtccaaagagaacatagttgattgtaagtgctagatctgtagttatctagagaacagaaaaaacagtgtattggttaggcaataagttttaaacagaaagtttcttatataatgtgtacatggtttgatggaagaaagttccccttgcttcttatcactttctttaaaaaggctcaaaaagtcctcagaatttgagtctccagtgatactaaatgctcccgactttgttaccaggccatgtgcatgttgctgtggccccgacataagcaatttgtcttcagtcactgtagtacttccagccagttgtcattctagagtcttcaggtactcatttaagaatgcaagccataggttatcagaatgtatttgacagtatgtatttttcttttgtccccagagttggcaatgatgagaacatgtcaaacacctggaaattcctgtctcattcaacagactcactaaataaaatcagcaaggtcaatgagtcaacagaatcacttactgatgagggtaagaggaagttatggcctttattttatgcctctgtagggactgtgtgtgtgtcattacctagaacataagtcttaatggagtgacagtacctgcctcttctgtatcccgtgaagattctctaaattgtcagtaaagtgtccagtgctttgtcatgactgcgtaatcagactcatccagcagctgtcaagtgaaggatgtcatttatttcgatgtgggcctactctttagtacaaatcttttccttcccttagacttttttacatgtacagttctagctcacagagcaattgtaagcctgctctcttaaatatgaaaaggtaccaggtcccttccaattcttaacttcgtgtagatagaagtcatgtcttaatcatgtttgatttatgtcatgtttattactgttaacctaagtctcgaatgtagagtctgtcactcctgaacaggatattgatttttttctggtactagaatatgatctctgtgaatatcccctgtattcatgtgtcttatgaaatcaactatcatcttgaggaaagtccaacataggcttattttacaggtcacaaacctgattctgatattgattttttgatatattgaggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatggtgagagtcttcattttgctctgattatatttgatttccattgtccagcatttttaagcagtaatttgttggactatgaaaaatcagttttttagtatgtggcttcttgaaaagatttcctttaaaaactttaaggtacagagacgtggtcctgttggtatcctatctcctttttgccccactcttctgttttcagttctactgaacattgtacttatatgtgagtacttatttatacagcagtcctagaaagagatatctcagtttttttccttacctacactaaaaactagactaaacacaagtcatttctgagaactgggtatacagtcagttacgacaggtgctgaatccagtgaagacctctttggaagtcataatttaagactgatggaatccggggtacctattatcagaaaataggacacgtgaaaaatagaggaataagacgaaaacacttgaccaggctcagcggctcatacctgtaatcccagcactctgggaggctgaggcgggtggatcactcgagcccagagttcaagactagcctgggaacatagtgaaaccccatttctataaaaaatacaaaaatcagccaggcgtgatggcatgtacctgcagccccagctgctcgagaggctaaagcagaaagatcgcttgagcccaggaggttgaggctgcaatgagccatgacttcagcctgcacttcagcctgggtgacagagccagaacctgtcttaaaaaaaaaacaaaaaaacaaaaaaacgagaacacttttaggggaaagatagctgttgacccaattttaaggttcaaattgggctctaaactagctttgggactgcagcagatgatctttgagggcgaatgcttataaaagagtgttcctgacacttgatctttttcctccttttagagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcaggtgagaatgggaaggatctcaggttcttacatacactgggaaaaagggaagtcatggggttccacagccatgcattcacatcttctttctaccatttattatctgtgtaagctcagggaacttatttaatttctctggagccttgatttccttttctgtaaaatgcagacagtagggtttctctcctaatgttattttggaaagttaaagggagggtatatataaagtacctaatgcatatgatagatgctcagtaaaacttagtttttcttcctcagagtctgtgccatcatcagaaacagtatagtttaagaaatcaattaatatggccaggcacagtggctcatgcctgtaatcccagcactttgggagatgaggagggcggatcacttgaggtcaggagttcaagaccagcctggccaacatgataaaaccctgtctctactaaaaatacaaaaattagccaggcgtggtggcatatgggagactgagatataagaatcgcttgaacctgggaggcagaagttgcagtgagccgagctcatgccactgcactccagcctgggagacagagtgatactctgtctcaaaaaaaaaaaaattgaaaattatttaaatatttggggctgggcacactggctcacacctgtaatcccaacagttcgggaggctgaggcggatggattgcttgaagccaggtgttcaagactagcctggcaacgtaccaagagctgtctctacaaaaaaaagtgaaaaaatgagccaggtgtggtagtgcacacttgtggtcccaaccactcaggagcccgaggtgggaggatcacttgagcctaggagttcaaagttgcagcgagccatggtgatgctcgtgccactgtactccagcctgggcgagagagtgagagaccccagctcaacatttaaaaacaaactctgtgtgtgtgtgtgtgtgtgtgtgtgtgtgttggaaatcttcaactttcccctctgcctcaaatcagaaggatctcatgtgtctaaaaaccagctgaagcacagaaagttgaataagtgactatctgtaaaatgcttaataaaatatgtattgttgatactttcatcaaggtgtggtatggttttagtcatactccaaaaaattcagctaaaattactttggtacttgtagatgtgattgtcatagacagattttaatgtttctttttaaaatattcttcttgaaaaacacattgccagtataacctttacaggcagaggggtatataacatgtacatctgactaggtatttccccaaagatgcagattccccaaagatgcaaattccccaaagattttgggcaaatatctgctgctgtgtagaagcagaggcttaattgttggaacatttgtctgagaattgtaaattttgtctttcctttgtgttcttgagcccatacccctcacttcattaatttattagcacattcactcattcatttttcaggtatttactgagcatctattaaatgccaggtagaactacaaagggggatatggcttaggcctctgcctcagggaactcctaggagtaaaagtaagcatgttatgaaataaatgcaaatgcagtgcggtaaatgaacacagatagctgcaacagatagagctcaaaattaagacctacaagtgatgacttttcctcctgaaacatccccttgggcatttccatttctctctctctgcccctcctctctggtttcatctaacttttactttctctaacttagtacttcatcaaactttgacttgtattaccatttgtacctccttgtacttgtgtacaacccctagtaagatctttggtgctagaattcacagtttaactcatagtatccgtttgctcgttctgtgtgccagtggtaggatcaacctttggggcatttgctttgtcatatgagcagataacttaccgtccctctgtctcagctcctccattggtaaatggtgaagtgaaaatctaccctgatccttctttccagttttttggtaaggatcaatttgtgttgcctctggaggtttgtagtacatggaaatcaataattagcatgtattttatgaactgcatacagaaattcattgatttagtgcaaagtgaacatacctttagaggaatcattgagattgcacacatttgggaatgatttaagggcctcatagaattattaggactgctggcctgaagtaagtagtacaaacagatacctaggtatgatggctgtttgtcatgtctgtctaacttatcaaggtcagatatttaagattgtctcatgaaaaactcctagtgaatctcattgttttattactctgtttatgacaaatagaagttagaatacattttgcattttccgtgtgcacagtacataaagtttctttaattttttgttgtttttcaaatctgtataacagctttattgagatttaatccatatgccatatagtctacccatttaaagttgaacctcttgagtaactgccagactgctttccaaagctgctgcaccatttcattcttttgggagaatttatgaggaagcgctcttgacttttacaactagactggaaacattttacaaaatggtattatgagtttggcgccccatggcataacttctgttctcttttctctgcagttttcaggtgagaatgcagaacgtttaaagaagacatatggcaagttttgtgggcaacataaccagtctgtaaactacttcaaagacctttatgccaaggataagcgttttcaagcctttgtaaaggtattgataagaaacatgaaaatccccgttattgttgagagccatgtgtccctgtcggctttcactagagcctttttcatgtgattcctcacagtctgtttactcccttgcagaagaagatgagcagttcagttgttagaaggcttggaattccagagtgcatattgcttgtaactcagcggattaccaagtacccagttttattccaaagaatattgcagtgtaccaaaggtaagtctcctttctaactcggtcttgtatggtcatggactgtttcctctgtggccagtagtactggaagccccatggaagtgctatttcatgctttagtatgtctaaaagagaccttgtgttttatcttgaattttgttgaatgaaaatttggactgttatgttaccagacttaggatagatgatagcaagaaggaaagggaacacattgattccatccagagttcaatgacctgaacagtattctgttatcactaggctgggagataatttccactagttattcccagaagtgctagaattgctgctgtttttcacttaatcagtaattactggtttctctctcttggctaattctgttcctaggtagttattttaaagattacaaggcagtacattaaaaattaagtaaaacaaataaaaaaaaaaaaacttggttgctcttcctgctattactgtccctcctagaagtctttagttccttttatttcagagcacaacatatgattgcatattatttatatcattgaaaacttctgactttttttagaatcaaacttatgacagcaagaaggataggcacatgatctctgacgtgttggcttccctctgatagcatagtcacaaagggaaaagatgatatggagtgagaagtcaggattcccttgcttctgcccttgtccaaaaagagccataaaaaacagaattattctttccttccaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaaggtaaggcttggctcttttgtcttaagtatgtgcccaggtaaaacaggcaaaaatccaagtgcttttgttggaaattcactaccagatttttttcccagagagcccatctctaaacactacccaggagcaacaagcatttagttcttcgtaatcttatatcaaaaatggtttgtgatggcctgcaaaatcatacaaaatagaggaagaagacaaagaaatgatgcagtcagggaaaatggaaaataaggttttaaaaaaacaaagcaaagcgtaagattggtgcacatatgcaagctgtcaaggaaggtgtattcccctataagagatggacagccaggttggaattgggatctgtggcaaaactcacaaggagggagacacagtcagcgagtttcacagaatctgtgagttcaaaacacatcacttgttcacaagagatgttagaggagtttgcagctccagacacctaatagaaagttaagtttaacccacatcaattagatttttttattgttataatttatgatattcgtatatctttaaagcaaaataaatcataaaggatgcccattttccatttggttttaatttttacatttctaatagtcagccgtatcaagttaaagaagctatgaggcttgttttttaatttatgtgtacatttgattttttttgtttgttttcatcaaacctatactccatgggcctatatgttacaccaatagccttgaattatacccaccccgtcgccctggcctcagtgagctgaggacattgaagcagggtaggccagtactgtcagcctcactggcatagaaagaaggtggaggaaatgggtgctgctttcatttctgaggtataagtgatgatgtagataactgctataggaaatgcccacgcatagaacaaatggtaaagaagttccaggcagtcagctggtttcaacaatgaataaagcaggacaccctgcttagaagttgaaatcaaaatgaagagccttggaaagagatacctgctctacagtgtggtgagtgctggaatggaggagaaagcaagaggaatagcaatagagtcaagtcttgaaggatgacggcacataaggagaaagtgttccccacactaaggaagagaaagtggaagcacagagttgaaagggtgtggcacatccagggaagagtggacacccgggactctcacgtgagagagcagagtgaatgacaggggagtgacgggaaaccagcccaaagaaacgggaggggccaggttgtaatgaggtgcattctccagactgaggagttaacagttgatactattgatgagggaagggggcaaagaatgggttcaaaaacgagaacggcaagcaggagagggatacatgaggtggtttttcagtatgacaactaggggcagtttagagtgcagctggagtgaagagagactggtgacagataagagactgtgcagtgctttggggaagagctcatctgggcctgcattgtagcagaaggcataaaaaagaagggcagaaaagattcagagaaagaaatctcctttcccaccaccagctggctgtgtatttcatggttctgtgataaacttaaactaaggctccttccctccagtcttaatattccatgatgttctgagagccctagctctctttgagacttttacgctgtctggcagttcagaaatacctgccccttcttgtaaaggcctgaatttcctagagctgctgttgcctggatccagcgctttattctttcctttacatagcaatttatttattcccaaaataaaaactagtagattccagctgttgcaataaagttgtggtcaagccagcggcagaacgataggttttctggcctagaatgcctcctgtagagataggagttggtgtttagtcattttcacccccaagtgaattcatgccaagaacagccagtactatgttgggtactctttgaaaggggtgggattgtttttctctgatccactgacactgatcatataaacttcaagattcaatgaagttaaaatgtgtgtctctgcttttttggggggagggggagggtgcaggcacctgaattatttaaaagtaaactttaaaaaaaaaactttttcataactgatggcagtacacagaaaattgcagtagtttagcctaaaaaaattagacctccctaggaatcagatgtccttgcttctgttttcttcatagctttgcagtgaattccacagaaaggggatttcagttgcggcagaggtagaagaaaaggtggggcatggactgcataaatcagttccatcctttcccagggaattgtggacttcactttccacagtgaagatgttacataggggccaacctgctagctcgagatagactcaactccagagacatcaaaccatcctcaggagactagtggaaaatgttactacctactcctagaggattagtcagagctagagtttaagctgactattgcatatggagctgaggaaagagccctatattcacatgtacctgtaagactggaaggcgcctgcctgtgtggccactctttgttcttttgagggcatggaagacgtcttttcattagacttagatatttctatacttcatctttgggcagcattcctgtctcctgccccacacctttcccattactgtaattagaagtcgaaaaatattgcaatctgagtattttttggagtatcctgctatgtgttgctgtttaacatctgtacaagtccagcttttcagctttattcttaaaagtattttattcttaaaatcttgtcttatgggatatatctttctaggactgagtacttaaacttttccaaaacaaggctttggtgataaatcccattttaaaatgctgctaaaaatctggtgaccagatctgaatcctggagaactgtaaaactgttgctttggaggagtgtgatctcagatcatagtttgcccgtataggggtgtatgtgttgctgaaacacccttcaataaaaaaccttctgactgtgggtaactattaagtagtcatcgttttatcttcccttctcccatttccattttccagaggttcaagcagttcttctcactgacattttagttttccttcaagaaaaagaccagaagtacatctttgcatcattggtaagctgaattgttatttttgtaatagtattataagcagctagtttagttatggaatgtaagcactatgttattgctctcccccgccctcttaaaattaaatggctcaggacaaattcctctgagtaatttcccacatgccctcagaattttctggcatcccctcttcccaaaaaattattattctgtttcatcacagtcttcttttagtgtcttggacatctgactatttgatctatgaagaaacctggtcactggagcatttctcacatttgagcccataaatggtgctcatgtataatattgctgactggattctttggggaacctggaaagattcatcgtgtggaaaacatgactggaacctttagagccataaattactatttcccttttgaaatctttttttgttaaaatctgaatgaaataaggagatacttctctttatcctaaagtagcccttgtttttcaaactatgtgcttttttaacagcatctggtcttaccttagattgaagctgtccttcagagttagaatattgtatatgtatcttttatttgccctcttccctttttccaggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgtaagttaaccaccaggccccacccttcccagccctcctgatgtctctgtgtgatttcataacaggctggactgtgaccagagtaattgacatcttaggaattttttgttctgtcttgtttgggttgtattaggaacagagatgaagatgaaggaattcctagtgagaatgaggaagaaaagaaaatgttggacaccagagcccgagaattaaaaggtgaggcattgcgagtggtctgagccccttgtctggaatgtctgcagttgcagaagactgctggtggattttagaggtacgggtttgccctcagttctaaagctgccccagcaggcacttgaaagcagcaaaatgaatagctgttaacaaaagagaaaccaaggccaggctgacatgggtcctcgtaaagaatggctgcaaggatgtttccagtactggatcaagagaatattgattctcttgactcaggatccgtgttctcaaacctcatgacattctctgtactttgtcacaggcgaatttgccaaaatttgtagtcacatctaagattaaaacaaggagagaaaggaatttggggaaaagaattctccagttaatctgatttaatcctcccccagtccctagcgttatcacttatccgcatgtttacaaatgagttgtgaggtgaagttttgggagcagggtatgtatcaatctatgtttgacccttatttattgagtgctgactgttttgtgtagtcttgtcagtatccctgcaacacaggcattctaatccccattgtgccgatgagacagtcgaggcccacagaggacaagctacccagggttaacgtgtgtagttagtgggtaagccagaattctattccctgtcttagcaaagcctggtactcacgtatgtagttagtggctaagccagaattctattccctgtcttagcaaagcctgttgctcttttctctttgccagtggcttatcgaatgtttcaaagtaaagactatgctttggatagaaataaggcttagagttaaataaatgtaagcacctaaggagtttggttaggccttaaagccatacagatgatagcattctgtctcactgagggggaaattaaaaatatggacagctttagaccagagccagagttatagcaaatttattggcccatgattaggatgacaaggataaaaatcttccttctttaaattttgtcaagtacctggctaggcatactgctaggtacaacagatgcaaagattccttaaaaagagcccttgcccttgagaagctcacaccctagcaggggagacatacatcaatgatgggccacacagtgatttattagaccacaggcacaattagcatgtgtgggatctgctcatcctgcctctagtaagtctcacagagaagctggtgcatgagctacatctgaaaaaaattatctcagcacacaagagtggttatgtgcaaaggtgaaaaaggacttgacatgtctgccaaggaatgacaggttcggtgtgtctggagggtcagggctaagggatgggatcttaagctggaaatgcaccaggtattaaaaggcaacaagggactcatgtaattaaaaaaaaaaatttttttttttaacatgttgaagatagttaggagagttgcttgagggaatgggaagccactggaagtacaaagaccatttggaagactgttaggataggttaagtgagaatgagctggagaaggaagagatgtaagaaataaggtcattaaaatctgatcagttggccaggctcggtggctcatgcctgtaatcccagcactttgggaggccacggcgggcggatcacaaggtcaggagttcgagaccagcctgaccaacatggtgaaaccccatctctactaaaaatacaaaaattagctgggcgtggtggcacgtgcctgtaatcccagctacttaggaggctgaggcaggagaatcgcttgaacccgggaggcagagggaggtagaggtttcagtgagccgaggtagcaccactgcacttcacttcagcctgggtggctgaacaagactctgtctcaaaaaaaaagagtctggtcggttggtggtaggacagagtaaggagacagagtctctcacaggtttccaaatcaggtgacctggaagatgaagagttgttgactgagaaagagattccacactaaagggaggaggtagtgggctggagaaaagattggtttctcacgtgctgagaacaaggcatctcagtagaggtggccacgtgggcgccatggtctgctgctaagaaaggggagggtttttgatggtttaatgaattatcagcatatagaaggtcattgaagccatggggatgaatgagatcctcaagaggaaagtgggtaaggtaaagaagacagctcaggccaggtgcggtggctcacacctgtaatcccagcactttgggaggccaaggcgggcagatcacccaaggtctggagttcgagaccagcctggccaacatggtgaaacaccatctctactaaaaatacaaaattagccaggcgtggtggcacatgcctgtaatcccagctccttaggaggctgaggcaggagaatcgcttaatcacttgaacccaggaggtggaggttacggtgagccaagagtgcaccattgcactccagtctgggcaataggagcgaaactttccgtctcaaaaaacaaaaacaaaaacaaaaaaaaaagaagacagctcaggatggagctgagacaggagcccagataagagattccattgcagatggcagatctgtaaagtgtcctgagaaagaatggtaggaagagaactggtgtcctaaaagctaaagaaggaaacatgttttaaaggaagaagtaatcatcaatgctggaaaaaacaacctaaaagacctcattggattcagtcatgaagttgagctgggaaagcagttgcagagtggacagaagctagagagtagtgggctgagaagtaaacaggggacacgggagtggaagcaaagtgcagacttgttatgtcacaatttccatggtttgccagaaagatccagaatggttttccagatagaaatcacagaacagaaacaatattgctgtcttgatgaaaaagaaaaggcagtgtgggtggggagggtgtcctgtcttgtcactttccataaattaccacaaggtggtgctcgtgtcttagtcattctcgtaattactaaacaccaatcaaatcacagatcattttctccttcctgcagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgagggtaattaacattcagcattgccccctcttcatctactcccagagtggtttacacactaatattacctgccagtttttacttttttactttaaagcacaaatgcagaaaattacccaaaacaaatatttcactatagtaaattatcaggtgaatatccttttaaccactactcacatcaagaacttaaaggggccctgaagccccttcctccacatgctctgtccccatcacacctccctccctccaaaaggagcagttattctgactgttttttaattagtcacttatgcttttttttttttttttttttttttggcaggatcttgctgctctgtttcccaggctggagtgcagtggtgcaacctcggctcactgcaacctccccctcctgggttcaagtgattctcttgtctcagccacccaagtagcttgggactacagatgtgcaccaccacacccagctaatttttgtatttttcacagatacagggtttcaccatgttggccaagctggtctcaaactcctgacctcaagttatccacccaccttggcctctcaaagggctgatattataggcgtgagccactgcacccggccattaatcacttacttatatatctttatggcttaagtgcctactcctagacattatagtttaatttgcttatgttttttgatatgcatcttaaaattcttaatttacagttccccccaccatctttttttttccatataatttatctttgaacaatctgagctttttgacttagagagtttcccacagtttggattttattcatacagtcctgttgtctgtttccttcagatttgcagctggattcagaggcgtaattaattactcagacttgatctctttggtaaattgtgcccttatagtgttgtgttctttcattgaggaggcataaatatctagttgtctctttttttgtgacatataagaaaagataaaaggataaattcttgattatttttcccctccatttatttaccagtttttaagaccatgaacatcttctgaaagtgacccatagtttttattatggactcatgaattgaaacatgtttgatggggccaggcacggtggctcatttctataatcccagcattttgggaggccgaggcaagtggatcacctgagggtcaggagttcaagaccagcgtggcccacatggtgcaaccctatccctactaaaaatacaaaaattagccaggtgtggtgacatgcggctgtagtcccagctcctcaggaggctgaggcaggagaatcgcttgaacccaggaagcagaggttgtagtgagctgagatcgtatcactgccctccagattgggcaacagagcgagactatctcaaaaaaaaaaaaaaaaaacgtttgatggatttcaagtcattgcaattcctaaccttattaaaagctcagaatgttccttttgtgaacacctctttctttggcttctagtcctgtggacgtgaccatagtagtcttttagagctactggtatagtaagttgttccaggctcatcttaattgttttctgccccagtcctggtatcagccatttctccaagagttctggattctttaagtgggaaattatattttcagaccacagtctgggtactgggagtggtcattgctgctaggttgattgttactaggttgggccttttcagtggacagagcttggggaaaaacatatatataacattatatatatattatataacataatataacattatatgttttacatcatatataatttaaatacctattgaacataaaatgtgtatatgaaaatttatatttacactttcgaattcacattgatattcttaaactgtggactacagtgtttgtttttttaactaaacctatttagtattacatctctatttcctttctttcacattgcaaatccttgttcttaaggatacatcatagaattcgaatattatatatttactttctggctttatccaacctattactcataactgttagtaatactaatagtattactaattactattgctaatactgttagtaatactaatagtattactattactattaactaatactaatttactaattactattgctaatactgttagtaatactaatagtattactaacactattttgataataatatattctaatagtaatgctgctaccactacatatgacttttacttgctgtccgcattctcccgtttttgaaaaaatagttgtgctgtgtctacgctgtcagtttataactgttacatgccatatgctctccttgtaagccttgaccatagtctttgttctgtaagtgaacatacttcatgcttaccagaagttcttaggtcagtcaccctctagtcatgtggatatgtgaagctgattctctagcatgtgcctcaggaaaggttcatgagagtaatagtccatgagctctttcatgctggtaataatttatgccctttatacttgaaagcctattttgctgaatataaaattattggcttgttcatattttcttccccaaggtattaattactctcaagtatgttgttttatttttttttctggcataaagtattgccatcagagactgataataatttgattttccccatgtaagtaacatgctctttgcctagatgcccaaaggatttttttctaagtacaagtagttttacaagaatattccttggtatttgttaccctaggttgatgctgtcaggttcacagtgttctgttttcatatgtggtttcaaatttttcagatttcaggaagttatttttgaattataatttgtactattttccctgttccctttgctttggtcttcttcaaggtctccatttatccttatgttggaccttctttgtctatcttcagtgttggtcactttcttttaatacttttgatctcttcatctttttaatgtttaaatggtcttcctttcaccttcttttttattaagccattttctgctgggttaatttgctcttatattctagtttagttttgatttctataatgattgtttttcttttgtttgtagctttgctatttcatttctgtgttttctaattctgacctaagttagttctttcatgtcttttgtcattttcttttctttcttttctttttttttttttttttttttgagacagagttttgctcctgttgcccaggctgcagtgcaatggtgcgatcttggctcagcctcagcctcctgagtagctgggtttatgggcatgcaccaccatgcccggctaattttttgtatttttagtaaagacggggtttctccatattggtcttgaactcctgacctcaggtgatctgcccgcctcggcctcccgaagtgctgggattacaggcatgagccactgcacccagctgtcttttgtcattttcttaatgtgttttggtcacctattttatggacatgtctttccgatgtgcttttattatctgtagagaagttagaccctgtgttctccccaccatcactccctgttcttaactttatatgggatttgacttcaatattttctattgctcatttttatgtgaaattagtgtcttaagtttacaggttcagatagcttttctcacaccataggactcgtctatcatttttgtgtagtttttcttttttaatatggcttgtcttatcagatttcctgctattggttccctcccttattccacctggcccttctttttctttatctttttatttttctcctgtttaacttttattccattttctccactttcttctttctgtgagccataccctagaaaagaaccctagtgggccagagttgagatgcaaattcttagactactctagccccttgaactcactccatattggcaaagccagaaatcctgactgttttacttgctgttctcaaatcaatccatcttactttccagggaatatcttctgtctgctttggatatgattccagaagccatgtcacttctagtaaattactctgccttccctgtacactttcaaatttcctaggcctcttgcatataaagtggaaggtctcatctctaaatttctagtagaatccaactaaaacacataccctgagctgagacccttctctgagcaaaggaactcacccagtcactctttggaactttcaagtcgtgctctttgtacgtatcatatatactatgaacttgttttcccctcattgaaagataagatgtcagctttgcatgtttcctttattccagtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggtaaatgatgtgaagtcatgagcttttataggcaatccttgactatctcacacaactcaaaatgacttgtactttagtagctacatcaccgctcccaatcagcaaatttcttagtgagatttcaagacactcaagagcttgtcagtcagactcatattcattttgagtaacaaaaaagattttcctaagatctcagctaaaagagtaataatacatgttcctgcttccatttcttctgcatccgtaaaattattaataatcacttagctgccaccaagcagctccccctttttgggggcatcagtaggtttcagacatactacatccccaagatgcctatatgatattctttccttggctaatctgtttcacaactttaaaaaaaaaaacaaccctattttttgtttaggaggcgagaaggaagagggagatgatggccaagatcttaggagaacggaatcagatagtggcctaaaaaaggtatttctctttaaaatacaccatgaacctccttggcactttcctctgaattcataacctttgaaattatttcactttgatgttgttttcgatgcctgaattgctgcttttaataaaattattttcagggaaaatcacatttttaaaacaaatagtacagttaagagctccacattattggctgtttggcctcactggcttagggcagtgtgtttacattcataactctaccatggtcctggcaggaccagtttcattaggtttgtttcaggtgctccaaaccgacctgacctccttacaaggtatcagtgataaatagttcaacctcttaaaccttcactaccttagtgagaggctgtggtagaaaatggaaagctacagcctaacacagaaacacactgaatgtcatttttgcatcaagatcttcatttttttatatgtatgttttttgttttatagggtggaaatgctaacctggtatttatgcttaaaagaaacagtgaggtaaggacattatgaactatttaagaaaatatgtgtttgttgtcattgtcaagttaggaatattgttttttccttttttttttttctttttgctgttacaaagaggctaactgctggctatcatctgtatgtgtaaacaatacagttgtcagtttccttggcctttcccctgtctttggtcctaggggcaccatcttggaattttgccagttagagaattgcctgctaagatggcctttgattcgtttctttgattctctgtccttaaggaagcctcttgctgtttttttgtttgtttgtttgtttgtttgtttgtttgagatggggtctcactctatcgcccagctcgctgcaacctctacctcccaggctcaggcaatcctccagagtagctgggactacaggcatgcctgccaccatgcccggctaacttttgtattttttgtagagacagggctttgccatgttgtccaggctggtcataaactcctggacacaggcagtccacctgccttagcctcccaaggtgctgggatgacagacataagccatcttatccagcgcttcttgcttttaatgagctttctctaaatagggcctgtgaaatccctgtggtggtttcctttggtctaagcacactgagtagaattcatagcagccttttctctatcacaagcctgatactaagagccacaggtctggaacatgggcatttaacttgtgggtaatttgacacagtaatttcttatccttcaagtactcaagttatatcatcatcttttttttttttttttttttttctggggatggatcttgctctgttgtccaggctggagtacggtggtgcgatctcagctcactgcaacctccatctcctggattcaagcgattcccctgcctcagcctcccgagtagctggaattataggcatacgccactacacctgactaattttttgtatttttagtagagacgagttttcatcatgttgtccgggctgatcttgaactcctgacctcaggcaatctgcccacctgggcctccaaaagtgctgggattacaggcatgagccaccgcgcccagccatatcttcttctttgagtattgctttagacttaatatgtgtttcatctgtgaagcagtcatggtgtccttctggaaggatgcccatcccccatcccacccccaggactccttgttgtgacataatcttcagattactgccatctctaaaattaattctgagtatctgactttgtaagcagaatagaagccgatacatgataattgctttttagagtatagttctcaaggatgttgactgtgtttcttctttttcttgtccttgcttttaacgttaagttaaaagtctccaaggaactttatttttgaaattttaaggggaatctttcctttttccccctaaaatacagaaggatattgttttatatttgttgccacaaaagtctaaatacagtggagtcctgaaggaatccttcagtgtgcttatctttaaatgacaaacctgagcttatggaagctacttgctctctggatctgctgcttgaaattagctcacagcagcttccacgtcccaggttcaagcaattctcctgcctcggcctccagagtagctgggactacaggcccgcactaccatacctggctaatttttttgtattttagtagagatggggtttcaccatgttgcccaggctggtctcgaactcctgacctcaggtgatctgcctacctcagcctcccaaagtgctggggttacaggcgtgagtcactgctcctggccttgatttttctttatggcgacttttccctctatatttagttacaagaatcagggtaagaaatagtacaagacctgtttgtttttcagacattccagtatggattagacactataaatgcttagctagagtcggcaggttcttctgttacttctgtttattaagaataaaataagaggggccgggctcggtggctcacgcctgtaatcccaacactttgggaggccgaggtgggtggatcacttgaggtcaggagttcaagaccagcctggctaacatggtgaaaccctgtctctactaaaaatattagccaggcatggtggtggacgcctgtaatcccagctactcaggaggctgaggcaggagaattgcttgaacccaggaggtggaggttgcagtgggccaagatcgcaccactgcactccagcctggacaagagtgaaactccgtatccatctcaaaaaaaaaagaataaggggtaaaaaattttctcagaagagctaagcctggtaattaagatttttgtgttttgtttttaaatgtattataaaaggaatacatgttcatggtagataagtaacataagttacttgataataaacataatcccaccactgaaaaatagctaccgttaaatgtttggtgttttcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaagtttggtgtttatatttccagccttctacataacatatccgagttgtatatgtgtgaatagtacaaaaatagttttacataattcatagcaatacttcgtagagcttcatatcttgctttttttcctcttaatatgcattaaaaacatttccccaaggcatgtttttacaaagcatgctgttgcacagcttcatcttattgtgtaccataatttacttagtctttgtgatagttaaccgtttttctacgttttgcttttaaagcagtgagccaagaaaatctttgtacatacattgttttttcacagctctctgattatttcccgagtatgccaaaatgcttttgaaaggaggttttgcagtgcttggtactacccattagacatacaaatgctcattttcatcttttaccaacattgagtattatcattcttattaagtttttgttcgtttgataagtttgggtcatttattttattttgcatttatttgatttcaaataaggttgagtaatttttaatatgttatgctattggccatttatatttctaatgtaaattgctggtttgtgttcctggcctatttttctactagggtattttttttgtcataatgttctatgagagccttttttaaatgaaagatttttccatttgaatttctattagttctttgccttttaattttaattttacatttttacatagaaatttttgaaaaaaatcttctggtttcttccattacttctgtgtttgcaaagccttccctgtttcaagattagaaaacagttctagttccttccagctctttttttttctttttgaaataggatctcgctgtcttgccctggctggacataaatatggtttattttttgcctttaacattttcagatatttgaacctttttttgtgtgtgagctaagatctcaactcaatttttttcagaaatttagccaattttctcagaacaattaattgaatattctttccattaatttgaaatgctatttacatgctaaattgttatgagaagtttctggaatttctgttctgttgcgttgatatgtatgctgtttttattctagtcattttaagtaatggaagctttctattacattttaacttgtgctgatgttcctcctatacataggtcactgtggtcttcgtttgtttttcttggctgctggtgctcacttagtttctttggtgctttcaatttgaaaatatttcataaagatataagcatttagttgtatcttaaaggagccatcttatcaggtaaacattagtgtgatggattctgagattcataaagccctgaaacgaatgtttccattttgttcctttggcagcaggttgtccagagcgttgttcatctctacgagctcctcagcgctctgcaggtgcgtgccttcatcttccatccctgcgtttatttgtctagagaacagcagcttggggctgttgttgacttggatctttgaggtttgcaggatgtttaatggataaatggggccctcagtctagggaagactggctctcgtggtgagaaagttacagaatgcatcgaccttccaggactagaattagtgaagagctggtgtgccgtaggcatggcttgataaccatgctacaaatcacatagcatgctaacatgcatctgggagattacttcactttagaaagccttaagtatgattataagtttctatattccgtatctctgtggtatttgaatagagtggccttcctaatacagcttctgtttcggacttcccaggaacatcctcaaattctgctcacttcctttcttgaagatctaacctgtctcgttcctactttctcccacttccaacacacacacacacaacccacccacccacacagacacacacacacacaaccacccccccccccaccccaggtaataccactgactgcaaacagcatgcaaccagattgacaaaaacccgtgagttcctgcacctttgaggttcttgtatgataaacagctgcaattatcctggagcatttttatgagacgggcttgaaaaatgaggggagagttctagtccgtcatagtgcctggtgccccctgctgtggggtcgggagggatccagaagctcgctgtcgtcctggccagagttgcagggctcccctctgtgtgcctcccagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtaatgggactccctgccgagagcaacctaatgatgatattaattaagaccccctgtgtattaagcaaggtaagaaagtgagcagaaatatagagcctgtttttggccagatgctcatgcctgtgatcccagcactttaggaggctgaggtgagagggtagcttgaccagcctgggcaacagagggagactctgtctctcctaaaaaaaaaaaaaaaaaaacaaacaaacaaacaaaaaaaaaaaacagtttttaagaatctttgtagctggacacaatggctcacacctataaatcccagcaccttgggaggccgaggcaggtggatctcttgaggccaggagtttgagaccagcctggtcaacatggcgaaacggcgtctctactaaaaatacagaaattagctgggtgtggtggcaggcgcctataatcccagctgcttgggagtctgaggcatgagaatcgcttgaaccggggaggtggggattgcagcgagccgagatctcgccactgcactccagcctgagcaactccgtctcaaaaaaacacacacagaaaaacaaaaagaatctttgttttaccccgaaagagaggcagaggcagaaagtcttcttctgctttttgcatctctaagaggctgaaaaagagaatggaagtgctggggcattttggccagggcagtaatggatatttggagttggcacttccctcagctagaggagtctcagtgtgtctgagaaaatggcagtcagccatccaggattttaggagcaacgccactgctctgtgccacatcagaaatcaggcatggccccaacctgaaggaacttgtagcttaatggggaagcacaccaagaataaaagagcctccagaacatgtggtgcctgtggtcctgagacagcaggaaatggctctcaggccagagttgctggaagaacccatgtggcaggatcggtgggaggcagttacagagggaaacgcccatcccagcaactaggggaggccgccactcctctcgtggatggatgatattcttgcttggggatgttgagacagctgcactctgcatagttcctgatttgcctctctactgctgatgaaaaacctctctttctctatagctgctgcttatattggaaggcttttggttattcagcacactcactcctgagcttatttcagtgatattccttggttatttcgaaacatggatgcttgtggcagatggagagcctgggtgtacacagatctgcctgtgttttgaaatgcataccatgttgccgtttgtttgattgattgatcttggaccacgaaagaaaattatactgacagcttccagggtagggggcagttgtagctttctgcagatgttgccaaatatattgggggtggggagcagcaaatgccatgtgttgctttttatgacataaggagggattccacccccatcccaataaaatcggtgctttgacaaaggagggttcccaggcagctaagagaacccagagtagatgatcctctttatctctggtttaacctgtgactaggattcttggtgtaagctcggcttttccacttatcctctaaccggaacaggcttctataatctctttgccttaaaataattatctgcatccctgtgtagagcaatcttaagcagctctccttgtttcttcagggaatgggaattcttttctaagtcgccccatcaaaggtactattggttttttacaacgccggcgtttgtgtatgtagtaaaagtattaacagcattaaaggcgatatttttaacatgtttatagatactacttgggggagggcagctaatgaaaccttcaagctctatgcagtccacagacgtgagctctgtagagttcgcagaggtgggtaagtacccagccagcacacccagttgaattcagccaggatttattgagttggcatcacggacgctgacagcctccaagtgaaaacccttctcttgaatatgtacaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtggtgagtcacgcacacctgctctccctgtggccatagtgtctgtgcattctgagagagggtagattttagtggcatggggcggggttgaaaaggggacagttcagatgctcaaaagccaaactgccatccttttcaccagctccgcttgctaagagcactcatgcagcgaacattaagaacccactctgtgtggcacgtgtgcagaagcagagagcatgggtttcattttcaaggcattatccgatcgaggaactggagctcacccctcaatgaagtaattcaagtcctccttgcctttctgggcctagagtagtcattggtaacagctagcatttggtgatttaaccctcaaatgactgtatgaagttggcactgctaaccccaagagaagtgaggaaactgaggctcacagaggctaactaatgtgccagcggccacagagcctgcggctgaattccactaaatgcctccctgttcatgtaccactttttcccctgaatccttctctttaggattgatctctcctttctgtgtgggaggttaaagaaaaagtacattttcctggcctcttcataaattctagtgattatttaaaagttaaagggagcattaggcagtgaaggatatcacttaagaaccttattaaccaaatttgttcagaaaccccggtgcgcagaagagttaattgcccataagccccagtcgcctgtttgcattacagaagactttgggatggggaggaagttcaatgaaaggagcagtttttctgaatttttttcattcttggttttcacatttccagatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgaatgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattctgtcatcagatccagaagaaatatcctggttttccagcatgtttacccacatgttttggccatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtttccacgccgggacaccatgttctccatcaagctaaagaaatcacgtgcctgaaactgtgcttaagttttgggggaaagatggagttcctatccagagcccccagatttccagaatcgagtgagcttcctggaaggagactgcgtcttctctcaattccagtcatctcagtcgttgtcgttaggtgacatgtgcactttaaatgctctcatcggttggcttcattttcaagacaatcaaatgtattgactgtgttttcttcttagaaaatggagagggttaaaaacatgcaaactgccactttcaacctttgccagtattccctctacccccgtgagagctatctggggggaagaatccttaccaaggtttttttggaaaggtacgaatcttaacttttttccccttctgtgtctcagggtaatactattcagagtcgcccctttgctcattttctcccgtatttgttaccttcctgaggcctcagtattagtcgtgagcacaaagttttgagacctttggcgttgtttcttgatgtgggaggggaggtgttagtgcatgcaagggttgaactagatagaccctgccttagtagagggtgggactataaccttagaggccagaacttgatccagaagttgctgtccacagaagtgctttctatttcatcatttttgtttctagggctctttttctgtagccaggtcttcccaaggattttagtatttgcattggagttgaggtttactctaatgatggtggcccagctgtgcccagaggacagccaggcaggccctgggagggagtttagaaagacagtcctggtgaatgggcttcaagtggtcacaaagagggtggctgtgaggtgaccccagacactgcagaacgatgtgcaccctctgcgttttggatgtccttggaatgtgggagcctagaaataaccctgtggatggaattggggcagcggctgctggagatctgtgtgccttgccttccttcagcaggaccgtctaggtgcgcagccacctatggatgcgtcccagccagccccgtcgctctcgtccatcctcagagacaaagaagagggcagggagtttgggcttggttttgaactttcctttcaatgtagcaaagcattcctagttaaccagagccttggaatctactgcctgctggccaggctttaaaatgaaaagtgttttaatgctgccataaaagggaggcgggggggaggaagggaaaataaaggcatctttccaagtactcatctaatttaattgtcaaaagattgataggccatgaattacttctccatctcactaagggttaaaggcgtgcaaccccccactggctgtgtcccctgccaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttgcaaatgctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagccctttcaaaaaataataaatttcctgtgaagtt

SEQ ID NO: 38697 - DNA, 147248 bp, Homo sapiens
cgcagactgtgctggagctggtgctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatggtgagtttgccatttgctttgcttgtagtgtttattgcacggtttgggaaataggtggaatgttaagcctcaggaagagcgtgaagaggaggttctggtttgaagtttgagaagggggctgacggatttgcacctggaaaacgacttgaaagacaattgggatgtttgtaaatccggagcttctagatccaccgttggagagagtacactactaaatttttctgggaaagcctacaataagtccttttggctgagtgtgagagtgggacgtttaaaataagaaaagagtgaatgcttaaaacggagcactaaaggcattttagttagaggagctctgttctgtgggctggagttttcagagcaaggaaaagtcgcggcagaagctgggtagggtggagtctttttgtactgaacttcagctgcttcataaaattctttgtttagtaaaacctctgcagcaactctgatagctttgatttttctttgtctttggctcctcattctttcctctttaacaatttaaacttctttttaccattttcatttgtgaaaatgtgatcacttttgcttactgggaggcagtctcgtttgtttctccatgacagaggctgatagaagccagatttcttaaacagtggtattttcccaccctactggcttgattaacaggacagtggtggttcccggttggatggcggaaggcaggaaatcagcatgtcttgtatatatcttatttggcatggaatatttgcatggacattaccccttagacccaagcttttttttttttttttttttaaagataaatcttgcctggtgaccacatttttttcctatgcaattttcatatgttacagttgggttatatggtatggttaagcaaaaatgcatagctgttgtagtatataagaaaatatttaaattgattcctctattaaatctttaatcttgagggttgcaatttcaaatacagacatgtactcctttaaaataagccactgtagattttcatcaactcaaccatgtaacatcaaactcaagcttttaaaactttggacattcattaaccttttctattactttcatatatagacacatacatacaggtatatatgtatatatactatgtatatatctatatttttagaacaaatatctgcttctgtgtgtttttggtttcaaaaagtttataaaattaatctagagatcagaagttctaaaaagcttaaaaagtgaaaatacgaatttgtaaatgaatatccaacaatctgtcaggagtcccatagagggggcactttctaagacttggagctttttatgttacgttttatgtttttaaaatatgaggtaatttataaaaggtgaaaacttttgagtttctttgtaatggcatgaaaagcatgtgttgtttggaagggtggcaaaaataattgaatagaaagtagaagaaaacaggaggagaaaaacacagaaaaattacaatagaaattgaaaatttgactctagaaagaacagtttactcccctcccccaccaaaacaaccaactttaatttaaaacctttaataccactttctttgttaatttatgttaaaatgaataaagtactttaataaagtatggaaataattgaatatgtgaataaatgaaaggactgtttcacaaggtacatgaaataagccatattttaaaagacattcccaaatagttataattactctgtaggtgtttttgaaaaatgagcagataatttttcttaatagtaattgacataaatgtaaggaatgtgatgcttgatgcaaaaaagtccccaactccaatccaaccccagtaccccccgcgaacagtataaccaaatagcacagaaaatggaattccaaacatcaaattttacagaatgtgtaattgcttgcatatgtgttgtaaaaaattccagtattttatttctcaacttaagagaatataagtgataaaaattcaacagcaaaagaaagtcgtcattgccctaatcaaacataatagagaaaataattccagagtatagtatattcagagctgcttaacttatattgtacttacttactatgcatattttggtttaagttgatattgtatggatacttggcaatactttctttttcctgttcaggcctatcacaagcttaataaaggtgtcataatttagaaactccatttgattttgagtttggggaagagtaagcttagatcgatgctttaaattaaagaaatatctgaggcacacatgaaaagcaagtacatttttcaaattttatctataacagtcacataatgtgatatttacattttgtacaaatatgtcttcttggaaatgtggagatctgtttttgcatgtaagtgcatattaataagtttttatttttttctttctttttatgacttcagggtatatttccctttacttgactgtggttatttaccagaaatgtaaaatgtaatctgagtatgcctgcctgatagaaacatatgaatgagaagataaaagtaaataaataaagttttaggcattttaagccaaaatcagttccattctcactgagttttaagaactgatttgattttctaaatttataagaaactgaaaggagaaagtttgggagttgggctgactttagttaaaactaacgtaacaaaaattagggagttaaaatgaaaaaaatcagcttttaaagagtttgtgtgggtgtatgtgtgtgtgtgaaaaatcagggagttaaaatgacaaaatcagcttttaaagagtgtgtgtgcgtgtgtgtgtgcgtgtggtgagagtgtgtgtgcattggggtggtggtcttcaaaagattccacatttgtgttaaggaaaatgctagagcatttacagtgtatttatattcctaagttaatgcctagcatctagtgagctatatatattcttgttattagaagtaggcatgcttaattttagaaaataatctttgttatgaatcattgtattcaacatgggataagcaatggagaagggaaggtgcagaaatgtatcattttgtttccaaatactgtaaacctcaatgctttcagaggccaggcaggtaatataaacaagtgaagcaagccagtgtttgtacatcaataggtgatgatggggcctgtggagaactgaaggtgcatgtccactttaaggcattcagaattaacattttcagaagatattgcatatgacaaataaaatatatctgagtatatatttggctcccggcccatgaatttacagccatcatgttgcaatcctacactgatatcctcctggacccaagctaacttttgattactgagagatgaggggctcacagtcttatatgtcatggtctcttgcatttttatgatatgtctgccatttatctcattgttacgatacaaaaatcaggaagcagatatttaacactcagtagtatttggatgacatcattttaaaggaggtacagaatatgtataaatatgtatacatagcttaagatgcatgttaactcataaattgttttaaactcattactgttgaaatacatgctatgaaacatgtaggacattcagacttttatagtgggtacatgtagcagaacacagtagtttaaacaaacaaaaaaaggttttctggccaggcgcagtggctcatgcctgtaatcccagcactttgggaggccgaggtgggcggatcacctgaggtcaggagttcgagaccagcccggccaatatggcaaaactccgtccctacccaaaatacaaaaattaggtaggcgtggtggcacaaaaattaggtaggcgtggtcccagctactcaggagactgaggcacgagagttgctagaacccgggaggcggaggttgcagtgagctgagaccgtgccactgcactccagtctgggtgacagagtgagactctgtctaaaaaaaaaaaaaaaaaagttttcttttttaaatataaagaaatgcttttaagcaggtagtgaaaggctggcatattggctccacaaagtcatcagggactgaggttttttctacctctcctggctcccatatctctaggtatttttttttaaatttatttttatggtcctaaatggctgctgaagctccagccattgcgtgtactttctaggcatgtggatagaggatggaaaacaaaaactgtgagccattccccaccctgcccccttttatgaagactttaaagtcttcataacatttaaacttacttacagttggccggaatttagtcatatggtcacacaaaacttcaagaggggctaggaaatgtagcccttacctgggtggtgctggcaatatactctactgaattgagttctgctatgaaggataaaaggaagcaccactattaggagttttatggtccctacctcagtgagcaaaaaggtcagctacttttagtggcctagatcttacggtttcaatggacaaaatatagttgtgtgactagatccactttggttattgttcattactgagtagactgtgaagccaagaagactgaatggcacataaatattaggctacattttctttgcttcttgtctttagataaattttgacacctataacttctattcaaactaaactgaagctttagtttgaagagtatatctctttctacatatgtacattggtagattcatagatttagtgaatttttaatattgactaacacaatgtatacttggaccatgactcgtagggtcattggtaagcaagccacagatcagtgttgataaaaaatggtataaagaatcacctaagatcttgtgactaatatagattctagacccctctactttccaaatatctaggaagtttggatggggtctgggcatctgtatgtttttagagctctccagttgactctgatttacattggtgaaccactgtattaaatctttgactgacactctgaatcttgttgtggacctgttggcttttatgttccgaggctacacattaagattttggtaataacttgctattctagttattcattttacttataaggctgcttagttgaagtttgtaggtaaaccattgcaaagtcaccatcacttctggaaaaataactcaaggcccaaatacccctcatggtggattaggcgaatcattctactatgcagaagacacatgccatttgcatgtgtttccaggtgaatgcatgtttttcattttcaatatttcctctctcttactttctgctcttcacactttgagcactatcgctacaggcctgaaattcattgtgttcatcattctagacaggtacctaatgcaggatgtgaggcaaaagcagaaagaggaagctttgttttaagaagctggaaattagaagattggaatcgtgttaatctatggccacagaatgtagtttttaaaaatcatacagttttctctggtttgaagaatgattaatgcatcatcacctggccttacatggcattcttaaaatgtatggacatggatcaactgatctttaatcggattttcttctctgagatcacaacattgaaaagcttagatttatacattagagatatagtaagggtgggggaaaagactggaagtgttgattattaattgatctattgtataaatttgggcaagttacacaagtttatataagacaaatcttggaattatataaagatattccttgatttaatattttttattatttatatccatgaaactataattttcactaaaaatgtagcacgagacagtatcaacttactgataaatatgaagtctttgaacttttcttatatctaaaagtcacagcttgagtaggcttttggagtctgaatgaaattatcaggaagatactgataatctagttttcttaaatttatctccatataaagttcatatatatttatctaaattttacgtaagatgaatgagctgtgatattcaatatttaaaagactatttactcttggcatttgcatgggaagtactctatcctatggaaaattttgctttaaaggtgtgaccatattggcaaccttaaggtttttatttcattttatcaatgttttaaaaactaaacccttcaaataaatcaaggtggcttcatcttatactaaaatattcactaagaaacaatgtataagggaaattacaataaagcaagattattcctatctaaatcttgccttctacagagaagatagaggctgggtgtgtggctcactcctgtaatctcagcagtttgggaggctgaggtgggcggatcacctgaggtcaggattttgagaccagcctggccatcatggtgaaaccctgtctctactaaaaatacaaaaaaatttatctgggtatggtggtgggcacttgtaattcaagctactcgggaggctgaggcaggagaatcgcttgaacctgggagggggaggctgcagtgagcagagatcatgccactgcactccagcctaggcaacaaaacgagactccgtctcaaaaaaaaaaaaaaaaaaaagaagaggaaaaatgttaacaatattaattaatattaattaattaatcaaactttgttcctatagccttctggtgttatgttcaaactcaaaaatgtttacatgctttttttttttaagtttaggattaagaaggaggaaagacagtctcacagttttgtacccctttttaccttttatttgagatgcccaatcagaattgtgaattcagctttaagatgacagcaaactatattattggtggaaacactacttgcaacgtaagcatcatagcctcgttgtagtctatgtagtataacaagtataataaagcttggtccagccatcatgtgagagaacagctgggttctggtcctcgttctatttagcagttttgctacctgcagagggtccttaacctcactgggaatttgtgtcctcatctgaaatattgaggaaatagtatgcacctttgtcatctgatgggattcttaggaggaccatttaagaaatttacttaaaagtaattttagagtacttaaatgagacacggaaagtgacattacaatctacttcactgaccacagatataaaccctagtggtgtatttttaaattgctttcaccaaatctttgaattgttttgaagcacctcctggacttgttcttttgtgttttatttgttctccatctccctgaggaacttgttccatcagtcatgctctcttttctataacttcagccacttcctttctatctgctctttccctttagcttgtaaacaagttcagctctctcccacagcctgtgtctagctcccacccagtctttattcttagcccagctgctttaaaaggagcagtgcagttttctgtctctgcctcctatgccctcacttggcctctctttccacttaagctggtctagcatggtgaggattaaaatgtgtgatattccaagggtcccttttcatcttatcttatcaggcctttctcctttattggagaccattgaccactccagctttcctaaaatgctactctctgaaggttcttcctccacctccctgacctttccctctcagcttcatccatgggctccttcttctcttttcctgtagcattttgcttttcttacaagatttagttcattggttctctctggatattctcttcctaggccacctagaattaagggttttgtttaacagctgaatgctgataattataacatctcttcaaccccaatctttcacatgaactttagataaataaatatattcagctgtcccaaaggcagcctagaaccacatgaaattcagtgtatccaaaacttaatttattggcttcccttcaagacttggtcattttgcttatgtagtcccccttatgccagttaatggcaacatgatgctacccggtcattcagtcagtcattcaatcagcacaattccaatcgttcactaagatctaccattttacctgctaaatgtttctcaagtgtacctcttctccatccctactacaaatgcctcagtttaggccctcatcatctatccctcagttactgtgatagcatctaaattcatctccttgcctctcatgtatctgctttccaacaaacacatatattggtgccttctgttgctagtgtgatataaaactatctaattttgtatttaccttccttaacaactttcattgggtcctgtaacttgtagaaagaataaggttcaagcttcttagtgtgacatacaagatcctgctgatctagcccatttctgagttttagtcgcatcaactgtcattctcagcctcaaaataaggaattgcttgaggctgccacccccaacacacacagacacacacaaactctctctctcactctctctctatcccctttcattctctactgtccagattccacccagaactgacattctctcattagttgagctaagtgctcctctggccatctcacaacagtcagtacacctctgccatgcaggaacaataccatactgagaatgctttctttccatgaatccgttttacacattcccaccagattaggctaagtcccacttttataatgtcactctccagtgacattataatttattaacattatttattaattattaatataatttattaacattaacaatttattccaagctgccattgactgttgcatcacacttaacacattatactgaccttacttctgtgtgacttttttttttacctaagagtgccaagagtatccagctgccttgcaagactgctcatgttctcctccactgtatctaaacaaatactatgatttccattattgtccttaacactactgattgcagcacaccatgcagcatcctttctcacttcagatctaactttttactgttcccacatctaacttttgcgatttaggtacttcagtgcttctctttttatcttccctctgcctattgatgttttcctccaagttctgcttcaaatcttatatcctctaagaaactaagagattcttatctgcaataaatatcccctttcctttcaagggatggtccttatgttgcaagtgtgtttgtgctaaccaagaataagtttcctgggagatagggactatgtcatgaagtcattttatattttagatccacccatgcataaatgccaattgagtactatttgtgaaaatctagaaaaattttttccacaattcgttcactcaagtatgagtgatccgaattcaaatttaggttttggaaattgtatttccatattctcgggcaattttttttatttctctgtgttacagtttcttcatctatcaaattggaatgatacttcaaataattatgatgaatactatctatctatctaacacctacatgatagcagtgactcccaactaataataggaactcattaatatggcagatgattattattagattactatttaataataacaggccaggtgtggtggctcacgcctgtaatcccagcactttcagaggccgagctgggtagatcacctgaggtcaggagtttgagaacagcctgaccaacatggtgaaaacccatctctgctaaaaatacaaaattagctgggcatggtggcacatgcctgtaatcccagctcccagctactcgggaagctgaggcaggagaattgcttgaacccgggaggcgaggttgcagtgagctgagatcgcgccattgcgctccagcctgggcaacaagagcaaaaatccgtctcaaaaaaattattatttaataataatagagataataaatgcttattgggtgattatgagaaccaagatgttagatattacagagaaataaagaaacaacttttgctctcagagagattaagcctagcataaaaattttaaaatgcaatttttatattttattctactatgatcattttggtaatatatcagtgattttatctgtgtgttaataagcttttaaaacccatttaaaatttttactgttcaaataaaaaggccatattgtattatttccttttgtaggtttactaatacaaaaaaagaaagaaagaaaaacaaaaggcatttcccaatggagagtttctaatggccccatgatctgaagcatcactgcccctcccctgtttcgcagccccacatacatttactttgtgctggttcccagtgtgtgagcaagccaagcatgatccactccatgccccagtgccacctcatgcctgtctaccatccctgtctgcttcagagtttagtttgtgaaactatgataatcatagaagtctctattaaaaactggaaacctgttttccactctgcattgctctgagttgcatttggaatgagaggcattgcttcactgcacagggatttacaaagcagctcccaggactattcggatacagtagtaggggtgaccatcttttcccagactctgtagcaagtctcttcactttccaaaagctgttaatttacctcactcccttcactcccaggagatttttatgaaattgactccagaaagcagaaactggtgtgggatattggcacatttttcatactcacactttccttactttgctgcactgttctttctttgtaggttttcaaattcataataaaaaatgatgggtttaacttggaaggagagatgcaggtggaattttaccagataatttgtagctatgaaattctttaattaaatttttgatattcaatatggttgttctgtggtcatcaactttaaattttttttattatggaattctgaaaatatggatggttcccatagcaaatacaatttatttatagagatttaatattttcatttagctttcatagtaataggcttatttgctcttgaggtagaagaacctctcagattcatttatgctagtttggaagtattttaaagctttttttttctcattctttcgttctcagatttttatattaaataaatggaaagttacagtttaattcagggcactatggttttcatgttgtgatgaagtttcagccagaatttttggtgaagtggattggacagtgaggttaactgactaccatggaaagattaactgcaaagttcctagttttctgatctttggctacaaacataaaacttctgaggtttcagcaaaaagggctatatttgctttgagaggacagagggcactgaccattccatgttaagcgagagattctgttgtaagaattaaaaaaaaaaaaaaaaacccgggcacagtggctcacgcctataatcccagcactttgggaggccaagacgggcggatcacgaagtcagaagatcgacaccatcctggctaacacagtgaaacccccgtctctactaaaaatacaaaaaatttagccaggcgtggtggtgggcgcctgtagtcccagctactcgggaggctgaggcaggagaatggtgtgaacctgggaggcggagcttgcggtgagccgagatggcgccactgcactccagcctgggtgacagcgagagtccgtctcaaaaaaaaaaaaataggagtttgtactgggaaaaaagagacttgaggctgatgaatgaagagcaactgcaaattctatcagggagctggtgttcaagcctttaaggtgctacagtgttatgcccttctaggtgttattttgtgaaactatgatagtcatagaagtctctattaaaaactggaaacctgttttccactctgcattgctctgggttgcatttggaatgagaggcattgcttcactgcacagggatttacaaagcagctcccaggactaaaaaaaaaaaaaaaaaatcacttctttcttcaatccttccctatttttccttaagttttgataattgttgatgagattaggcaagttttttatttgtggcttttgttgttctctcttaagcatagtgtagctgaactgaattttgcttagacacaactcataggtttataaaccaatggagttctcattagcctagaaatatttccttatacagtacttagaatcatttttgtttgtttgttttaaaaaatggagtgggggagtgtattctgttatgtaaaggatgacaacaaattgaattagaattagttctataaagataaatcagtgaataggctctaagtttcactgtgggtgtttgtgttggggcataggaaggatgacataataaaatagaattggtaagttttagtatattcagcatataaatacatcttgtaaagttgccaagtgtcccgctcacctgagctaccttgtgcctcttgactttccttgggtgcaacatttgctaaagtcctaggagtaagagcaggtccagttctaagaaaaaaattttgaatacctggcttatttttagtttttaagggaaatatgctttcattcacctttctgtctgaaggaaaggcatttttcaggattgggaggccatccttgcctttccagtgttttgcactaagctccatctggatgtctttttcccagattttctttcaaatttcagacttttccttccagcctgacctcttatcacaatttacctgtttggcattcttttctttccgagcctcatggggagctaatatagtccagatgccctatagttagcgtcctaggacacagatttaatgatattatgctcttgtcatacaagcttgttatatggtaatttgccttttaagatctttttctcaatattttctcgccacgagaatcaactgacatactggctctgggtaaaagccccagtatcccagatggactccgtggctcacactacagacgaataaaattcagctgtcatagacactctacttgcccacggagggttccacaatccaaatgttaaaattacttcaagtcttttctaatagaaactgaaagctgtctggttataatcaaaatggaaatttgccagccagattcctactgtttctgaagagggattttgagtttcttcaggatagaaccctaaaattgccccatggtatatgcccaaagtgacctaacttggccagctgaatttcagggagatgctttccaagatgacaatttcactggaataatttcagaataggtagttctctgcccataatgtccctttcctgtcttaggtgatttaaaaaaaaaaaaattcaacctgtctttcttctcttcaaaagcaagtttcaagtcacacctgggtagaaccttatgcctctatggagactgcaggatgtggaagacaggagagagggtatggagagcagcaagagcctgggaagaagggctctccaagagtatataagtgataccaatggacaggtggctcacatagcatcattgaaatgcctaaaatgtaaggctccatgctaatttagtatgaccatatctaagtgatgtcttgggggatttatttagtgaatttcaaaaaatttggaaaagtagatgacatctctcaacatatgttctttgactcttctattttttaccctattttttaaacatagtcattttagaataaataaatagataaataaataaactgtgtcacaatactatattctttcggctaaaagcacatattccgtcaactaggcctacaggcagtaggagtaggacactgactcagcaatgagtttttgttttaaattgttattttgggagcttcccaagagttcctgttaccatttttctacatatagagctttttacagttagcacttcttttccatttactttcaatacacagttaacaaaagaagggtctttggattcacatctttgggtccagactttgccgtttgctaaccttgtgaccttgaacaagttcctgatcttctttaagattcagtttcctctcctcgtctgcatattgaggagttaaattaaaatgcatggccttaatgggcactgaagaaatgtggatgttattagtacttttagaatggattccctgattggctcattacagacttttcctccaataactaaaacaatttttatcagattattcccagttactaggtttgataggaggaaggataagggagcagtgaatcctaggcacctgggacaaaattggggagggagtggaagaggaaaaactataactgggagatttgaaatgacaatagtaaattttcatttactatgtatttatatttataattatttttacttatctcatgtttttccctttgggcaggtttgtgcttagctcttgattatttacaaagcatttcaggaaaagcaaaccagcaaaacccccaaaaattatcctttggtattagaatgcatttggcaaattaagtggtacatatacacatttaatttaattctttctttctaatataaagtttttggcaattgtttgcacatttgcctttggtagagttgtttgagaaaagtggaaatatgcttaagatatgaaacatctgtttattttaatgatattttactgatgtcaagacagacttatttgagccctggggcagtatttttgtgagggatggcatgcaccttgcctgagcagtcaatgaagagaaagcagctgtttgagcttgctcaacttctactaactcaacgtggatagagtccagatagcaactggccctgtgtcagatgactgcaataaagctctctttccttataaattctttataaacatgatgtgttggggtcttaattttctcatttacaaaacagagataatactttatatttttctaccttattggttcaaaagaaagagttcataatttctgtagaaattcttagtcagctgtaaaaccctattacataagcatatattatattacataaaggtgttattatttagcatgcttttactgtaatgaacagttagctaaatgcaaaataaaattcttctctgaagtaaacaataataataataatcaaaaggaatataagactctccatagaaataaaagaaggtaaagttgtattttttcaaaatcatatttaaatcttttatttagcaaaataaaatagactgcttatataactatctagaacatctcccaaagccccagaataggaattaaatagtaaaaaaaaaaataagaatagaggctttgacttgaggaaaaacagaacagatagaaaaacaaaatgtgatttttctgctataactggactgtagtctctctacaagtgaaatgtagcttcctggcagaagcctgaatcactattattattactttttctttattcatctcgcatcaggaagcttgtctcaaattcaaagttaaacgctaaaagcctgtttgtagcatggtatcccttttctctgggtcagaaggtgactgagagctagaagtttaaactggtgacaaatatccacaggcatctgagccaaacgtttagaaaaaagtcctatcatccctcaggcctgtctacattctggtattttaagactctctacttgtgtagagagaaacatgcagttaaagatatgagggccttgactaaacaggctgttactttcatgaatgaattgttgaaataatttgaaagaaaagcttctaaattaaaactggaccaggacacaggaaatctgcatcataattgcagctctgtcatggactaacttggtgattttgtggaagtgacttaaattctctggacctcagttacttctgttgcaaaacctgtgatacattacccagagctactgtctgctttgaaagcctgtgactatagaatatttagataaaggtacttcacttaagtcatatttgtgctgtaatacagtggaaagtctcacctacacattttggtaactcgaagcatcacacataatctctatggtaatacatttctgtacttgtgagtttgcatttgaagtttagatcaattcagatttgtagttatgtccctaaatatggtttatttaaggagcacagctcccaatttataacttgtaaattgatctgcttttcagtgagtgactctacaataaagttcctagatgctgttataaaagatgattgtaaaaaaaattcaaaataatctgatatcaaatttttcatattaactgaattttccaattagagagaaaatatgtaaatgcatcatgtgttgtgttatgctgtttagccacagactcagtgttctctaaatgtttttggtgagaagggatgtcagagtttagcagcgtgccttcttgccctgatgctggcggattcatctttgcaatgcttattttttccaacaatccttgaacataccaaactgctatttcattcagaataagaataagaataataatgaggaaaagaaggagaacaatgggacaggtggagaaggagcagaataatggggcgagagagaaggtgaattattattattattattaaatggttgtgggcttttacctgaggagtagatcatatttgttcttgattccttattttttgcctcttcttgacttcttatttttcttggcaatcatgtttgatgggagatacataagtgtttactatgaatatttagaaaatttgatttattccattgatattccttgagcacagaatttttttggaatatgctgcttgccctcctttatcttctgggaaaatgggactccatttttgtgtttgttcccccatttccctccttcactagtactgactgagtcctgcaaacatttatcttctcaagtcctgctagaattcctctcccagggattctgggcagaaaacaagcctcttttttacatctttacaagtagtgtgtgtgtggaattcaagtgcatgaaacattcagattaaaaatctgataatattttagaaattccagtatacccacaaatactcacatgtatgtttaaatcagggattccagtaggagaaaactgttagattctagcttaatgtactcctcaataaatgaggtatactttggtcatcgtaaagcacttgctaataatttactactttgggggatttaaatcccattctatcttcagaagtcattattaaagtgttatcagtaacattagaatttgctttggatgattctgacaaattcaacgttttattaaacaaaatgatgctctggtctcaaatgatggagatttcaacttgcttttctctacagaggagtatatcccccaccatgcaagttatgaggcatttaccttcatttattcattaatttggtaaacatgtgctgagtacctgctctttatcaggttctttattgattgatacagaaacaaatatttaattcttactcccaagaagttaatcgtctagtgggaatgagacaaataaaacaaggataatactttgtggtctgtgctgtggcagaggcagacaaagaatcaggggaataacagaagacttccctcccacatactgcctgagaggtggaggactgggatgggagctcagggaaggcctcccctggagggcacacctgagaagtcattccgctacatgaactctgttattttccttatcccttattttttcctccccttcacatccaaatctttcaagtccgccatcaagtctgatgtgcatcctctttgaaacctttttgaacatcatagacatattttttctcttttctctaaaaggtagcacttcctctttctttaacacatttagcacacaataaatccttttatttattgcccactgttttctaaataacatttattgtaaatgtcattgattttttagttatatcatatgctccttgagggtaaagaccatctctcaaacccagaaagtcagatccagctccagtgctatgcatatagtagaaactcaataaaagtttgtgactgatatttcaagcaaaatatattttcttcatgtttcaaaattaagtgctttttctctgttgttagattgctgtctaattacattgcacaaccttgcctaagtttttatatacatagcattgagcttaaaaacatggaaccagctcttatgcataatttagctatatttagcatctttggtccaaagccttataaaaatatgtacatcaaagcactgtaattaaatggaaacaaagttaaatttatattttacttgttttatttatagtgacttgagtcagagtatagggacacaaagatgattgacatattatcttgtatttaaggaatacataatgagaggaatagatacattaacaaataactataatgctgtctaataaatacagtgagaaagaatggcataagaggagtatccagcccacccttgagagcatgggttggtttcttgcagatgtatccaaaacataaaggatagatgtatagtaactagcagaaatgacacaagaggaaggacaagaggatggcatctagataaaaaaaaagtacagccgggcgcggtggcccacacctgtaagcccagcactttgggagatcgaggtgggcagatcacctgaggttgggagttcgagaccagcctgaccaaccccatctctactaaaaatacaaaattagccgagtatggtggcacatgcctataatcccagctactcgggtggctgaggcaggagaatcacttgaatctgggaggcagaggttgcagcaagctgagatcgcgccattgcactccagtctgggcaacaagagtgaaactccgtctcaaaaaaaaaaaaaaaaaaaggaaaaagaaaagaaaagaaaagaaaaagtacatgaagaaattctcaggaatattaattagcattgttttgcagaaaactacaactactttaatgtcttagagcatagaatggaaggtaggaagacattattattagagttttgatttttttggcaatttattgattgattaattataaactcagtcttcagtagtaggaaagacagcaggtgtagacctttatttttccttctctgtgcattaaaaagctgaattgtaaagggaagaagagctataggaccctagtcagaacaggatgtagagtccagtgaggatttttgttttattttattttcagatggcagagtaggctgtttataggcttcagaaaaaagctccataaagaggaagatgttgaagatagaaaaaaaggggggataaagattgcccaagatatagaaaggctttcttagagacaaagtcagggttttctgagttggctagtggtctatactctgttgacatttatttttggtgtcttctgcctctacaaataataatatcacactacatataagtagtattatacaattcatgaagcattcccacttcttttatgcatacattctcagaacctcagattaaagatgaggacactgaatctacaaggaatgaatgatgcagaggatgttggacagaagtatagagcttcagttttctggcttctatttcagggctctctcaattgtatcttacagagaggagaaaaaagggaggatggcaattttagtcaccaagaacaacactctatgttacctgaaaattatttgtgttcagtgctgagttcttagagacttcagtgagaccaaacctgtggcaggcaataatgaggaaaaaatacaatttactgttttatttaaaacaattatttatttatttttaatttaattattattattattattttttgagacagggtcccgctctgccacccaggctggagtgcagtggttcaatctcagcaacctctgcctcttgggttaaagtgattctcgtacctcagcctcggccttccaaagtgctgagattacaggcatgagccaccgtgcctggccaatttaatgttttagaagtttagatttttttaaataattttttcagtgaatatgcataaagaggaagatagaaccacacaacttttaatttactcaactaatacatttacttgtaataaaagcagcaacattgtagctggaatctggagttgaaaacaaatgtaatcacaggctgtgtgacagtgcaagagccaaaaatgacttttgagaaaaatataatgcttgttcagcattcagtgagacaatcctaattgttagattttctgccttagctttagatacactgctgattttaaaatcgatgaaacagtcatcggccaaatatttattgagtgctttctgggtctctggattctaagcaccatgttagacattacaagtagaaagaagaattagaagtgggcttacttagatacctaatatgagagatacaattagctatagattcctgtgaagagaaccaatgggtatataactaacaacatgcatgtagaccagcttaagcagagaccacatctgaaccaaatattttcagtaggaggttctctaatgaaaatgtttgtttgctaagaaaatatttttcttcctgatgtagtgacatagatgatcaatacctttgttcaggtttctttgagggtggttaaaattgagttaaaaatgtaatcatctgcagaaatgttttaccaatttgtatgaatgctgcctatttataataaatcaatccgtagagtataaatatttgtgtgacttcggtgcaccaaataatcaatctatatatttagtaagaaattcagaagcagaatccttggttcctgaccttgggaagtttcaaatttagttgcaaaataaacacttgaaataattaggctaagaaataggatatataagcaccaaacaaaaagacattaaagttttggtaataagtctagagtcagttcagggaaggggaaaagttggagttgttgggaaatgagtgaaagatttcagagaggaagcagataggagaatatagtgttatggaaggtatcagagatactcttagaagagattgacagttcctgtatcacagagatccaaggaaggatgaagaaaagatactgaatctggtactgtggtgttttctaactaattttgagagagtagttgtttttacagttaagaaccaaagtaaaatttccagaggttaaatctcttgtatattctaacatattgatttctgaactaatttcacagtagccatttggttcatatatttgacttaaattgtactcagctaatttcttttagttttatattgtttcttaatgttagggacctcttgaatactaataaaatgatggctatggtctattggtatttgcactgtgttaatacttttagtgctaataaatgttcatagagctagtaagcactacaaaaatagaggactgtgatcagtggctttagtaaagaattgcaaaaatgttttggcttaatatttaatcctttatgtaataataatattggtttttaacctaaataaccccaaatttccataaattactcataaaagtcattactatggagtcggtcattgcacatatctgtagctattactgtaatgattcttagtaactcatctactgattactgtatgattacctaacactatgacttaataattaaaatgcagaaaatatttattggacctgtactatgtttcaggtattgtgctaggctgtagggataccacagtatataagacacagtctctaccttcattgaagtctatctagagagagaaaaacacagatgtgtagaatgggaatgttttgaaaatttagttgccacaaaaatattgtttcctgtttagatcaagaacaaataatatatgtatgactaatatcagattaaaaatactgtagtttattattgcagtgatttcattgatagtaaaaatattaagttgtttcttcaaaccaagacataccagaggaaatagaacattttgaccaaagcctttaagttttatttcaaacaagaataccacaaaacatttaattccactgaagaattagcccacattttatttttgtcatccaaaaacattacattccaatcttccttttactggtatgtgggaaaaacactttgaagtagataatagtctggattgggattccatgtagtctactctgtccagtcaggtttgcagagtagtgaaatatcaccttctctagaagataacagaactatgtgtttgtaattattgttgaagatatatgatgaaatcatattcttgctttttttagacttctttatttaaatgtccttagcatgctctgtcaatttaatgaatattttaaattcttctgtaccactcttttcttttttgcctttaactttgttttgggttaaacttccagacgtgtgattatttgtatatgctttaacacacttggaagaaatatatttaaaaaataaagcaaatttatacaactttcatttttaatgtgaaatatgatctataagtcttagcactatttgtatttggggcttcatgtgctaagctatatatatagatatatatatgcttagcacatgaagatatatagatatatatatagatagatatatcgatatatctatctcacagctggaagtttcattaaattttgcagaatatttaactacttgcttcagtatagcctcagtgctatcccttgtggagatgagtaaaaaacacagacaggtagttagaactattacatagtcatattaacagttgcctagagtgaatttaccattttgtcaatagatattatttttcagctactgtggcaactaatcttcagccatatttccactattttattgcaaattcttaaagtgaatagactatatatgcttattatattcgctagtgtgaattaatagtggattttatgctagctattttggaagtttcagaagataatgtgattttacactgtgagtttggtggaacttattatcagataacagactcaaatattcagcacaaaaacatagttgagaaatgtcaatacatatttttggctatagagaaataatattaatttttcatactaaagcatcaatgtgtgataatattctgcttataaaagcctatgtcttattggtgcagtctctccaacaaagctggatagccagactcttttaaaattaatttatgaggacaagactatcaacatacagcagtaaactgagcataattgaaactttcaagtcttgacaaagccttgtgaaaaagtaatatattaaaaagaatgattttatatatgagtttgtcttcaaatgtaatttttatatttttaaaattctgcagttgtcagtatatatcaaaacttgttccccaaagaagaaattttgaaatttatttacttaataaatatttatttttaagggcaatgttgtcattctgaggatacagtaatgaacaagtctctgagcttcatggaacttgaattctactgcagggtgtgaatggcaaaataatggccatccccaaagatgtccatgctctaatctctgtaacctgtgaatatattaccttatgtggaaaaggggaattaaatttttagatgacattatgattgccaatcagctaattttaaaatacagatattatcttggattaactagctgggccccatgtaatctccagcatccttctaaaaaaagaaagaggcggaagatgtgatgacaaaagcaggaatcatagccagagagagagagagatttgaagataccactcttctggttctgaaaatgaagagaaagccatgagtaaaggaatgtagttggcctctagaagctggaaaagacaaagaaatggatttccttctggggcttccagaaggggtgcagccctgtcaatatcttgatgttagcccagtgaaacccatttcagacttctgacatccagaactagaagataatgaatttttggtgttttaaatcacgaggtttgtgctagtttattatgacagaaactaatacagagaaataaaagataataaataaacaaaaatatatattttaaaaagataatttccagtaataagtgccataaaggaattaaaaacaggataggattctgaaacagtgctgtccaatataatatacactaacacatgtagctgtttaaatttaaattaattaaaatctaagtgctactagtgtggccagtgactactatcttggacaatgcagataatagaacattgctatcatcatagaaacttgtcttggacagtgctgttctggagaatggtactacttcacacagagtggattcagtttgtatgaggatctgagaaggaatcaggcaggtgaaaggcctcccaaaggagcaaaatgtagagcagtatgtgctataaaataaatgaaacagatgtgatgtaaagcattttaaaatctcccaaaggcctagtgcaatggctcatgcctgttatcctagcactttgggaggccaaagttgaaggatagcttgagtccaggagttcgagaccagcctgggcaacatagtgagatactgtctctacaaaaaaaaattatttaaaaaagttaactaggtttggtggcatgcacgtctagtcccagttacttaggaggctgaggtgggagggtcccttgagcccaggagctcaagggtgcagtgagctctgattgtgccactgcactccagcttgcacattagagtgagaccctctctctaaaataaataaataaataatctgtcaggatactttagggaccttattattattttatttcaaggtactcataaccactaatttattcattcattcgtcaagcatttagttacaacctaattttatttcgagttttatgccaggtaaaatatatacaaaagtgaatataatggaggtgctaaactcatagaaccaaagtctagtagaattctccttttaaaaattgtggttcattttggacagcacggtggctcactcctgaaatcccagtgctttgggtggccgaggtgggaagattgcttgagtcaagaacagcctgggcaacctagcgagatttcatctaaaaaactaaataaataaaaattatggttcattttgacggccacagaggccattgattctgcaggtggagaattaaactgcaatttctcatcatgctagggagggtgagggaagagggaaaccagcaagattctgctatgctggggactgcccacttgtccagtatcagagccattcgccaggtcattttgtggacctgattccactctggtatcaacccacatcatatttgtggaagaagaagaagcaggagtcatgaattatgattctcctagcgaatgagcgcatccttattaaaccttgttaagtcctgtgaataaattttgagctagaactttaacttcatactatagttttgttggtgttactgctatgcattcatttcattactgctgtgtagtttatattaatgacattgactttcaaatatcatgtcttagagaataaaaaatagagtttctgatatagtaatctcctttaaggtatccaaagagctgtgagttgtctgcatatgtgcatgcatatgtgtgtatgtgtgtgtgccttttttgtttgcttgtcttaattttttaaaaaatgtattacttcaagacactataacattgactcataaaatgtgtagttattaatatgactgaaagtgccagagtttgcagtcagtaggttgcaattttccatagccagggaatattggaaagctgttattcaaaggcaatgcagaatcttagggggtctatacaggaactaccttttaaggaaaatgcgtcttaccagtgaaagtgatggaggatgatttccagatgttcaaatgcttgttttggcaactgctacagaaaactgaaacgtgttgccagaacaaccaaaagggatgtgaagcactgatgtaagagggatcaggccatggaaagcaaggcaagcagaaaccagagagtatatagagagataccagagaggggagatagttgagccaagagaacaaactttagagccccagtaattacatgtagtaaaagcatatctgcctctgtatgaggatgcacacccaagcttatcacccctgtgcaccccacttacactttcctgtgctttcttcattatctttcctgtaactattgatgtcattatgttaattgggaaaactcttcctggctaatatgcttgttagatattatgggttagtgaagcatgcatgactggggttaagcagatttgtcttcaaatcttgagttcattcttgactaccaggatggtcttgactgaatcatgtaagctctagaatgttcagtttcttcatctgtagaatggaggttataatattattaccaaatagctgttgtgagaaccaaatgaaataatgtatgtgaagagcatgcaagaataggtttcttctccatctgactccttccaaccaatttccagaagtaacattacgttttttgcccagttaggaaaaatacattttcagaagacatctgagaattgcatgtaatgttggcagactcacagattgaaaatgtttagctaggttgactttttgtgggctcttggtttagaatcatataggcaaccagatactgtgtctacaaatcaggcagccacttgggattgttttctaaaagatgagaaaatacaaaaaataaaaatccaaccttgattgaatatgtccttttacactctgaatatctgcagtgtttcttttcccccaacttttttttaaacacgtgttgattttacagtgcagactattaactgccatcccaaaccaaccagttccaagcagttcaagataaataaaattccccatctgccttcacatcttggtgagatctttgaccttcatttctaaatcattttgattcctcgccaccctcccccaacttacttctacaatgctctccaccctagctcatttctgaaaaagagatttttccaatctctgtgctaggcctggtcctgggccagaaaaagccaggctcttccaaaaagccagcctctgcgggagttggaacctaaaaatctaattcatactgcaactattttcccagggggtggagcaacaggagccaggataacagaaagggatcgctgtagggaactagctcattccacacctggacacctgactgtgttccactgtgaattctctgggaaaggttttgaagtctgtattttgagttgagctacattgtgtgttggctttcacatacattgtgtgtatggccatttcaacttaccatattatctgtccatgccctttgacatcttaatttctctgaggaaacatcacagagatacaatttagaactctttggtatcataacttgtagcccggaaggcatggagtgctgaccttacctattattgtacttgaagttagaaactctcaccttaaatcctagatttttcatctatgagctgcatcatcttgtattttaaattatacatgtaagtgtcaggttccatatctaaaaaatgtaaaggatgagaatacttgctctgattactttgcagtgtgtaaggattgaatgaaatcatgtgtgttgaagtacttaaagcagagtagatggctcccttcctagttctcctctgagattttgaagaattctgttcatattgcattgtaattatttgactctttccctctactgactcaaaaacagagattaattttttaagctatgaagtaagcaaaatagcataatagttatctttctaatataactactggggtcttagacccaacagtacactttgaagtgaactctatagttatgtgatttttaaagtaaagtggcttttaaataaatatagcttgtatataatttcttactaggatagagtttaaccaaagttattgagaagtatataaggtgtgtgcagtcagttgaagaggctccattacagcagagttttaagaataattatagagagtaaaattagagaaggtacactagtgggttttacagtgaagaaggtaagaaaaagagttacagatgaatatgtgtttttatggccttgcttatattttaaacacaccttggcaacttatcatggaagaggggtaaactaactgaaatgaattgtatagaagcaaaaactaaatgtcaggtgtttatttgatttgccagttatctagatcatccttactgtttaaacatttaccgtcatgtatgttttcagtcatggattcaacagaaaagacagtcaaaacccaattattatcactattgcttttcttgtgaagatctgttatctagattgtctttgctctgaagattgcttcatttgtcattatgcctttattaaatataaaacataaacaatttaaagacctactataacaccatttgccatagaaattagtttgctttaaagaaggtacattttggatgtatatccaggtaagaatgtgtttattctattttaatggaaggggtgaagggcatgagttcatttcaaagaatgtaagagtaagatgctgggggttagtgtgtcttaaaatgtttgcagtgattatctgtgtggaaatgggttacatttatttcttattataggccatggtagctccttatggtagaaagaataataagccaattttggctgccaggtaatccatgattttttcatcaaattacgttacagactactgtcctccatatttatgcatggaaacactttctaaaatgttatgtgggattccctgtggaaaatcttttttaacctttgacctaactgagaatacaatgggttccctttgaggtaatgaattctctgtctctggaagtaaccaagcaggagctttacagccacttatggatgctatagaagaaattcctaagaaattggactaaatagcttcttgttctcttctgatgctctgtataaattaatttagtgtttgaggaaccaaagataagcttcctaagttcattctagaacaaagatctgaaaatagtagaggttccaataaacatcaagaaacatttattgtctacagaaaactttttatctttcacggttttttaaatgggagtaggaggttatatcaagaaatccaagcttgatttaggtcgattttattataagatggaaaataatagcagtccatggagacactggcatttcacactaaacattttaatttttgagaatttttttaaaaactaaaatttacataaaaaattagcatgtccaagagaactccagttgattaaattccaaacagcaatcacctcagcactgtgtcctaaggacttttatattgatatgacagaatgagagttgcatttgtgtcctgatatttggcaattagcaggagctctgtttgccttgtgtgctcagttgattgtcatctgagagcattctggatataatttaatgcctgttaagtcatctctaaagtacgattgtaatacagtaaacaatcacaactgtttagtgtttgcacaattgcttgctttcatttgaccttattatagactgtgagcctgttagtttgattcgtgaaggcacacacattgttcaggaatgtttgccagtaatgagtgagggctagttttccatattgacctcatacataattacataaattaaagcaaaccataacaactgagggtcacataaaatacacttcacagagagattttaaagcccttgcattgtaccaagcttgaaattatattgccataagacacatatatcatttttgaaaagtgtatgtttaagtttctactaagactttacaaagaacactaaataaaaggttctattttaataagcattaccatggagattttctctagaaaaacttggctaagaaagaggattgccagtgtttttattctggaggttaatgacttgatgatagaaatttctaatgctaggcttccaaacagtcttgaaaccactaaacacttaggaaaatgcaaatgtggaatttagatcttaaccccctgaaaacattagtgatttttaaaattcacttatagtttcttcattcttgaaatttcagaataatgttgatgtttagccaagttcaatttaattttataattaacctttttcatatgtgacttttttggttaatagtgtagtcgatttttaaaaatgtaaaatatacacaagacctctgcaaatgaaattgcattccatgtgactatttaagaaatcatagactttcagagtttaatggaatatagagccaatattaaatatatttaccaataatttcttttagatggtggaggccaaagttttagttatcaatcagatattaaggttccaatattattaatcagcaagtattacttcatttatttcactttctaaaacaattttgtttgaagtttatagaaccttatttctattgttttcactagtttttgaagcaacatataagatgttatcatgggaaaatcttcacctaacattagcacatcaagttttctttttgataagaaggaagttgaaatgtctttggctggagtatttttcatttttcaaaacttttattggagtacaatgagtcttattctgtcgcccaagtgggagtgcagtggtgcgatctcggctcactgcaacctctgacttccgggttcaagtcattctcctgcctcagcctccccagtgggtgggattacagtgcatgccaccacgcccaattaattttttgtatatttggtagagatgggtttttgccatgttggtcaagctggtctccaactcctgacctcaagtgatccacctgcctcggcctcccaaagtgctgggattacaggcgtgagccactgcaccaggccataatcagtatttcatgttgaagaccatgtcaacattaaaatgagcttaatgaccactaatatattttgggaatttccatttttggttaaggctatggtctgtaactccatatatgagattaaatttgtgctttatggaaaaatgaagattcacctaaatctatgattctagaatatgcattcctaggtttagctaagtctttttgattgttatagcatttcataattttctgacaccctattggagggcaatatggactcatgtttattactaactttataatgtttttctcttcttaatcctctttttacatcttttaagtctcaattcacacccttcacagtttagtagacttccctggcctatcgcactctttcttggtttcatcttcccagcttagaagacctgtgtcttctgcatggattcatccagagttcttacctcccttgggtctgtggttgccctttgcttgattctttccacctctatgtgtcttttcttacatgtgtcaacttatgccacatgatgtttttctaacctgcccatattatgactttaagtgtcagatactactatatatatgcatatttttttcttgacaaataattgttggcctataaaactagcatcttgcttggctatctcaaagtatgactgtgcaaaaactctgagatcattttctgggtctttcacatcataatatagcttgtcatctaagtgaaatttgggtttccctccccccagtgaatagtaacataattttttgtgaatgcaagtgcattttccacaaagaagttcatttgtcctctttctattaatactaagagcatcatggcgctttttaatgataatcattgacattttttaaatgtctgaagtttaggataatccagaaatggttctaaggatctgtgatagactcctcaagaaattctccaccaactcatttggtagagtcccgggaccatcagagaggagataaagcttctcttcctccttctccacctacttccttacccttgggactttgctggggccctggggtattagttaaggcatgtagatggcctgcaaggtaaagaagcactctgatattatctgtaagcccagaacattctctgggtaatgttttttctagagacgttatagcactgtagtcctaggaagccctcagtatttgaatttttccacctgaagaaatatttttttggtctttacttgtttcttgactctaagacagctccttatgcatgttagaacatctttccaaatcccatggtgattcaatcttcaagcagtttttgtatgaacctagtcatacaagtattcaagcatcattttccctcccagtaccatgattcctctgtgagttgtattgtgttaagaagatagttattctctcctttgtaacagattccaccagatcacctggttgaaagtaaaccttagatttccagggtcttcgctgaattctgtctttatgaatggggatcatattgacaacttgtcttttctggtttgcttaatttgttactggtaggtcatatgtcttggcttactgttcaacatttaacccttacgttttttcataattttcgtatagatgttatagcatcttaggtatttatctgtgtcaaatataacaatgcatttttggcaatttgatccagtattttggacacacataatttaatatgtagtttaggtgttgaaatcgtcaaaagaatacattaaaagagaaaagaactaactattcttttagtattaccccaataatacaattttatatttaggatttctttggattccggaattggtttccttcctctgtttgacatttttaagggtcttcttattgttggctttgaagttacttgtttcacaatctttttcacaaatatagtttcacaaagatagtttcacaaatctttttctggtctaatttccagttatgtctgatgtgtcaaattttagaggcttccctttcttccttgacttgggaaaatttgatttagatgcttgtttcttcctatgaaggcagcttttactgtaatagtttgctgtgaaagcattttttaatgcatctggcttgtttttatgattcatgacaaaaaattcatcttgggcttctaatgatgtattttaaaatagtctccagacgtcccgtggttcattttattttaaactatttctttttacttcttttttaataatggccagattttcctaagttccctttactaaaattaaattattttatatggcattccttttttcttgccaaatgctaggcttaatcattttgaatactgtgtagacagaagtgggcacccatgatacaaccttcatcaattcctgctcaagtctgcctagactcggaaaatccaattttggcaaactgatgtctgtaatcatctgtattcttgtactccaatgtgcattctgtatgtctatgatgggattacaatataaattcaccttatttatactttatccaatgttttcactttctttcttgttatacactatttagataattttgcttaaatagtgtccctgtagcccatagaataagtaaggttcatattttttagtttaacaaccaatgcctttcataatttgatccctaattattctatcttcattcacttcccactgaactttttcttttcttttgcagtacaattcttactaaatggtaaaatttcacaactgtaccttctcccagatctttctggaatacctttcccatttccttcattgttcatccgatcaatgtatgaagatatcatcattctaatcaagatgttagttgtaggtgccttttcagttaaattgcatgtaaccttcctaaatccttggtccttgccttcaatgtaattctactgtcttgctctttatgagtccagatgtgagagtcattacctcactcatgtacatggcaaactccactcatgtcaagtttttggaaatttaataatttaactgaagatttttggttctaaagaaggatcacagtattaaggactatctatctattttctcctttttttccttttcagaaaataataattatgccttatctcatatacttttgtagcctggtttcacctattatatgggtcttcccctatactctaagtagcttagaaaagtatgtatttttctttaaaatatggtacttgcccaataaaaatccttctgaataagatcttcttcagctcattaattggccatagtttttaaagagcccagaatgatctaggcaatataatagacactgattatatagcaagaaaattgcaggtcaggtttttgtgttcataaagttttagtgtgtgatccaaatagcaatacataattgtaaattagatattcaatagatatttggggttatgcaagtgaatattttatattttaagcttagttgtattattttagggaattatagtatatttgcattactgtattttactatttaaataggaaattcagtgaacgctgccttgaatccatgtaaaaaataaacaagaagaaagagatggtcaagaaatgtatcattcttaattcctgacgtgtgcaatttttcacattactttactcatttaagtaaaatttctattggagtatagttcccatgtcatgtttctaaccctttctaagtgcaagaatccttctgtgttctcacatcccgcttactcagagtctgaagtaagaaagtttttatacaaacatggaaacactcatggcttctactgtttcatacatataggaattaagaaagtattttgcaatgctctgaaggcaattctggttgtagactaggtcagctcgggcttccatgaggttctaaactctaagaagggctagttcagaaaggatcattggaacaagaggaaaattgcatgctaatgtattccaggagatgatgaaatctctcatcttattaatttggcagtgttgagttcctcttctgtagaatgtaatttcctttctaaaagatatgaagcatctgttcccactcagaaccaaatggagaattcttcatctacattagcaagtcaggcctgcttagtgccccaactgtgcttactgctcaggatgttctactcacgctgactggttagtgcatctggtgtttcacattatttgttggaattataagcacttatcatcttcccagttcattaggattaaaaaactctgataaaagtatatatataaaatatatgtattttttaattcaagaagatggcaaatggattttttcagtcttgaaaaatatataaatataatatatacatataacatatatatgtatgtatgcacatatatttttgtttgttctcactcattcagcattgtatgggtacaacaaggatactgcaacctacagtgtccttatgaagctaacatacatgactatacaaacacagaccagttctctaattcaaaatttacagtaaataagcactgattgtttttctcccctctcctttgagaagattcttgctcagaaacaaaacttgtactctcctaactaggtaaaactaagcaaatacccaactatgtacttgtttactgaaactgtgtgtcaaactgtaccttttttttctctttcatctgtctgtcttttgagtttttgaattgttcagaaaattcttaagtacttttatgttcactgttttcagaggcccaagagtcttgcatcacagcaacatggtttcttgcagggaagaatgtgtttgaatgtccacaccccttgccataaccatctggtttgcagatgataaatacaaacactacgttgtttcttttttttcctcctctaaagatctgggaaacagattgaacttaaaattctaccctggcgatctcaatatattaatcttcattaccatgtctagttctttaagaattccagttctgcagctatatattttttaaagactgaacacataatacgtatgatataccacttgtaggatttttttatgttattataatgtcttcatttcttcctacagtctagtaatatcttactcctttttcaaagtccagtttaagacctgtttcccctgtgaagtcttttctagttattctaacctccacacgtctctctttcattgtttggaagacttcacaccaaagcaaggtatatatttgtttaaaagtttcatgcatgggcttagctccctaatcagagtatgagttgtttaataacagattgttcatatgttttgtaatcatagtataatggacacaatggatatttagaacctagttgtcgaattaatacttcattaatgccatcaaagaagcctcattctaatagaggatatgagagagactttattaggatgggattaagttaggcagaaaattttacagtgggaaatattgacctcagttacagggttagagtaggcctttatacaccttttgtctgaaataacattagaaacagaaatggaaaacagtgccacctctgggtgacttctgtctgaaatagaaaacagtgccacctccaggtgaccctaggcaagtggacaggagcaaaataaaaggcattccttcttccagtagatacagccccaagctagggttcatagtatgacaaggagagcttggattgaatgtcatttcccactggccccctcagttggagtctttgtgaagtgtacaaactgcaaacaatatacaacagccctccaaacagtgatatagataatgcaggcaagtcaaggcggcttggtggcttatgaagtagctgacactgcatactctgtgtggcatgaagctagaggctaagcacctagaaatttatttgttacacattaggagagagatcgaacaatcatggctgatgtggaaaatatttacttaagaatgtagatttttcattggtatataaaaataatatttaagagaatgaatagcccagagaatagtcaagtaggtcaaaaagcagttgatgagatttgtaaggtgtgaacaataaccagagtgaaaaaaaaaatgacacaattctgaaggtgaggacaaagttgttattgggccagagtgcgactgagggcaattgctgaggtttgagaaaggtgacacaattgaagggccatttaagaagaagtttcgatagctatgtttaagatagattgcagggtaatcatagtataaagaaatctgaaggatgtctgtcctattgaaagcagaatgaacaggaattaattaaggtaaaatatggagagaattttttggttgaccttatataagagtgggcataagataataagcatttaaattatattctttagtggacattcattaatataatgataatcattactttgaggctaccatttattgagtgcttaataagtgcattcaattattaagtctatgtatagtacatttgtataaataatgttagattttagtctaacaaaacacataaatattggtaaatgatatgcacagatataaaaaatttataattatggtgagctagttggctgcagtatggaaaatataatctatggtatacatatatcataaatgttaagcatttattttagaaataaaaaaacaaggattttcaagggaagtatagatgtttaaatatacctagttcgaagagtaatcttgttttgcactaaaatgtattttattattaaaaacattttgtttaaaattattgtcaatcataacatgaaaacatatagattaaactttaaatattttggaataatctgtatccattccaatgataacttatcaagtctatacaatgttaacatttacatataatagggaaaaatctagttcttgattatatcagatttatattatctctcaccataggcataggaaattccagaaaagaatttgacattatttataaaattactatccataaaacatcttaaatatttttccttagtttgatgaagctcaacctttagtctttcatccttgacatacatttcgttatcaaatcatgcaagcaaaatatgcagaattggatttcttcaagtgaaaaagagatggcttcactattaaactctataaactccttgatcctattaaaaggacggtttgcttaattttttaggtcagaatacaccttaagaatctagaagaaatttaacagtgcatttcgctattttgaaatagcattagtaaatttcaagaattcgggggaagttgggaaatgagcgtgctaactttaaaacttgcattaactacgtgacccatgtgactatatgaacttattttacattttttggtaagaggaaatctttaaccggagccataaataaattatcccagtcagataattgtatatattaatatatactcagcatagtctttggttacagtaatagaaagaatgcatctgcaaagataaggctctgaaaactgacttttcactgcctgtgaaatcatttcgcccctgtgaaccccaatccctttatatgtaataaggcaaaataggcaaataatttctaccttgaatagtcgtgagcatttatcagataacatctgaaaactgccttgtataaagtaaacactagatggtatttattattattattaatggtaaccttacgcatattaattcaccaatgtttttaactggtctactgcacactatatttccagctaacttccaagtcggcttccttaccagaccatggggaatcctcagctcatattgcccagccccatctctgcctgtcaaagtcctgcttcatttcccagaatacctcactgaaagcacatctctattaaaaggaatacatctggctattttatagttccttttaataaaagaatgctgattttatcattgaagtatttttaaatcttaagtgggcaaggtgaaaattttagtatattttagaataaaatatttgaatctaggttaattaacaagtaatatctgtgtggtgcttaatagtttaaaatgcttttttcatgtaatttatccatttcacttgcaataagaattattaaaactaatttttaatttggaagaactgagccttagaaaaatatattacttactcaagttctctctatggtaattactagagctatgtcttctgatactagaaactatttttcttagtatacattaagcctctacaatgagaaataagatttaataaaaagaaggggaggggatacagataataacctaaaagggaaatagtaaggaaatgtaaagctgtaactatagctttgtacattttgaataaagatcaacttccctattctctttcttcctttctatatatatatgtgcatatacatacatagatttttctgtatttttattataagctttgttgaagcacagtggtgtctctttgtttaaatttctggtctataaacatatctttgttttataatataatgccaaatgtgcctccaggtttaaaatgtattaatattcagaagagtcctctaatctgcttaagacaagataaagggaaaaaggcaatgtagaatcagagggctgtgttcttcattgaggccctgggcatgttttttctgtttacaattgctggaaaatattagttttattttctgccctatatggtatcgtatcatgtatgtacatatgttaaagtgtgattattttggtataaatacatattttacactttgattcttatttttattcttgatgtttataactggagaattatagaaatgctaaccaattgtattttggacatgatttaacatctggtcacttttttatttttttatttttttgagatagagtctctctgtgtcgcccagactggagtgcagcggcgccatcttggctcactgcaacctctgtctcctggattcaagtgattcttctgcctcagcctcctgagcagctgggactacaggtgcgcgccaccatgcccagctaatttttgtatttttagtagagacggggtgccaccatattggccaggctagtctcgaattcctgacctcgtgatctgcctgccttggcttcccaaagtgttggggttacaggcgtgagccactgcacccagccaacatctggtcacttttaaaatatactttctaattttagaagttttaaatttacaaaataattgtaccgatagtacaaagggttctcaaataatctagacccaattttccctcttcttaacatcttacattcacaacgaataagccaatattgatattttactattaactagagtcatactttagttagattttcttagtttttgtctaatgacctctttctgttccaggatccctcacaggatcccatattacatttagttgcatgtctccttaggctccttttggctatgacagtttccagacattccttgttttttaggattttgacgatttttcaggagtactggcctgatattttgtaccatgtccctcaattaggatgtgtatgatttttgttttcatgattagactggagttctgggtgttgggaggaggtaaagtgccattctcaactatcaacatgaattattattactgatattaaactttaataattaattaatttatttatttttgagagggagtttcactcttgttgcccaggctggagtgcaatggcgtgatctcagctccctgcaaactctgcctcctgggttcaagtgattctcctgcctcggcctcccaaagtgctgggattacagacgtgagccaccgcgccaagcctggtgttaaatttgatcacctgtctggggtggtatttgtcctgtgtcttcactgtaaatttgctgtttcctcccttttccattctgtaccctttggaaggaagccactatgtacatacagttcttacttaaggagtggagacttactcttcaacttttaaagggtggggtagctacataaatcatttgcaattctgcataggagatttgtcctattctattttatattttgtatgtatttacatcggtatggactcatagatatttattttacatttttggtgatatttgaatgctactttgcttattttatttgtcaaactgtttcagttttggccactggaaagtctttcagttgtattctgtgtccctttgatatatccccatcatgtgggcttttttgtgtgtatgtacttttttactttcggttactataagatgttctaggttcgttttgtatatttattggcccagtcctagaatcagctgtttattcaaagagctcttgttccttatattggagaatgctatcagaaaccacaatctgggacctaggtgtgttcattgctacttgggagttgttgcttctgtgttctgtcagctgacagagcaaggaaatatatatgtgtgtactaatagttgtatatacaaatatctatatatatttcaattaagcatgtatgagttaatatttggaagcagagacagtagaatcgcctgagaagaaatctgagcatttcttctcagatttttcctatatgtgatatataaacagaagcaaatcaagacatattaataagtaagataagggtagagctagacagaggctggaaataataccttaaaaatataccgggccgggtgcattggctcacacctgtaatcccagcactttgggaggccgaggagggtggatcacaaggtcaggagttcgagatcagcctggccaacatggtgcaaccctgtctctactaaaaaatacaaaaattagctgggcattgtggcatgcacctgtaatcccagctactcaggaggctgaggcaggagaattgcttgaacctgggaggcagaggttgcagtgagccgacatcatgccactgcactccagcctgggtgactgagcaagactccattttatatatgtatatcctaaacctggagtcctcaactggattaggcccacacagatattttcctgggctcaaacagtgctttgaaaaactattagaattacatcattaacatcaaacaattgagagatgtcaaacacaaatattgatttctatcttctctttaaaatttgccaggtctgagaaatcctaggcacacatcatttatgcacccatcaccttgtgctgaatggtggttcaagccttcatgagtattgcacaagccccagttcaacagcccatctacccatcccccgcccccaactcactgtcttctgcacagttagaagctagctcaggttctagtccatgtgctgctgttttttctattgtagaggagaaaggaaaatatttcctggatccatggctaacaaattaataagataagaaaaagcattttcctctaagtgaaaagtatcattttttgtttaatacacaatgtgtgactacatcaaaagaatattacttaaaatttcagtacaaaatcaacccagctcaccaaatttggatttctctaatcctgtgttcttcaatagtgatcagaacataagtcttccttcttgctacttgtacaaaatgacttcatcaagtaacatgagccaatacagaatttggatttaggcgtggccttgatatatatgttattattagatttcaaaacttcagaagacatctctcatgtaagagtaggacttcattttctgtgataattttatacctcttgtcatttcctataaaagaccaatgataattcactcaagatccataaatcacattctattgctatatttaatgtattatgtttgtgtttttgcttgaagagattggtccagttagttttattcagaataaacacgaacgaagaaaacatttgttaactgtagattaataattgtaattatagaacctataatatagatttctactacactaaagagatggaatttagattcagcattttatttgacatttggcttctatttttcaaaatgatgaatattatcagacaataaaaagtttgggccatcagcagttaaaatgaaaataaagttcagattgtaagtagctgaaagtgaagcaagtttatagcttgccatgttttactaactgaaccaaactaaatatatttggcaagacaatgtacttgtggcaagaaaatggaaaaaagcagtgtgattacttgaataaggttgaatttaggtctaattccaagtattaaaaataaatgtaagataaaatataataactattataaaatataacattaaaaagtatagaaagatcaggtttggaaatttgactatctcttttccccactctccatatcattgtattattgttagcatcataaaatttcatagtgtttatgtctgtctgtgtaaacatacaaacacaagatttctccattgttatacatgtatgatatttttatatacatatatatttataaaaaagaaaaaatatacagatgccaaatgtgagtgtatatataactacctcctagttaacctgtgtaaccacacctgtgtaaaagaaaatatctatatcctcaatacacacatatgaagcttttacatatatataagtatatacatatataagcatatatataaatatgtatttatatacatgtaaatttgtactcaggtatttttgtgtacatagcagtaaggttttcattagaagatgctgattagctcactggaaactttctggtttgcagaataatatgttgtctttttatacacaaattaatttcctatgaacatgtgtagcatagattagcattaaaaattaatctgataaatacaaggtgacttaactattaagtttctgcactttcagtgctgagaaaacagagctttagtcaggcctagctcagtaagtcccatcccactcgcaatcattttattctaacacctccctgaacatagcccatccagggaataaatgtgactggtggacctctttctctgctgatcctccttactgatgaaaggtttacacctgcaataacactctcttgtttcaaatccagggcctatcacttatgagggatgggagttgctgtgagctactgttggttgcctcatgggaatgatactgtttattgaggattaagtgagatcaagaatataaaacagttaggacaatatatagcacatattaagtattcaatgaatgtaagcttctattgctgcctctcctattaccactattatagctactaccaatttaaacaaaatccttttaaactgaatgatcttttaatatctcttataaaatatgtgttctttttcattaatctggagatttcctaaatgtgtagatataagcatagtgtttgcaactacttgaagccaaaacaattgaaagacattagcctacggattatgaatgataaactgccatgtggagtattatcttttgttcttcagttcactgtttgtaaccaatatttatgacacagagaagtaggatttgtcagaaatcattgcagtacttcattttcaagcttaggcagtatttcttttaccagatatgtactctgcagattcatagagcgttcaaagcccatgtgttactcttaataactcacaactgactgtgtggcaatattttctcataaaatatctccattataaattatgtattacttaaatatccaggttaggaagaaaaaagttgctaatagggttgaggtaatagtccagtaatccatgagcatctgtggtaggttctgtttttataatttggttgttttgaattagaatgtatatggttttaaattaagccagtcattttttattatttgactacagccatgatgtaagctgaaatggaaaataggaatagaaagataacaagaagaaaagttgtgacttgaattgaagatttattacatatgttatatgtagtccagccaacccaacgttatgagctggagatatgaatactatccttaaaggcaagataacttttcaaaactttaaaattaatgccttgtataacttctcagtctgtactaatttcatgtggttaataaggcatgcagaagctaatgttgttactaatgaaaaattaattgggattagaagaaatttcattttctaaataataaaaactgattgtccaccctattttcctgattttagccaagcttaagagatgtatgtgcaactcttttgaatggcatttatgacataacttgtttcattttcctgaaatttgcccttggtttgttgtttgctgaccctcaaattccaggaaggcattttcatgtaggatttttttattctatgagttcatcaattttgaatttgctttatgcaaaactgttgacaatgatgtactttctaaaatttatttctgagatggagtctcactctatttcccaggctggagtgcagtggcgcaatcttgactcactgcaacctccgccatccgagttcaagcgattctcctacctcagcctcccgagtagctgggattacaggcacgtgccaccacacctggctaatttttgtatttttagtggagacggggtttcgccatttggctaggctggtctggaactcctgacctcaggtgatccacctgccttggcctcccaaagtgctgggattacaggtgtgagccaccacatccagctgataatgatgtactttaaaaatagagtctagcaaattgccaaaaggttatatttatattgccaactaccttagaggaattttcaggcttagattataactaactctgtaaaggccagctggctggtgagaatgcataaggttctgcatgactggctttaatacagaatggagggcaagtataccaataactctcagagtgggatgaagaggatgacagatctaacaacctgtattgattccaaagaaatcaatcagcatatcatttttagtatttttttcttttttgttggtgaaagaagagctttcataaagggtcaagcaattctgtatggctgtgtcctccctggactgcatggtcattttcaagcagagggtgtggcagcgatttcatgtatgtcttcccaatccttcactcagaaataaacacctgaaggaaaactaaaatagtcattcagagcaggatatggtgctttaaaaatctttttcttgtgtgaaacataacttctgaactcctctgattctgtcattaacacttggttggtgaagtggtctctctagcttctttttctagcttcccctctgtcgtaaggatggacccttctcaatttacattaggcccagagtaatgaacacctaactggcttgctgcatggaatctttccctgctgcctgacgctcttagttcattccgttgtctcagaagattcagtcttcctttttccatttcgcagctcaacaaaggaaaagacttcatgccatccctatcactatcaaccaagtaaatgcaatgctgttagttgatgttcaagatgtctgattaaaggcagccaacaccctctggcatgtattccacaagaagttctttctttcataaagaagttgaataggctgggtgtggtggctcacgcttgtaatcccagcacttgttggggggccgcggtgggtggattacgcagtcaagagatcgagatcatcctggccaacatggtgaaaccccgtctctactaaaaatacaaaaaattagccaggcgtggtggcaggtggtgtagtcccagctactcgagaggctgaggcaggagaatcacttgaacccgggaggtggaggttgcagcgagccgagattgcgccactgcattccagcctgccgacagagcaagactcggtctcaaaaaaaaaaaaaaaaaaaaaaaaagtcgtacttgggcagtagtgtagagattggtttgcctgttaatgaattcaaactaatctctacactgctgcccaagagcattctatattcaacttctttatctctgagaaattgcttatatctccccaactgttatttccagaacactcagccagggaacactcaattaatattgttttattaattttttttttgagatggagtcttgctctgttatccaggctggagtgcagtggtgcgatctcagctcgctgcaatctctgcctcctggattcaagcgattctcctgcctcagcctcccgagtagctgggacaacaggtgtgcactaccacacccagataatttttgtatttttagtagagacggggtttcaccatgttggccaggctggtctcaaactcctgaccttgagtgatccacccacctcggctttccaaagtgctgggattacaggcgtaagctactgaacccagcctgttttattaattttgacaataaatgagatgaattgttaaaaactacattgaatgcatctttttttcttatacattgtgatttggttatttgaatttcactcattgtttttcaatactattcttcttttccaaagatattaaagatacttgacttaaataaaagtacattcaaattattataaagttaagatagtttttacttaatatctgcagccaggactaataagtctatgcagctcccttaaatacacaaagttcatttcctctgttttaacagaaattaaaagaaaaacgtaaaatcaggtttgtaacctttccaaaaacaagttcccttttttcttctctgattttctgaagttgtctgtaccaaaatgatactgttatttaggaatgttgatgtggtaggaaacttctacttatgtctctaaaaaccagaccatgattacgtatcataaaaatagatgcaaaacgtggctattctggccacttgaggtcagagaactttgccatgactatgtttaattacatgtccatacaactcaatgacttattttttcaaagaacagacattttaatacaagacaatcaaaatatgaacctcagtggatgaattaatagataccttataatcaaaatctgtcagcctctgaattaacccaaagttcagtattcacattttatcaattatattacatagaattgccttgtttgaaatatttaggtattcttatgagaaatacataattactaatttacacgtataatttctttttctcctctaatttgttttaacaagtatgagaggtaaatttagctaaaaattatgtatatggatgaagaaattctcttagaggaactctaaaactaattgaatcatacttgatatatttgttcttttcaacaattcagttttttaatgcatatttcattagggtaccatcaatgtgttttcctgaagcctaattacacaaaaaattatcacatattttccctccttcgggtccagacagagctgttattgagctccaggcctagttgctgtttttgctcaaagagattttcaatgtccaatggcatctcaaagtaaaccttggaccctaaattttttgtccaataacatatcctgattgtctgtggtctcttaagactatctaattcattaagacatttttttcacccaagaaattaaacaaatgttaaattttctcagcgaatttcatattttcgtgaaatttttacaatggcttgagcagtttaagaagaaaaaaacctttttgatgctttgcattttatttgctgggaaattacctaggcaaagaaacttattgttccattttatgaactttacaattcacttagctgtcaaagttatttccggtaacccaagaaagaacttgataccactttttatgatgacaggacttaaagatgacatttattccaataagaatcgtcatttgaaaatactatgttatttccctcaggtctctgctcaaattctactttatttgtgagcttgtccctgattattcaaaattaagctcagtccccgctctcctctcaattcacttttctcctggagctctttgtctttaccttgctgaatttttggtaacacttcttgctactagacatattgtatggttagtaagtataatatttgcttatttcctgtttctttccactagagtataagctctttaaggactaaatcttttctgtctgttaacacttatatttctaacattgatatggtgcctaagatatagaaggtagtcaataatgtgttgaataaataaaaataaatatattaagcatttgtgatgtgacttgggctttataaactaaatttttcacaggcacttgtgtaaaaggtaggtttgtagactggtttatactctaatatttcatttgtaaaatggaatggaaacttatctgtgtagaagagatactagatgctagctagatctgtttgaaatcttttcagagccaaggtggctatttaaatatggtggcaatactctgattttatttcctcatttcccttttagttcatgtggctacagtgaagacccactatgtcctagatcccttgctaggtgtaaggggtacagctatgaacaacacatagataccctgcttcagtggagagtagcctagctattaaagcaaaaattaggaataaatatgatgagtgtctttacaagtaaatgcccttttaaattgagcacatattaggtgctcaaaaatcattgttaaataaatcagtaaataaatttgtaaagaggctgtatatcaaaactcaaatcctgacacttacttctagaagtctatttcatagactcacctcttaaaatatctcagtgactaaaaggatttggagtaaatagtctaaaagcatactcataggttctaaccacaaaatacttccatcttcccacaaattactaaaggaaggaaaattctcatgtgaaattagacaagactgtttctttcagaaataaaagtattcaggaatgtgtttgtccgttgccctatcaccacaatccagggcagtgtctggcatggagaagacagaaaacgcatttttgttgaatcaaactgaaggaatataaggagggaaaaagattttagttctatggccaaaaagatttctagaatatcacaatacagacatttttagctaactattaatttatttcatcttcctttgcttcaaggtcacatatgctcatataatttataactgctgcaggcagaaccattaagagagcacaatttcaaacaagtgtaagccacatgagggcataaactttatattacggtaaacctcccaccacacagtctttaatgtagctgcataatatgtgtatttggtaaatggctgaattataatccaacctcttcccctaaatcttaacatggatgaagtttaaatggatgtatgatacagataagttgctcttcaattcctaatttgaaaatgatttcctaaatcatacactataacttgtcccttttgaaatcaaataggtgatttacaaaagtaaatgtcacctagtacctagtagcttttgcacgtaaaagagagattttaaaagatgagaaaaaaggaaatttgacataaaattattattttatttacaccattttctcttcatttctgaataattcaaggaatgtcccagaatcatctctcaaaatagaagcttgaaaaatcctcattgaaaaatcagttttcaaacattttacatatttcatattgaaaaacatggattttcagatttctttagcaaatcatttatgggctgggccccttttagtgaaatgtaaggagtttttcctgccaatttataaaagcatagaaaaacaggctgaagacacagctgacagcctttcggctttagtatcgctagccatctgttttctataaggtagttgttttttcttgttaagttccccgtgtgaaatgtttttctttttttttttatttttggtttgtgaattctacccagtgataaaactcaccaggggaccataaaggcacaaatggaatctgggagaactttgagacttcttatattcacaccagaatctcactttactaatctaaatcagagacttttttccatggagatttgttaccgaaataccagagtcctaattgattaaagcaattttaattcaagagggtttttgccttacaacagatgattattgagagagatttcaggtttatgatagttttcggtgataaactttcctaaggacgcaagtgccccatttagcttttctctgttattataaggaagaagcagaagatatagtcttctctaacagctggacgtaaggaaggaaaggtgcctaattgggaatgatcattctaaagaacaacagttttcttgttgcacatcattggaatgcttattgtgaggacgatagtaattatttctgaatctggcatcaaaatactagagatgcttctaaaaaatacaagtttccagtttcaaaacaaaatcagagtcactagaagtagggcctaggaatcagtattttaaaaaattctctgagcgattctgatgcaaagccaggtttgaggagcaccaacttaaaagaaaatcaaggctgaaattaaaaagaaaaaaacaaaaaacaacaaactcttcaatatgagggatacacagcatttaaaatcacaaactacatataatttttatgaaactgattttggataaaatatttgaattacagaagagctgaaagatcataaatatatggttacaaaaataacctgaagctttggatggcttggaaagataattactgggatttgcctcccaattctgcaagcaaaataccacctactttttacaaacataactagcaaggtatgtatgggttatattggcagaagtcacaaaacatacttcaatggcttaaaatgcctcttgtcaaggtgccttataattagcttcaaaagccttccagctgtgattccattaaatacaggtgtattgctgtgggcagctacatcaggtactgtggcattaataggctcaactaattgctgcagtggatttgtgcagtattatatgcttactcagaaaaatttatcttgccctctttcctacacttaccatttctgttcttgaaatctgagtgcacttctgttttatgaccttatttatatagacagacttgacctcagggcgttttgtggaagaagcagcactccttcactgtgatcatagccttatataaatggatttttgtcaatataatgtagatttttctctcctgctgcatcctactccagattctgataggccctataaggaggagacaggtgagcatgactctacatttgatacacatgtaaatggatttgaatcaggcaagagaaatctgggaacctctgtgctaaataataatggtttgtgtctaaataacacatacttatttttcaaagcactctcacatctatttgattctcagaacaaccttgggaagggggtatattatccctattttttaggtgaaaatacatgacaatcaaagaaattgtaatttgtcaagtgttacatagcaagtagttttcagtgttggtgtgaaaaagtaaaataaataaaaaagcctaggttttctgaactactcaatttccattcctcctgcatcgttttgcctcttaagggtttccagtgagtagattaagagccaaaatacatctgaaaggctattagttagagctgcaaatttgctttctcttcctccatttcttctcattcttttgatttgggttggcaaaatcctactcactctgaagatgaagccaaagaaagaagactgaaggccatcagaaatctgtggtccagacacctgatgctgccattttttccaaccctgtccctttttaaccactcaattttgctttccttttttttgtctcttctctttccctgccttttaactgtattgaattacaaatcgtttctggataaattctacttctttctcaattctcagttcatacatcacttccacaagaaaaggtatcccaatccccctacaatggctaagcaatgcttgtacacactccctaagcactctgaatttatttctgtaagttgcttatcgttttgcactttagttccttggttatctgattgtcttcctaattaggatatagctacttggagttagagggatttcttttgttttgttcagttttggcacctaaagaagaaatggcacataataggtactcagtatttgttgggtggaaaactattgtctctgctcatggccttagcattccatgcagtgcagtatttctgtggatatttctttggagacccaagtctgtttcctcaccctgccaagactacttcaaatcccctacatggcacactggactgcatatatttcatttactaaatgtggccatttttgttatgctgttattagtcccttggtttggaatgcattttattattataatgctacctctgtaggggaaattaaatttgacttacatgctttactaaaaagcctaatttattcttcctgagttttagaagccaaagagctgatttcctctttcctcttaagaaattctgcagaatgttccacttgatgtgctctaagtgccttgtcacttttcttgaaattcattcttgtttagcactatgaaaagaaataaaaaaacttatttttaataactttaagaaaaagaaataatttcttttggtaataaacactagatattaacattttaaaataaaaatattactttgggtttaatcacaacttaaagaaattttccataaactcttctcattacacaaaatattaccattggaaagaatccacatatactgacttttaggtaatatgcattttgctactttatcatattggtttttttctttactaacatttctaatatttaaatcttaagatgaacaagctgaatgattgttaagtgaaattaatctctaataaatttaagtataacatagttcctgtgtaaaaatcaatttttaaatttctgaaaactttagaacacatatagtggagtttgtaatttatcatatgtaggctggtataaagtagtataaagtcatggctgggagagggttattgttgcagatttcatattcctgtaagttttgactaaactcttcacctatccgtctatagttaaaggaatccaaagcctggatcccataagaaataagcaactttctcttaattttatgagatgaggaagaatcatgttgaatacagttgtctctcaaacaatatgggggttatgggcgccaataacctgtgcagttgaaaatccacatacaactttcaacttcccccaaaattaactactaatagcctactgttgactggaaaccttacctgtaacataaacagatgattaacatgtattttatatgttgtttgtgttatatactgtattcttacaataaatgaagctagaaaaaggaagatgttcttaagaaaatcatatggaagggaaaatatatttatgatttattaagtggatgtggatcatcataaatgtagtcattcttattatcttcattttgagtaggctgaaaaggaggagaaagagaaggggtttgtctaggggtggcagaggtgggaggaaatccccttataagtggacccatgcagttcaaacctgtgttgctcaagattcaactgtatgtgaatactgctgtatgtgcaatttggtgtggatatgcagaataattttgtctatgccttagaattcctaattcccagggaagtcattggtaaatgcagctggacataaaataatgcctctaaatctacttaactgttttatttaccaattcagatactgtgaatggccttattcccttatggttgaacctctacaacatcagagaagtttctattggtggatacataccttgagtttctttttgtatctagcacatcttgtcatctcatttgataatatggtccagtcatgaaaagtttggttgagttcataataaatcccatagttctttatacttgatatttagcccgtaaaattccattaaataatttttagtcattgctattccattaacactataagaatatccagattcactcagttatctgccattaaatcagtatgcaaatggatcatacttagaattttttattagatcatatgcttttattgctataaaacaaagtgagcaattacatttatttcattatttgcttttatttctaatccttattgccagttgaatctattgtgactaacctgaccgttactaaacaggaaaaaaattgaagttataagttggtcctggtaggaagattccattttcaaatctatagcaaagattaaattaaaaaaaaaaaaaagaaaacacagttaagaactttttaaaatactagttcagacttcagaaaaatgaaagaaaatgaaaacatgaatgtaatgtaatttaaaaagcagaagttgatagttttctttaaattgcattttataatgttgaattttattgaatttttcctcagtgacttttttatcatcccctgtttagtttaagtgaaatagcaagcatggtgcattctgtttgctgaacggagtcatgtttatataatgcaagctgaatattctggggaaaaatttcatttcctgcgccctataaactaatctaaacagaactaaataatagttggtatgcaatcatttactatccctactcattaaaatacctgaaagacttattcatgtcatggagatagtctttcccccatcaatatcctgtgaggcctcagaaaagctagggggaatttcaccggatattagcatggtaacatttggtggctacacaggcggaacaccaggaaatgaaatttcctccatttagagttgggaaatgaatagaaagaatggggttcgcaatcttagtatattttaattgcttcttgttctcacacattttcttttaaaacacccttcttaatcgcttccttttctcatctctaaggtaaaccatgctttacctgttttttctttaacccaggcttctattgctcttcattcttcacaggagctctatttgtcacttttccactctcttagtcaaaatccacatttagagtgtgacttaagacttttgtacatgtaaatgtgccatccccttatcttttctctaacatagcaatctggttgtctaacacaatgtataatagttatgggcgtatattttttttaaatattggctctgccactcactagctttgtgatcatgattgaccccaagcctctaccaggatggttgttaggactatgtggaaaatttttatcactcacttaacataacttttagaacacaattaatagctgccattaatatttctactgggttattcttccttaagattcactccaacatgccttaaatagagtttaggatttttaaaataaaatttgtttatctctccaaaacttttatttcattcgatgtctagaccatacacctgtgttactttcctaggggtgcttgataacaaagtaccacaaactgggtggcttatgacaacagaaatgagtgtctgagtctctgtatctattcccctcttccctccttataaggacaccagtcatattggattaagggcccatcatattccagtatgacctcatcttaactaattaggtcatcttcaatgaccttatttacaaataatgtcacattctgaagtacagaggattaggaattcagtatatcttttagcagggcacaatttaacccaaagtacccagtagatatttcttcctccattcatttctgagactctgaaattatctttaaaaatttttaggcctggcgcagtggctcatgcctgtaatcccagcactttgggaggccgaggtgggtggatcacttgaggtcagcagtttgagaccagcctgaccaacgtggtgaaaccttgtctctactaaaaatacaaaattagcttggcgtgatggcacatgcctgtaatcccagctactcgggaggttgaggtgggagaatcacttgaacccaggaggcgaaggttgcggtgagccaagattgtgccattgcactccagcctgggcaacaagagcaaaactccatctcaaaaaaaaaaaattaaatactttatcccacccaaacttcatcaaacccttcgtattttctacctagtgtctcgtggctttacctctgttctcataactactgtttctcctaactccagtataacattttccactagtggcctttggtctcatttatttctgatttatctttaattaggtagttacgttaatattcctgaaagcttcttatacattcttttatttattaccttttttcatttattcagcaagcatttcatgtatcaggcactttaatacactcatgatatagagagaaattaaatatttttcattctcaagaaatgtacagcccagtagagtttacatgcaaacaaaccaataagtgtaatagaatgttgcaggtatttgccaggtgtacggataaggtgagatgagagcaagagaagagaatgaccaaattccatgtgggcatgtcgttaaaactttcctagtggaagaggtatcacatgtaccaagtattctcatcacctcctttttttgataaattaaaccatcccctcctgaagctatgtatatgacatgttttcctccctctctattcctgttttaggtggttccctgcctctttcccaggcagagttttccttacccccaccacctcaaataccttctattttttcaaggcctgcttaagaacccacttctactcaccctttctcagataatttcagcttatagtgataccatcttttcagatttcttatttgtaattctcaaacctcgtatcttatataaactatttgctacctcaactaattgtggtcattgaagaaacaactggatagaagatactttacattttgaatgttcttagtaaatatttgttaaaagagtgactttataaactttcctctaagctcctctggagtagcttgtgtatctttaacttttgtatctttcttccatggtatatagtcaggcatacagtaagtagactcaataaatacttaagtaatctatgaaaatgagtataagtggatgtgctaagtataagtaaaataaacttttagtatgggtatttaatatcttacttcacagtgttttctaaattacaaaagtcagcttctttcaaactagacattatactatttttttgacttcctaaaatgtcaaaacacaataatccagaattctgtatctacaattgaagaaagactgtggaattggacctagaaaaatgctttttttttttttttttttttttgagacggagtctcactctgtcacccaggctggagtgcagtggtgcaatttcggctcactgcaagctctgcctcccaggttcatgccattctcctgaaaaatgcttttatagtttgtcccagtgtggctagagtgagttagtcatcggcaacaaatggttcctgccatgttgctgtgcaccactgtcttggcttctggactgctggcccgcaccaccgcaagagccccacccctcctccaaggcaccttcccatggacataccagttggtttagaaacaagagtgctgttgttttaccctcagtcaaaggaagagatggtaaagaaattaaaatcagagtcatggttgagagggagtacctggtctccttcagatccatcctggccagttggtagagagaaggaatctgttgccaattaccaggaaggagccaggagtaacaatattatacaccttggaaatgaatttttggaaaaaactgctttggattttaattttctcacttgaaaaaaaagcaacccccaaaacaataaattaaagaaaggaaataaggaagttaaagaactcaaatcccagatttcttttgacttctctgacctccagcctagatgatatgcccttcctacatgttcccacaacaaccaagatttgcctataattttgtatttaaagaattatgttctaataatctgttactgcactggttctctcagtagtctgtaaactccgtaaaggtagagaggaattcattactttaactgtattcccagtgcttggcaaaataacagataaatatttgttgaataaataaacaatattatcaaaatgcatacattatgttattttgatgtttgcttcaagaataagtgtatttattttatgatttaaacacattcttaatgccaaaggtgttggaagactaaaacatacagggaggactgaaactcacacagaggatctctaaactgtggccttagccattattatggctggtatattctgagggatcattgaatgatttgcatttatgggtttccactttctctctgctatgtatccagactgtcttggtgtctaagggtttaaaatatgtttcattatcaaataggacaccaaaggagaatcaatagatgatatactcataagtgaatgtaatgttattctgtattctgttcacccttactaatttgaagtttgcttttataaacagaattttatatttccataatgattgaagattgtttttgttttggattctaggaaatcctcaggttgatgttccccagacttagttgtagttaatgaaaataaacagcattagacaaaacctctcaaaacacagaggaagatttccaagataaggaccaataattcaaaaggccccaggatacatataggttagagaaatgaaaaaatagaatgagtttatgaagtttcagtgtgtatgtaatttttccagaatgcactagtgaaatacacatatgagcaaaatcattctacaaaaaattcattatcttttgcagcttctgtatattttggttgtttttggcaaggaagttgaactccaaatgtctcattctctgatccaaagttttcttttgtactaaacaagtatttaataaaattgttattatatttgctagataaataactatcgattaaatggattaactaatgcctctattcctttttccagattgacaaatttaggatgagctttcaaacacactttaaagcaaacttctttatgacatctttaaatatttcttatctgcaaaagtaaaggctcatgttttatctttttctatatgttaacaagtagaaaaactgaggcacacttttcatttattaatttagtaataaccagttgactagtaaacaacttagttaatcttttgtccaaactaaattttatactccttagtttaggaaatgttatatatttttctcctctgatctcagcatgtgctaatgactgtattagcaagaaataagtattctgtagttacttggaattaagcaaatttttgaaagattttagaaactttaaatctttccacaggtatttaaagaaaatgacaagagtattgttttcctttatagatattttattcgtagtcaccatgtttaaataaattaaaatgtgaattatacaataatgataaaattcagaatttaaaaaactgaatgaataacattaagtaataatctaaaacttttgaaattctaataaagtttgcccatgtttacttgttaaggaaaatagcaacttctccttagaagcacatggatttgtaggtgaaaaatctccgattcattctttgtattttccctaataggataaagaagtatcttcaggttaattctgttgttttctaaagaaacttgtaaaacctccttcttgatgtagtaaagttacatggaaagaagatgattgtctcatcctccttcctctacccctctccctccttcctctcttcatcctccttgtctgtttgcttttcttgtcttttgttctccctacaagtagagaaattacccaatgaagagctttgctgtgcatctaaaaagttattgatataactttccaataaaggcaacaactctttttctcataccaagtatgactatggcatttggctggttttgagattcagagcatattgagttttgatcttaaacatgcaataaataaattggcttccatgcaattatgcacattataagggataaactaaatatgaagattaagagatgaatttaggttctgaaataacaattacagttttttttttaaagattctattacctgttctggaagtgacttggaaaggaatgccagaaagaagagtaaaatctagttttagttttgttcttcagcaaaatcacttacttttttaatagctagaaaatagatgtaaattaaatctgtgtaaagcagaacaaaactgaatactaattcaagtcactagatatttccaagaggataaaattagaaattggcctttgggatgacagcactagtctcctttcacccatgcctccagaactgagctccagagggaataatgcagaaagaggcatccctttaaattcctattagaaattttcttcaaaatattttagaatccttggtactgaaatgaatgggatcaaagagccattgagaactgtggaatgtttggtggattgtaaaagaaatttcaacttgctcaaggcaagggcagagaataaagaatgaattggaagaaataagctgactacaatgtctggattttctctagaggccctaaatattcttctgtatcagggaaaattgaaaaaggaggcaaaatgcagctgcaaagacataataaaatacagagttaaattgattctaaaatgttttatgtaaaatatttaattttatactcattgagtatacaataatgaatattctcttaaaatacaataataattattttcaattacaaaaatgagtaaaaatatatgttctttttaggatataatgtcaggaataaatgataatacatcatattcctataattcatggtattttaaagctttgtaggtttggcccacatttaaataagcagctaaaatggcgcttctctaaaaatcaggtaatagcccagggttgaagcatatcattttgtattcaatatggcctagatctcttacttggtattcttaacaattgactttagatataaaaatccctttttatatacaaaagaatattatgaaatgactttaccatataaagcttcttaagcaaacaactaatattcaataaattaattcaacaaatacttcttgagcatttactatgatcctgacactattctaggatatcagaatatatcaacaaaggaagcaaaataaattatatgtgttctcacagagctataattctatcatggggtgacaaacaataaacataataaattcaatatatagtaggcttgaaagtggtaactactacattaaaagaaaaaaaaaaaagagtaagaattagtgaattgagagtgttatggttgtatgtgtgtgtagtcatgtgcaatttttttggtaaggtgaccagagtaggtaacatttgagctaagaccagaaggagatgaaggaaatctggaatgtggatactatatattactgaatatttacttctcctttgaaagagaaacagttaagcagatttttgtctctcctgttgatctcaagcaatattaggctaggagagattaagtagacatcattcagaacacttacaaatgtttcatgtatttaggtaggcagacacatttggcatagctctgtaccaaacttattcactgaggattaatatttaagattagaactaaggttggctataaaaattactgctgaaatttctagtgtatagattatagagttggctcaattctctttgtgctgttttgcagctatttagtagtttgaggtatgtgggaaaaaaaatctatgtcaaatgcattagcagactgaaatctgctcttccagacagaactgtagatgagcattgcatgtgcagtatgtgtagttttagtttcacgttttggccacagtcatttagatttcccaatgatacatggaaaaaaacttaagtatacctaatatgagagtttttcctttctattttttccattttaagtaaagtaaaaacagcagttttactagttaactgaaaaactttgcttatgagattggaaaacatttaatggttgcactgaagaaaccaaccaccttcacagacagtttatcaaattttttaaattcatatgctcactgaaatgcattgaaatgaagctttctatgagtcatctccttttcaatttttcagatttcaaggaaaattttcaaaattgtcattatattgctttagaatataaaacatgattgtccttagtggaacaaaaatttaactcagctcaaataattattgaatgcctactcttgttcagttggtacaaggaaaaaaggagcagggcacagaaaaagtaataatttggataactatcctaaaaccagatttaagcttgcggggctcactagaaagtaaaagtctttgcagtggattgaagaacagaagatgtaaaaccccataggcctaccccatacatacttatcctcccaccatcccatagatcttgaggctgagatagaaaaaaattgtcaaagtatgtaatagatccccctcaggtatccctggtggcttcatatgtatctaacttttcaaatttgggagttgtttaaggaaagcaaaatgaggaatgtggaatttttggcatctcctctgcatggtctaaagaaggaattgaatgctgtccctcttcgtctttcccttctaatgataaacagtgccctagagcagaaggaagggaaggatttccttggtaggttctctggaaccccatccaggagcccacgctctgctgtgcattactaaaggcagcatctgtggcatccagactgacacgtgggcggctttattacctcctcctttgtcccacaaggcattctctctccacttcatgaggccaccagctgacagtgtcatgattatagtccctcaaggacctttacagtcagagaaactttaagtaatggtagcccagatcttcacaatcccaaaagggacctaaatctgctgggtcaggaaggctgaagggttgctgtagctttctgaaggttgttctaaaatatgaactgttgtgactgacacagtcttcttcctttctggtcacacagaggcctgaatgtcagggacacacctggtaagaaccaccaagtgaccattccctttcattcaaaaaagggttcctaagagcacatcctctctggaaagattagggaaggaggaaagagagctaaaagtgcttatctttttaataggcatatcaatgaactagttccttactttcctcattcacatctgcattcatcaatgctacacatacgtttatcaaagacggattatataacattaaatgtgaaggttgctgaggtaaacacagttctggctgtcgaggagctcacagtctcacagctcacaggggaaaatgatcagcacaaacctgtgtctgaataagagatttaaaatttttataacacgtgtgtgctgtgtattatttctgcttgaaagaactttagttaatggctagagaatatctaacataattttagggacttttatttcatatatttttcaaagcctgtaagtagactccaataatttaatatgcaaatacagtcgtctctcttggccagtccaaggtttcaatatggccgtttctatgcaggctttttttttttcccccacaggtgtaattgtgtgaaaaaatgtggatgcagggcataccatatagttggcaagctgcaattgtgataatttagtttctaattgttataataagatggtggatttggtctgccatctagtgattaagaactgaattcttacaactaaatttaaaagcacttaagatttatgagaagagaaatctatgaggatatatgagaaacagaaaaattgagttgatttcaaataaaatgtgatcagataaaatatatctcttttctgtaatatatcagtgccacaattgttgtgggaatgacttcacaatggattcaatttattggaacatttggtgagggtaaaagaatcttgtaggttgggagataaacatgaaaattacaaaatagtgatggtattatcagatttctaccagtcctaatcaattttaggaaagttaaacataaacagcaaaaaatacaagtaatgcaaaattatagttttggcgttcttttttagattatataaaaatatttatctaatttttaaatttaaattttatttttattttaagttccagggtttatgtggaggatgtgcaggtttgttacataggtaaacgtgtgccattgtggtttgctgcacccatcagcccatcacctaggtattaagcccagcatgcattaactatttttttctaatttttactaatgctctccctcccgcaaccccaccctactccctgaccggccccaatatccaggtattttaagaaacattttttttttttttttttaagtcctgggccttgaatctaagctttggacgtcagcttgggttaattttatgatttggatagagaaatcaggaggacagaattgaatttctcagaatgtcatttgaaaatttttgttattttatactgtgttgtcatttataaaataattctattatgacaactttactgcaatatttttcaacaaattggctgcaattttgctttctattttacttttcttttcgtttaagtaaatgtctgtgtagaaaacagaagggacaacttaatcatatggtgtacaactaccatgtagatccgtgaaaactgcaagacaccctgtattttctacccactgtttctttgtacatgtctttcattcagacatggacaatgagagttcactgagtttttgagccctctgtgatgtgtatggattcttgtctgagtgaagagaagacaaggtttaacagtgaatgtggtttttcgtctccttgctatttaaaagcattccaactaactttccacatcatcttaaatttaattataaattctcaggagaagggaagccatgatgactcagagtataaaactaacctttaacattatcatttaaagaaagtaatccagtggcccacttctttgccccttgagttgaagttatgttgtcttaaactttcagaaagaaactgctcttctaggtgttaacacaagactgagacaatgtgtctttttattccaaccctaaaggagccacaaggaagaagataagctactccttgaagagttcctcacatattttaatatttaattgacatcattacgtgtcatcttgtttttgtttttcatattctctgcttccaaatatctaattatcccatcagcatatatatccttatatataatatatatccaataataacatattttgttataataattcattttataaatcttcaggggataacttatcctgttctctatggctccttcaagatttatacaataaacaaacatatattatataattaaaattatataataagttaattatattcatctattatataacaaatatagcactccacaatgttatatatataaaacatacatatattgttatatgtgtaacatatataatatatataatactccacaataatatatattttgaggacagaaaggaacacatatgcttccttcttgtcttttctttttgtgagtccaggtctcactctgttgctcaagatggagtgcagtagcatagcgttcccatagctcactgcagcctagaactcctgagctaaaatcatcctcctacctcaccttcggagtagctggagctacaggcacaagccactgtgcctggctaactttaaaatttttgcagagatagtatctcactatattgcccaggctggtcttgaactcttggcctcaagcaatcctcccaccttggcctcccaacatgctgggattgtaggtgtgagccactacacccagccacatatgctttcaatattttgcacaattagtactaggcacatatgcacttaactcccagcacccccacccaagagtgtgtaatgagagaaacaagctaattgaagtagtatctcattttcaggtaatagcatttaacatttgtaagtggatatttccttctcaatcataaaacttaatgagcaaaattacccttaagttatctacttaatggaattgttcagtgaactatagacataagcccatttttatacaggttgtgtctttggaaatgttattcatggaattacactgtgttaaagtgatatttcatctaaaagtcacactgtttatttgatgaatacatttctcattttttcaaaataatcttccagaaaagcatattaaaacataatttctattttccccttggttttaaatgactataatagcactatggacatagagctaatactgttttgttgattagatatgtattatgtgatacaagtcttttaatgaagataaaacagattagaaacttgtgtcctcatcttataaaacagcacacaaaccattaggatatagtagtgttactctctgaaagcaattttccgtttgccaaatatctgtgatgaaagactaaatacataaagcaaaatattccacaggacagtgagaaaaatgtttttattccagctttattaaggtataattgacaaataataattatataaagcagatttttgtattaatatctgtattgtaaactaaaataattttcatatgtagctttgcattatcatttgaatatatttatatgccaaatgataatatctttcataaactgattacaactacattaaaacatctttttatgaagtacaaagttcatgctgtgcaattaaactagtttaccgtagtttagattcattcattatatccatccagtagacaaatatttattaaatggctgttctatgaaaggtatagcatcaagctatacaatgaggaggccgggcacagtggttcacggctgtaatcccagcactttgggaggctgaggtgggtggatcacttgaggtcaggagaccagcctggcaaacacggcgaaaccccgtctccactaaaacaaaaattcgctgggcatggtggcaggtgccagtaatcccagctacttgggaggctgaggcaggagaattgcttgaacccaggaagcggaggttgcaatgagctgagatcgcaccattggactcctgcctgggcgacaagaacaaaactccattttaaaaaagaaaaaaaaaaaagaaaagaaatacagtgatgaacaagacgcctagtccttactttcatctagtttttctctagtgagggagataaactaaacaaaaataaaaaattaatactcattctaataaacttcctgagggcagtgatttttgcctatttgttcacattttagtatctcttcaattacctagcatataatacacaatgaatgaatgaataaatgaatgaatggctgagtgaatgagttctttgaaaaggtctctgaaaaatatcagttgggtaaaggaagtctaatttttgcagggtagtcagaaaagaatttcgcggggagatgacattgaagtaagtaatgatagatagccatgtgggcctgggatgaaggaaggagaggtagtgctgggcaaaagtggtcaagttgtgcaagaaatgggaaagaaggtctttagcctttataaggaagttttgaatttaagtagttgggaagttcttgatgtatttaagcaaggatgatttgatccacattatgttttaaaattctgtagtatttcttataaaatcacaaagttaatgatgtaatatatgtgtttacttgttagtaaatgtataatagaactgctcttgagcaatatgtgtacacacacacacacatatatatgtgtgtgtattttcccaaactttcttaaattgtaatgtaaatgtagaaaagcactagacaaatatatattaactcactgtattattttggctatggttttccttaattaattttgatgcaaacataattcactcattatctgcataagttttgcatttctgccacagttgagtaaacaccatcaatttagtatatcaaatagaattctactccatgaaatgggacatggttatacttttttactgtacatttaaaaataattttaataaaaacatacacctttttcttttttgaagtttttttctatggtacatgaaaacatactgtctcctgttgtggaatttactaaagtttccagtgagttgcaagtcataatagggttcaccaaacattcaaattttatattctcctttgagctattcattttctccccattttcagatggttctcttttatccctctttattgatattctcatgtttcatcattcataccttcaagaataaaatcttgaaggaagcattatctggttaaaaaatatacctccattgtatcacttttatttcttcccctatcatgcaaggatacattatcattatttcatggtgaattacatattattttgttatgaaatgaaatcagttcatctgtgtttggctccttggaaggttacttcttagtccagaattttttagaatccacaagatggctcaccttttattttctcaattctataatttcagattactaacctcttctttcttttcttattttagaaggatatggtgaagaaatagcctgcactcagaatggccagatgtacttaaacagggacatttggaaacctgccccttgtcagatctgtgtctgtgacaatggagccattctctgtgacaagatagaatgccaggatgtgctggactgtgccgaccctgtaacgccccctggggaatgctgtcctgtctgttcacaaacacctggaggtggcaataccaattttggtaagaatgtttagggccaactcataattgatccagttactcacctttatagttgcagtgtttttcactttcagcattcagcaactcaagagaataattaagcagcttttttggtggcttttggggttaatgattaatgattttgctcactcacttcatctaaagttagatagaagcagacagtaatttcctgtcttcttaaatatctgaagcatttggggctgaattttggtggttatgtctaatctgagaatttcttgaatcacttaagatgatcatttgttaccatatgcatgatgagtgcctccaagttatttttcagtttccctttaagtccattaatgcctgagagaagatctagaaaacacatttatctacaatgatgccaactttgtcctagtgaatggaatacttattcctaatgtaattcagtgccacagcaccctgtattacattggctcttaaatgcagaatgcttttcatgttggctaggtaaagaatgaaatagatttccaggagaaaaaataatataaagtaaaacttttaaaacttctttgaagaaaaagtttctgtgtttaacagatattatgtatttcagtatgagtacatattttaaagatacatgttagggaaacaagtttatatttataggtttcaataaacaaggtaagagcaatattaaaccttcaggttatttgtgttagcagtcatgagacttctaattcatcattgtcaagacaatatcaaggctttatttttttttcaaaatttcattgcaaataacagcaaatacaataaaggtttcaacagtatgtatatggaaatagatagcaacttaccttttctctgcttcttgaacagaaacaatgtgccttgggtaaatacctacactcacttttcagtaatgtaataagaaatatataaaagaaagaattaaaaccaagacatataagagctacccaaagcaaatacaatcatcaaaacagcccaggaataaagtaaaattaaatccgtggggataagtgaatagcaaatgggaacaatggtggcaaatatcagaaaacacaccaaaatatacagtctccttcaaatagttggtctaggagctggcaattgcattatgcacagatgccataagataaaaagtggttgagttcagctaaatttacgagataacacaccagaaaatatattgctatagaccatgtgaaaattctgacctatcattttaccgtgaaccaaaaaaaaaaaaaaacttaataaagtaattctctttaagaaagaaggctataaagcagaaataagtaatggtcagaaaagaaatagaaggaaaatcaaatcatcacaaagaaatgaagatgaaatatgagggatcataaggagagttgatatcacacaaaataaagcaagggccatgagaataggaaaataatgaattacaatttttaaagagttaaaaaataatagatgtagaaggcaagcaagggataaccctgaagatgggcacccaaagaaaaaattaatacaattgagtagaacaaataacaatataatacaagaaaaattttatgaagtaaaactttaatgtcaatattgaaatggcaaccacatgtctgaaaaattgacctaaaagagttaacagagacatatgtaacttaatgaagtcattaaactttaaagataaataaatacttctttagaatgtcaaagaataagaacagattatttctcaagggaaaagttgttaagactggtcacaaatttctccacagtatccagtgtcagaagacagtggagcaatatatacatatttcttaaggagataatatggttaattaaagttaaatataaatccattctctccttcaaatataaaagctacagtaaaagcatttctgtggggttattgtttctataaatttctcagggaaactaccatcggctaaatgcaaggcaaccaagagttaattgaagaaactgtcaaagaacttatgtgagcatttattatatttaaatctagaaaaagactaaaacaaaagtgtaacttagggtgacagatgggattgtaaatattatagcttctgacaatgcagaaataattataaaacatatataatgaaagggggaggcaaaagaaagtatgaactagagtgagtttggtaattcctcatctttaaaggtgaaagtcagataatatcattcaaacctgacaaatcacatgaacaaagtagtggcacatttaacactacaaaaataaatgctaaaaagaacatttccttgttaaaatggaatgctagaagaaaacctgagcggcatgtaagaaaaaagaaacactgtcaattttatcattgctcattttagtggaactaatagaaactgtctaaacaaatacagatctatgagtaatgtaaaagaatgttaacataatttagcagaatatggaatataattgatagaactaatatataaatctttttaaacataagaagttctaacacaccaaacaaagatacttgaaaacacagtgaaacattttatttttaaaattttaacaaaaaatcatagttctatgcttatataaataaaaagaaagaataaaagtatgtgcatttagcatctttctcaaaaagttaaaaagaatcaacaaaataaactgaaagtaagtggaagaaaaaaattgtaaagataaaaacagaagttgaaaagtgagaaaactgaaatatagtagaaataatatgtaaatccaaaacatggtcccataaaaacccaaccaaaagatctaacctaaagcaaaaaatgataaagaaaaaattacctaatgaaagtaaaacaacatgaaagaatcattaagaggtccctttattcaactgtatcttcataaatttgaaaactaatatgaataattttctaagacaatgtaatttactaagactagctctggtagaaacagaaaatcttagaacatggattttcttagaagaaacagagaaatttgcaaagcagctagattcccaaagcagcaagtccaggtgttttcacagttgtgtcaaacaactaaaaggtcttaaaaagaaatcagatggttttaatgcttttaaatcctcttcttgaacattgaaagagacagcaaactttcaaagttttactatgaaggaagtatattatttacagcaaaagtaataacaatgacacacacaaaaaactatgaactgatctcataaattttttttacaattctaaataaaatattaagtctattagcatattaagagagtaattattcatgaaaaagtggcgattattccacaagtgcaaaataattgactattaaggaagctattaataaaaataattatcttaacagatctatgaagagaaagtatatgaattctttcataattaaagtaaaagtatttgacaatgatcagtaaatacttttgataaagacagttactaacttggtaataaatgatactaacataatacaatatttacatctcaacttaaaagtttcattatgcttaatactaaaagcatccctactaaacacaaagatagactgagtatccattatcaccattaccatttaacagtactgaatgtgcctgaataaataatttgacattaaaaaaagaaatcagaggtttcaaaactctaaaaagaggagcaaaaactatccatttgcagaaaatacaattgtatgcttacaaacctattaaattgagtaaaaataaaactacaaaaaataaaagaatttagtaagacatgagagtgcaaaattaacaagcagaaattaataggtttactatgtataaacaattacatcatagaagaaataataggaataaaaattcctcatttgtaatagcaacagacacttaaggataacttaacacaaaatgtatgagatctgatgaaaattttttaatactgctaattcaaactaagtatttaaaagactgaatgtcctattatgttcttggttagaaagactaaacattacactcacataaattctccataagttaattagtgattttaacatgatctcaatataaacatagcacactttctttgagaattcaacatattgcaagttaaaattttcatagactacacaagaaagaataatcaggcaaatccttaagaataagagcaattaaggatgactagccctacaagattttaaaaaggattcattagtttaaaaaatgtgatgtagatacatgaataaaataaaatcttgaagtagatccaaatatacatggtcagattgaatacaataaagatggcatcgtagcagtggagaaaagaagaattatttcataaaccttgttggaatggctaggcaatcatctggaaaaaaatgaagttgaataataaaaatatattctacactagcacaaattataaataaagcagtgatttaaatgagaaaaattaaatcataatgatttcaaagataacataggataatttctttatagtcttctaaaatatatgactttatgaattctgactcaaagcccagaaggcataaaaatgtacaaaaataataaacatttgtgtgacacaaaaaatgagcaaagtagaaatgtttgcaactcaattcacaaagaattaatattctttacatataaagaaatactagatataaataattaaaatatcaataacctaataaaaatataggcaagggaaattagctaatcattcgaacaaggaaatacaaatgatttttcaatatatgacaaaactgtcaaattttctcataataaaatatgtgaatgaaaactatactgagctatcatgttttacctatcagattggccaaaattaaaatgtttgatagcatactgggtatcactgcatattgcctgtggggaaatgtgtccattatttgtggagtgtaaagtggtataatttctatgaaaggatattggtagtatctatcaagttaccaatgcctatacctttaactcaaaaaggatattggggaatttatcttacaaatatacttgcatgtagcgtatacgtaacaattactcattacaatattatttttaatagccagcatgaccttcattctagcttgcctaggaaaaccccaaattacatcaattttcttggcataataaacaataactttcactttcattcttaaaagtgtcctggttagatgataaagtacatcctagtgataacaaaagattagaaacaatccaaatgtccctaatgggtaaaggtcaaaattagttaaatagattgtgttagattaatacagtggaatcttataaaaaaattaagaaaaacaataaagaaactatatactgatgagcaaagatctgtaagatttaatgaactatgtgatatacagacaagtgaagaacagtatggaaaaagtagaaaaatgagtctgtaataattttcttaaatattccaaactaaacttgagaacaacatacgagaaaccaataatagtggcctcctgtgggggtgggggtaaagtggaaatagggaacacaggaccagatggaatgacattttttagtgtataattgtatacttttaatacatttttgcttttgaaccatatgaataaacagccttgctcataaaattataaaaagcaaaaatggagaatattgatgaaagataattcattatagctttaatagctaatttaataatttaatgaactttaaatgtcatataaatgttgtgaagaatattaatatcatgttagaattttccaaaaagatgcattttttgccttttatggaagtattgatccaaaaccttttgaattctgcttactgctgatagtgtaatcactatcactgtaattctgactccagaagaaatctattattgaaagtaaatatttagcagattctcaataattgtttcctcataaaataacacatttactcttttctttttacaggtagaggaagaaaggtaagtgttactttgcatattttctttttcataagcagacttatatccaatactatccacacagaactgtgctctgaaacgtttgaaagcttttgaaaagtacaaagtaccatacaaatacattgtgacaagtatataagcacagttcagctactgtgtttccaaaggacagatgcctcttaaccattcactttatggttaatttctgtttgtatatctgtttctgccagaaagttgtgacatctttagggattgaaaatgtctgattaaccttttattctttgcatttgtcattgcatagtacatactttgcacatattagaagtacaatacacatttgatggaagaaagaaaagataggaggaagggaaggaggaaggaagaaagtgagggaggaaggaaggaaggaacgaagaatgtcaatttgacttcaatgggcctgtagcccctctctcattggttgggaagtaaagatccagaattaattgaacattttaccaaacagacatttcttcccctcctctcccctccttcaccttcagagagcttaaaatctaattctggacacaagctttacacttgaaaacagggtaggctgcatccatgacccgagtatagctggtcagcttggtcacttgccatcaataaggtaatcctacgaagcgaagatagttctttttgcccaagagtgctctctgttttttggttatcttgaaaattatggcatttacttcagttgtatccaaatgagatgggcacagggatcaaggcagtagaaactgttgctggtcccaatttccataaattttctttacttttgcacacagtggaactttaataaaatgatttatcagataacagataaagcaatgctacacattcatgataagtaagagtgatgctatcaaggggagatcctggccagttttacacattttgattcagagggcaatatcataaatttgtctcatttggaataaattagatatgaatatatgtcaaaggagaagggctgcaaatgctatttcacatttaatttattgtgaaaacgaaaataaattgaaacttagcagattggtataggccttgaacaaacttgacagataggtgaaagatagatggatggatgcatggatgcatggatagacagatagagagacagaccaatctatgaaacaacaaaaaatcctaacaatgagtactgccatgaaataatcattttaattcagttagcagttacccgacttagagagataactggtaggctgtgtcatttgctgcctttctccaaaagtagtgtgggagagctgggtgaagaatatactcaaagcagctgccaatgtagcagactgtggttatgtgccactatcttcatgacttgttttcatttgtcatcaggtatcatcagaaacacaagagcaaagcaatgttataaaaatgcaatttgttcttcgtttatatccactttgatatttacttacaactcattgaccgattgattcattcattaattcatgttaactccaacataattactgaaccttttttatatggctatgaggcaaatggtatagatgatgcaaatgtgagaaaaacactataactgcttccatggtaatgacattctacaaagcatgtccacatggtattaaatgataagtaattgtaatgcacatctggatctgagtacatgaactttatgtttctcagtggatatgaaaattaaatttagtaaaactttagacagaccattattccatacaaattaacttattcaaagcctatattaatacaaacaatagaaacaaatatttacatttgtggcttatatccaaaataagaaatctatagaatcattagggaatttattattagaaacttataattgaacacttaaccccttttaaatattgtgcagcaacagaacagtcatatatcaaaaagcctacaatttaggtaagacaggtatcagagagttctattcccctacatataaagcaagtataaagtgcattttgcttgtaggtctcttaggatggaaatttcacaactattcttagcaggctgttccatttttctcattctgactgaaacaatttgtcctctctttttatttgttcttctagtcttcctctagaaggagcattgtttcagcatcataaagtcctttgtttattgcacaaaaatttatgtaccctttctaaacaattcaaattctttcagcattttgaaaaatatcttttattatagctcttacatggttaaattttattatttttgtattttttaaaatagaaagactctagaagttagtggatgtgaacatgcagaaataagcctattttactttgaagcccatatatgttgattctttcttgtcctaggctttgtgtaggttggctattagtccctagtgtttcaatcttgaacttaccctatagaactgcctcctgcttctggagagccctttccttcttttggattctcaatttattccttacttccagagtattcgctgcttcaacattagaatcagcaactgtgactgagttattattagttccgcccttaagtccatcatttcacttcatgaagttttgtcaggatagtattggaaggatataagtagattgtatctttagtagtacaatttggtgatatgggttaaaaacttaaaatgtctttagtccacaaatttaacttctaaaaacatatcataaggtattaatcagagataccatggacacatttataaacaaagatattcattttaatgtcattcttaaacttaaaaatgaaaacaaaatttaagagtaagataatgaggcattgattagatactcaaagtgcatgtagatggtggaaaactaagaatgccagcatattaacagtggttatctccggggtgttgagtaggatatttagggttttttaaaaaatatttcttctattttcaaaatttcctgctatgaacacatagtatttttataatcagattaaaggataatatatatgaaaggagaaataaaataaactagaactcattcttcttgtgtttttctacattttagagatgttaaattcatattcatcctacacaattgcccagtaaaaagcattatttcttaatatattaatggaaagtaatacattttaaaaattcattgaatgcttccatttgctatgctgagcatgtgaagtagactaagacacaaccatgactttgaggagaccaaaatctgttcgaagacaaattttgaaatgaagaatacaaattagtaaatgattaagtagaaatagataaagctacaattcatccaatattatttaatctatgtacctgatatcatgcaatgaggattccatttctgagaaaagttctaagaaacaaaataaattctatctacatctattacatttgctatatctattataaaagcaattatattgacctgaccctatttacttacatgatagtttcttatgttgtttttgattttcttagtcaattgattttttttcctagattttcttcaggtattgagaatcatctgagtggaattattatttttttctttctttttattaaagatgagcacatgtactcatttttaatgcccttccatgagtactaaaaaagggtgctagtagttcaggaatggcatctgattagatcctgaaaactatgtgtcatatgataaaagtgtgaaaatttgtatatattaatttatattaatttttatgtattacaatttctggctctttttgtgttttcagtctttcagtagtttttcctctggtgctttgtctttacatctttttgttgcaactattttgtgctctagtcaactctttggatttgatctatgtggaaactgaagcaaaatagctttacatatttcacacgctggatttttttatgtctttcaggtgagcagtaatattttaatgagtaatatctgactaaatatcctaaaaattgttaactttctttttgtagttttttgcatttcttacatagaaattccctgtgtttacatggcatattctagggtgacatgtttttgcccagcaagccattatattgtgctaattgaatttttgaattgtttttaatgtcacagggacaaaagggagaaccaggattagtgcctgttgtaagtatatgtataatcattgtttccttgtaccttaaataaacttagcttatagtataattgtatattattgcttatgtacatactttcaaaaataaattagttattttaaaaacaagtttttagtataacacaagcaaaccagaacagattagttatttaatacaatatttgatattctgtgttcctgacttttatagtcccatgactaaaggtagaaagtcattgttttaaaaagttaaatatattacatgtggatatacactgatagttaatattagtactagttagtatagtagtttattattccacacttctggaaatacatcatgccctgatcctgagcaaaattccctgttgcataagaattcctaagacttctttaaacttgtaaatggatcaagaagtatgttactaaacaggattaaagctcttcaactgtcgttctgtcaggtttcattattttttatttttatttttttgaaacagagtctcgctctgttacccaggctggagtgcagtggcacaatctcagttcactgcaacctccacctcccagattcaagtgattcttgtgcctcagcctcccgagcagctgggactacaggcaagagccaccatgcctggctaaattttgtatttttagtaaagacggggtttcaccagtttggccgggctggtcttcaactcctgacctcaagtgatccacccaccttggcctcattctcctaagttttaaaggtgttatcatcagtctgtcaagacaaaaagaatatgcatgttgatttatttagcagtgtttacattctctatttgcctttaattggcttgtttttttaacgaagattacctaaaacttaaataattcatattgttttatttaattttaaaaagcatttatgtgtgcttactatgtcttaggtgttaagtgctttacaaatacaaatatttatttatttgtcttcataactctatgagggaggtaattacctaatcatcactaccattttacatttaagtttccacttaagatccttaagaacagagaggataagtaattagtccaaagtcacacatctggtaaagggtagtgtcgggatttgaacccaggccccttggctccagtgttggtgctctttatcattacgccagcactgcctccctatattagttaaaactagataatatcttaaatcttaaggagaggaggaaatggtcatcaattgacaacatccatttgttaaaaaaattactgtggtttttgttgttattcttatttgttactattgacctctctgaatatctgcagaaactttacctttacaaattttcttgtttattgtttaggtaacaggcatacgtggtcgtccaggaccggcagtaagtagtttctcccaatattcttggtactcttgtattccttgagatactgaaaatctttacagatattatatccatgagaagataaaagaattaaacaatgatacttggtctcttaaaacattttgtcttaaaccatcttcaagttagacattgctttgcagcaatgaatggtagataagggatcattttattctgaaactgaagaaacattatgttagtcttgctattggttatgtaaaagacaaaacactttattgttacatttgttaattttagtgtgactttgttcactgaaattagggcatacttgtgtgttgtttgactatgattaatggtaggctagttttatctgcttaataaaattatatattgcagtagaatttgagaaatcatacagcaggagagcatatttatggcttagtataaaagattaattttttcaagtttggattatcagcagtattcataacatatacacacacttcatgtaaatgttaaacacatcaaatcagcttaaaatactaagttagctttaatggactcactctggttcttctgaagccctcacttttaaacgatgctatatgttgggttgagtaaatacacaatataatcttcataactcagtttaaatcctcttttaaagagaaacaaagtccccctggcaacagccatttcccagggggggaaaaacattttaagatatcagcacaataacaccacttttgaaatataatagtcatttgttatttaagggaaaagtaactgtaattaagatttggaaatttctaagtgggttttaaacatacaagggaagtaatgcaatattctaagtaaagtaaaaagaaaagatgcttgagtgtacataaagcagtactgtagtaggctaagaggctttcctttccattgcttttatcagcaacttgaacagtgatgaacattttggggtatcatgtaccaatttgatttcatacagtccctggaataattgataatttgtattttgcacatttatgtaattttcaaaatcagaattgtaagtttttgtgctcagagtttagtggcaaaggctttacctgggagaagacagcaaatatgatccttaaaaatttgcaattactagtcaagctaatctatttagctcactatgctccatgatgccataatgtgcacctagttcttcataggtctttaaatgtcactgataacataaacaacgcttctaagcgtacagaacttttatatgcacatggctttattctctatagtcttcaactgaactgaattaagtgtggtatttctgttttccaattttcttttatcaagtagacttttaaaaattcaataagaaagtatacatttttgcatgcataatcatcattttctgttttagggacctccaggatcacagggaccaagaggagagcgagggccaaaaggaagacctgtaagttgacaggagggctccttgtggggaacgtacagccagtcagtttacactgtgttctctgaatgcagcaagaagctgggagcactattcctctttcacctccattaaattttacaaaaatacaataataattgtatattatcttattagataacacaaatgatatttccttgtcccttatgaggtcaaatcaaaataaagtagaacttaaggaagcatagttaacatgtcatgagtttcactcatgagtaagcaatgccaagaatgcactgttgagataaaacatccaagttatatgatctgtggttgccacaggaataaccaagctggatacgggaaaaaattgttagaggataaaattttctttcaagtggttgcacaacaagtttatttcccaggtagcactccgcctttttcactcagcagccactgcagagatagcaaaggagtagttttaaaaatcagcaatcccattactagacaagtgaaatacctttacaataaaatagtgacctcaatatctttgagataaaacatgaggatattatataatatataccaaaggttttcttttattacctatctgcacagaatacatattgttctcaagtgttagagttacaactttttttttctttttttttttttttttgagacggagtctcgctctgtcacccaggctggagtgcagtggtgtgatctcggctcactgcaagctccgcctccctggttcacgccattctcctgcctcagcctcccgagtagctgggactacagttgcccgccaccatgcccagctaattttttgtattttttagtagagacgagttttcaccgtgttagccaggatgtgatccgcccgcctcggcctccctacaacgttttttcttatgtatcacttctaaaatctaatgtctttcatatactaaataactgtattcatttgtatattgctcccattatcccatgtttcaattagaaaattttgtttgtactgtttaattttttctctaatgtatctattaaaactctcagtagatttttatccttttaaatatatatttatccatatttaaatgggaggattagaagataagcaaacagcagacaagtttgaatatataaatgaggataaaatatattttagatcatatgcctaggaactcttgccactagtttcattcttgttactacattatccttctactcatttcacctcatatatagtgtgatgtcagtactttttcttaaacggggctgcactatggatgttacttgcaggcatgtaggtgcaaagcagtgccccaagagattggccatatcttggggtgtgtccagattattatatgccccattcttcactgtggttgtattgagttttctcactagtgttggtagcttaaacactgctgtaggtctccagatgtctctcctagatctagaaagacagaaataggtagaaaataacatcagttgggtggaggatgggtggtcgtgacagaaaaaaaaaaaaagattttgcattggtgtatttgtacactgtaagtaattgataacattgggtcctaagtctaggtagaagttgttgtaggaccagacttccagagttcctggttaagatccaaagaatctactccccaacccttctcacttattttccctatttgactttgtgatgtggtcaatttcctgtcttggttaggcctgagacaatcaatgtgaattgggtataagtgtgtgcgtgttgtgtgtgtgtgtttgtgtgtgtgtgtatgaaagagcgagagagagagagggagaaaggggggtagatttttaggaggaatcaagtgagacaaccctggcagatatccaagtaggaaatctgttcctctcttaatcctagcaaagaactggtgtgatggtaagtgtttaacaaatcttttaatgcctgcctacaccgatttcaagatatgaaatgatgtatagctttgcatgaaatgatgtatatgaaatgatgggcatgatgtaacagaatgcccataggtagaatgttttgcctcatgtctcaagccttctgggagctgcttagctggactaaaattatggctgtcacaatatcataaatagcattcccccacccccaccattatattaccatcaaacagtacggaaggctcacaatgtacagcatggtttctcactgttaacactattgatatgttaggccaaataattccatatgcattgtaggaagttttgcggcattcctggtatctacccactagatgccagttgaaactgccatcccccatacaattgtgacagttaaaaatgtttcttgacattgccaaatccaggcaaaatagctctggactgagaactagtatgtcagtagttcagtatgagatactcctacaagaccttcaggattagccaatgattttcatgactgtctctcatcacacgtcctcagttttaagtgtattgttcagataacttcatagtgacaagctagcaaactgtcaggagatggaccgtcaatgatgtgctaagttctagttgcacatgacacttaaccactattggtatgtttcttgatctgtaaaatgggaaatatactagatcttaacatctataacatttatgtgtgtgtgtgtgtgtgtgtgtgtgtgtgtgtgtgtgtgtgtgtgtgtgtgtgtgtgtcagagagaaagagagagagagagaaacgagagaaatgaagttctttaacagttcccggtcattcgtcttttctacttgtggatgtttaaacatcgccacctagtggcaacctcaaagtacttttttattgtagattactgcggaggtatttgagtatcttggaaatggaagggaatgataataaatgtaacatttaccttaatataagaattatgtaattcagctcacttggagatataaaaatagatacttttaatgagctcccaaattctaatttgcttttgatatttaccggtaaacattcttgtgttcacttaattttagataatttttatagacgtttttattaattttaatcttaatctgtgcaacagtaaatttcataagctatttagagggcattccgtggagacatataatgaatctgaagtcaatgaaaacaatcttaggatcagactttgaaatacgaagtgttaattacagaagaatggagaaagtcacaatctctttggaggactaatgaatatttctcaaacttatctccactcctgttgacaataaatatagttttgtgtatgtctctttggaactctcattgggagcagagattatgcattagttcactttttgtatgtaataatatctggttattaattagcaactgagcattgcaagaacagaatcagagttttctacacaaggctgtatgaataaaccagactattattttgtctgtgctgtcatatacatatccagttcatgttactctcattcatatgatccaggagtcctagagaacaattgaaatcagcctctgttgtgtataatgaagtgtgaagtaaattgttagtagtttaggagtcagaaaagttttgatttttaaaaactgagaataattttctaagatatcatttttaaatataagtttttcaggctaagtattctacttctatttaatagataaatttgcttgtttgtcccactactgcaagaagtaaatatgtctatataaatgtttaaatatattaaaataattaaatttctgaatagctatgatgccaccctccccaaaaccatcatatacaaactgccacctccaccacctgagcttgtcctgtgtttgctccctctgcactatcagctcctatttgaattgcttactgtggtcccataggtattctcatgtttaagcatgggagttctttttttaactattaaacttcatttaccatatttcccttgatccctgcttataattataaaaagcatattgcctgatgactttttggtcctttctttttgaagcctttcaagattctttagggttaaggagccagaaaatacttaactagccttgtgggaatgatgaggttagaggacggagcatttccagaactgaggacgtggctgttccccaagctgccttcagaatgtgggttaggagaagggtggaatttggcagctagaaatcattgctcacttctctgagaacttagacttggctgggtcacagtgcctttgcctctaatttctcaatggtctagtcttcctctgggggtgggaagtaaaataaagtgtgccaggctttaaagtattaaagaggactgaaaggtaacaatataatatgcatgtattgagtgtctagtatgtaccaggaactatgcaaagcattaaacaattagacagaaaatctctacaaactccaatcaagggattcttgaattttggggggaagggagaagttaagcagacgtatacatagttaactgtaatccaatgacaatccactgtaatttcagtgacagacaagtgaatttataattgttgatcaaatacccttgcacggcaaaaactcaatcaaataaggaagttcactttagaatactgttgaactgaaaattttaaaaataattattctaagaatgctgatttctgggtatttaacacaccacataaaattcttacccagaccacatccgaatggtagaagttcagacctatgctgaaatcagtagtgacatggctgatgaaattactctaagtggctagattgccatgtatttttaaaataataaacactcccttgccattaagaagtctgtgcctttagctttctactaagtgtatatttggcagtgggttctaattttaactggcttgttttccagggccctcgtggacctcagggaattgatggagaaccaggtgttcctggtcaacctggtgctccaggacctcctggacatccgtcccacccaggacccgatggcttgagcagggtgagttgtgtgcattgtttgatgtcacgtacaggtcatgttttaaattattgatatattgttaggattttaaattgtgtctgttcagatattgacacttgactgtaagagcagttaaataaggtcaacactgctatggacagtagaactaataaacccacagggaattgttggaaaaattggaagaagtattttctaaagtactgcttcaaattgtttgtatttctcaatgtcagctctagactctatgtgctttgttttttctattgattctaaagaaccactgctttccccctctttaaatgaaatgagagatttatctgtcctattctctaggctcagaatgccaaaaaaatctgctccgtatcctccacaagagaggatgacacatccatgatgagggatatgagaaggccattgagttgacactaaaaatgacacctaattatttcttcaattttagtttttttacttgaagtaaagtcaaacaaaaagcctttcaataccgacttctttgaattgttaatgtcagacataggggatttataagtacaggcaaaccatggagatattgtgggttcagttccaaaccacctcaataaagtgaaatactgcagtaaagtgagttatgtgaatttttttttgtttcccagtgcatataaacttatgtttttccacaatatagtctgttataaagtgtgtaatagcattatgtctaaaaaacaaggtatatttctttattaaaaataccttattgttaaaaattgctaataatcatctgacctttcagcaagccataatctttttgctgatagggtgttttgctttgatgctgatagttgctgactaataagggtggtattgctgaagcctggaattgctatggtaatttaaaaaataagacaacaatgaagtttgccatatcaaaatcctttgttgtcatttcaacaatcttcacagtatcttcaccaggaatagactgcatcttgagaaacgactttctttgctcattcataagaagcaagtcctcatctgttaaagttttattatgagattacagtaattaagcaacatcttcaggctctacttataattctagttctgttgctattgccatcatatctgcaattacttcccccaatgcagtcttcagccactaaaattcattcatgaaggttggaatcaacttcttccaaacttctcttgaggcttatattttcaccaatcaattaagaatgttcttaatggcacctagaatgataaatcctttccagaagattctcaatttactttgaacattatattcttaagtaataagatttaaaagttgaaatttatttatatccatgggctgcaaaatggtttttgtattagcaggcatgaaaacaacattaatatccttgtatatctccatcagaactcttatgtgacctagtgcattgtcactgagcagtaatattttgaaaggaatcctttgtttctgagcaataggtctcaatagtgggcttgaaatattcagtaaacaatgctgtaaaggctgtaaacagatgtgctgttatccaggccttgttgttccatttatagggtacaggcagagttgttttatcataattcctaaggatgctaggatttccataataagaaataaacactggtcttagcttaaagtctccagctgcattaacccctaacaagagaataagcctgttcttggaagctttgaagccaggcatggactttttctctctaaacatgaaagtcctagatggcatcttcttccaacagaaggctgttttgtgtacattgaaagtctattgttgagtgtagccacgttcatcaatgatgctaacttgatcttctggataacttgctgcagtgtctacatcagcatttgctgcttcactttgcatttttatattatggagatggcttctttcctttaacctcataaaccaacattttctagcttccaacttttcttctgccacttccttgcttctttcagccttcacagaattgaagagggttagggccttgctctagattcgattttgggtaagataatgttgtggttggtttgatcttctatccagactactaaacctttctccatattagcattaaggctgttttactttcttattatttgtgtgtttactgaagtagtgcttctaattttttaagaacttttcctttgcattcataagttggatgactgtttgctgcaagaggtctagctttggcctatcttgggtttcaatatgccttccttactagaccatttctagcttacaatgtaaagtgagagatgtgagactctttctttcacttgaacatttagaggccattgttgggttattaattgacctaattttaatgttgttgtgtctcagggaataaggaggcccatggagaggaagagagatggggaacacccggttggtagaacaacacacacaatatttattgatcaagtttattgtcttgtatgggcatcattcaaggcacctaaaacaactactttagtaacatcaagatcactgaacacagatcatcataacagatataataagaacaataataatattaaagtattatgagaactaccaaagtgtgacacagagacacagagtgaacacatgctattgcaaacatggcaccggttgtcttgcttggtgcagggttgccataagacttgaatttgtaataaacataatattggtaaagcacagtaaaatgaggcatgcctgtagattgagaccttaacaaggaaacatatgaagcctgaatatgatttttgctttacaaaagttcatacacatttttctcaacagattgtagaataaattgccaatttatttataaacagtacacacattctttcctaacaaaatttggaaactaatgtgactactaaaatgtatatgaacaattttggtcagtttgattactagggttttttaattgtgaaagagagtaggtcaaactgtttccaaacttggaacattcagggattcattaaaaggactataaaagtgttatcaacttacataaatgtaatttaaagtttactgggcattgaacaaagaaagaatatcatccaaaaacagtccaaaatggaatctggaatctttaggacaaatgttttaaaggcatcttttaggctttgtttagatgtttggcatctctaactgtgggaagaaatcagttaaagagacttaaacctgcaatcaattagactggctagtgcttatcagaacaatccatgcttttatcaagtatcagacatttgccctgtttcagaaactgctctggagcaacatacttatacaatactctgggaaagaatggtcaataaaaagcacaaacaatcaaagcaacttaagtctttttccaggctttaaagtcaagcacttagaatgattctcagaagagtcattctataagaattctagagagtgtacatttatccatatgaaaaggacgttgatgtatgtcttttactgtagaaataatgtcaacatatcgcttttacagccgttttcagctcaaatggctgggttggatgaaaaatctggacttgggagtcaagtaggactaatgcctggctctgtggtaagcataaattttactgatcattgaagtacttcagtgaaaaaaattattttaaaaagagaatcttgagttaactagtcaaagaataacatgcatcttcttaaacacagtcgtacattcattcattcattcatttaattaacttatttactctactgtatgccagttaaaagcccagtgtgtttcattcataattatgcaaagtgctgacattaataaaggtctatctgtacattttatttaatattggaagaaaataaaggagtttaagacatataaccacagccacaatagtaaaacctaaacctttataaataaaaagcagaactattttatggtgctcttagaaacagtggtttggtaaaattttgaaatgagatgttttgctattttcatttttattattttctacttaatatcctctggctgccttattccaacagctctatggtttcctggctgagtcttctcaatattcttaccctcttttgaatttcttcaacatcagaaagactcccatttttttcctggatatttggagcaatccaattttattgaataaattaacacttttaaaaccaactctcccatgttttattgctcatagcatagttcaaaataattccaggttaatagcatttcaggcaataagaagtgcaaaatcagacctcatagataaccaccccttctatccatccttaaggccagcgttgtgagcattttaaatattatttgtatatttttaaagttactagtaatatggcatcatttagtgattcttttgggaacttttttttgagttgcatgtttttatccatttggagtttaaattacatatgtgtggttttttttaaatggagcttttcttactatatgttccattcaaaataaaaaattaaaatcttgccataagaataaatttgattttggccaggcacggtggctcacgcctgttctcccagcactttgggaggccatggcagacggatcacaaggtcaggagattgagaccattctggctaacacgatgaaaccctgtccctactaaaaaaaaaaaaaaaaaaatacaaaacaattagccgggcatggtggcaggtgcctgtagtcccagctacttgggaggctgaggcgtgaacccgggaggtggagcttgcagtgagcccaggtcgcgccactgcactccagcctgggtgacagagggagactccgtctaaaaaaaaatccaaaaagaataaatttgattttaatttattttactttttaaagtatgatatttaaaaaatagtaatatacatataataataaatgttctaaaatcgcatttttgttttcttccttttgttatgcctcagtggaacgatttcatgtttaaatgaggaaagcctgtgtggatagtttcaatctatgttgtgaaagaaagaaatcacccaggaaactcagtgccccaaatcgttttcaactcacatttaatataatctagtcattattgttgatgtttcataaacctttaattcaacttatttaagttataagaattatctgctgtgaatctgaagaattaaataggaagtttgagaactaacttatgtcagccaagatttttctttattcggatgttcttacttaacagaaccatccattaaacatgcaagtgttcttgttctaaagacattgggtgtgtacagacatatggctcatttctctttataacactgaagttatgtataaaatcatcccaaatgttgtccaagctttaatctccttgaatttagctgccttccaaatgagtacagatggagaatgtcatcatccccctttgtcaaaacttcacttttccagattctagagatgattcaacatttttgaaatatttgacctaattgtcatgagtactttgcaacgtttctcctcatttgtttttaagggtcctgttggcccaaggggaccacagggtttacaaggacagcaagtaagtctctttataattaattacatgctgtaagaaaaacatacacacacacatatattacataaggtctctgtgacatgactgcttttggctggttttaaaattttatattgtaatgctcacttcaaacaggatatattaaatagtttttatttagaaatatatgccacatgtctttgcaaagtttattgggataaatttttatcatctgatttctttatgtgactgaccttcgataacaaaattacatgactttgcatctgaagtaagaaattcattatgttatgtcatgaaaatgttcacaattggttatatgccaactctgaagctatgaaatcagatcataggaggcaatccccgtgtagtattattagaaataagaatcaagatgtttgttccatgggatctttaggaagaatataatacaatatgcttttaaaatgcctatcagatgccagtaaaatagtgatgtagaactatttttatttattatagcaatttaacaggcatcaggaaataatattttaaaagaaagaatgaaaataacctttagttcagtcaaggttaccacattgtcattgtcatgtgtgtggagttttacttcaagctatcagtgactagaaaatgtggttgatgatggtgatgatgatgatgttgatgaggagaactaccattgatggagcactcacacactgtgccagcactattctaggttcttaacatacattaattacttcagcagccataacagcctaataaagtaagtaccaatattattctgattttacacattaggaaacagttacagacagattaagtaacttgcccaaagtcacacagctggaagatggcagagccaactgtctaaacaattacactgtatattgacagagtacagggtttaatattctatttttccttggtttgtatatatactttgttttcaactgtagggtggtgcaggacctacaggacctcctggtgaacctggtgatcctggaccaatggtaaatgtcaagtaagcatgtagacccagttacatttgggtccaccattataatgatgtcaaatattgagttatttatcttcccaggtcctccctaatgtaggaagaaataacaatccagtttgggagtcctgttctatgaactgttcttaagctatatgtttctcatagcagaatatttaaattcaaagactatttaaatttatttatttaaatttaaatttaaaaattcaaagaatatttacattcaaagattatgatcattagacagtgctgagcgatttgcttttgtgcaattatacttcttgttgagcacatgatctggggatgcaacataaaattcaaaactttaataaaactattttctctgtctcaacaatatttatcattttcatttgtttcaataatagtttgacatttcatttgtctcaataatgttttgaattgtattactggcaagtaaaggtaaatattctttttttccttttgttttgttctgttattagggtccgattggttcacgtggaccagagggccctcctggtaaacctggggaagatgtaagctacctttcctcattttccattcaggttttgaagaggcgaaggggttaaaatgttaacaagaatgttctgtattaatttccattacatttccccacccttttagcttgcattaaattcaatgtaaacaggagcactcagaatggaattttacaaatatctaaaagggctcttaatttgcgtagtattatgttattaggtactactgtctcttcctgaattccctgggtttttgttaagatttctccattagatgctaggcttgttgtcacagtagcaacaacttttcctagtggaaccactgaaattacctgaaagaaaaaatatgttgctctgatggcaatacatcattatgaggtcttatttaaaaggaatttttaaaacgtgttagtagtatagtgccaatatggctccccaatgatgaaaaaatgatttcttcaattggatttttaattaaagttaagacccaactccagattttaacattaagaacatgtaatcagagaacagtgtgcaatagcagacttacatttctagattcttagttgtaccaaagttgaggatcaaattatgggtaggccattaatttctatatgatactaaaccaagtattaataaatattttctctttatgagtcataagatttatttaaacaggttacattgaatttggacatagagcacatatttctgatagtcttttctttttaaccacaggaaagaaatggaaagtagtattttaagaagcaatactttaattcagtgtcatgtgatcatatagaattctatagtatatatcctatagcatacatgtatgtttatgtgtataaattttgatgttcataaaatagtgagctacatcagaccaagaaaattttcaacaatttattcttctgggtaaattaatgaaagccacagactaacttgatagaatggagtactatcaggaatataaggaatagagcctatttttactttattttttgcactgtttagagaattgtacattagctttctaaagaagactgttttattagtaatttatttatcatttagtttcagagaagaaccttttaatcacttttgccttcccaatctcctacatttttttccataaagggtgaacctggcagaaatggaaatcctggtgaagtgggatttgcaggatctccggtaagtttatactcaacataaaggcaaactttgaaaaataaagaacattgaattaaatcacaattctctgtatgcacatgtatcaggcactaagtaaatggagacaaacagcattgtttgtttccgtaaaaatgtaaaatgtcacaggacgttttgccagagtgattgttaactccagttgtctgctttgcattggcaccataaataagccttctggagctagagaagtatattgaacataacatgaatgctctccaaactgagtttcaaatcctcagaaaattcagaaaaaaatagttttttttttttcataaaatgagttaccagcttgacctgtttacaattcacacttcaatcctattttagctctttaaaatctttttaatatttttactttatattgtcacatatgtctaaataatagcttgaagaaaagcttgttgccttgttttttatcaactagagacagtaaattatggatgggatgcttctttggctgctccccaaaccctaattttggctgaaattcttgattaatgttctgggtcctaaaatcatgacaatttacactgatttccagctctcctaacatagctgttttcttcccctttggctccctaaaagaatagactcctggcaactactccaccagaatccaagacctggcccctttgccgttctctgaacccacctgtctcttgtcactcaaattgctttgctaggccctcttctagaatgtgttacgctggccatggggaaaattagagtatgataagcaagcaaaagtcctcttcaaacattcctacttcttgggtttctcctgctcaacagcccctaaacattcactctcccatttattatatttcctataatttccttatgtttctgccactcagtacaatcaacagtaccacattactttctgtttactttctgaaaattgatgaggttcaatgctaggaaatgttttaaacaaatgaatgctcccttatcttttaagggaaatttgcaaggctcaaaggattatttggttgcaaatataaaccaatttcccaactccctgctttctttcctcctcgatcagcctgggaaataaatgcagacagagacatgaggtttagtcattagcacagatgtccttttcaacccatccaggtttgaacttcccatgtcctgctgcactcttgctcatgctcacagtgtgggccctccatggggaggaagggtgccctgccagcacaccacagatgcactgtgcaagctcagtgcaatgtgtgattgcactgtaatgacagtcctgggtcagcagaatgagaatttttatgagcattaggacatctggttcattttcttgttacattagggatatgtaatcacatgagaatttctcttgcagaccataaaaactgaagttaactaattatttgaaataacatagctcagcaattcccctataggcttagacgggtctgcactaagttgcctgctaaggatggagaggagacaaatctctgtaaaatgaggcattaagttgaacacttaaagggagttcttgatgtgaaagaattcttgagcggggttgtgtaaacagaagaattaatgggacttcatttgttcagagagcatgatttgttttacccctactgtgataaccctctaaaacactaaagaaataattttctttcaagaggtcacagacgaattattgctttgattttgttatatgaatttcatccattgagttgcttattcaaccatttagaaatagtgaatgaaacctatgatttgcagagcagaaggattttttatctgtataagatcatgctaggccaagagaaattccttaggaaaggttaaagtgctatgagagtaagaaatatcaaaccatttctttatttagttgtttatccagtgattattcattgaatgtccattaaccaaacataaggctaagtgccagctatacataaattaagaataataatcaataagtgatcacatcaatcaatgctatcaaggtgctcaatatactggcggcagtggtaatggcaattcaatgcaaaatcaaattaatataggccataataataagtaaataattaagtcattagcttagtatcttttaagacagtataaggaaaaagtttcaagcatcatttcaaaatagttgtgccactggatttgattttctatggtatttctattgttttttatttaatgtgtttaggtgaaagctacatagaatttgcagaaattaagtaattatttagtcaagaaaccaagcattctcatatttcttgactttcttttctgttggatattttgtttattcatttagttttttaaataatcataaatccacaaagtttttttctaaacaatttattttaaaaattcctgaccacattataatactgttcttcccatcatattctgctgccaatattcagaaattcatagaaaataaagacattggtttgctacaaagacatttaatcgtgtaccataaataaagcacaataaagaaggaaaaggatattttatcttgaatttctctcctgaatattttttttctaccttggtatagtcaattctcatgttggacatattgattcatgcttatgttcttgttttgttttcactactaattataacacagtgatatcatgtgaaaaattcaaaatgtcatgaactcaatacctggcattactttgtatccttgtataagtcatgtttccatttctaatagcatatttactttgctaattttgatcacccagatatattttgacagataaaagtatactgcttttttttgttcttcttaatatgttgctggaaaactgtgtactagctattttttgggaaaaaatgatatattaaggaattttgcatccttattaatgactgtaaaatgccctatctatgttttcctcccagggagctcgtggatttcctggggctcctggtcttccaggtctgaagggtcaccgagtaagttcaatctattgtaatcctctcagatactgtggtttagtgaacaggctctggggagatttaccttcaaaatctttacaagtcaatttgtcaattgtccttaactgtctatggttgcagtattcatctgtggttactgaaatcacaattttttaatacatttcctttgagtttaatttgatttgataaagaaatatattttgaattcttactatgtactggacactatgctacaaaagagggtacagtgatgaatgagaaaaatctctagcctgaagcttcaggctaatgggggatacggatgaaaaggtaggcaattcctgtatagtgtaataggtgacatggtagagatagagagtactaggtcacagaagggacccagtctacctagacttggaaagcaatagaatgccttccttattactgaagataattacgatgtaactattatatattgtttacatatgtagaatctatcatctatctaactatcataatatcaaatagtgatattcaatcaatatacactggcctctgttttgagtagttgagattttgattaagatgtctgctgctatactcattattaagtattttgaacattcaccttgaatacaaatgatattttataacaatatgaactctgtagttatgtgtttcctctaaagccactgtaaggtttttatttgtagctacagattaaatttctatgaagtcacaagtgtttgaagggtgagaacactgcaagctgaaaatgttatttaaaggtgaaaactctaattttccttgaataagctttcagaaaagtttgagaatttgaaagtattttgagcaacaactttaaatttgatattcatttttataaggcaatttctgcaagcttatttttggttcttatgcctttgaggattgaaaaaaacaggatacaaatacaaatttacatttttattctcagggacacaaaggtcttgaaggccctaaaggtgaagttggagcacctggttccaaggtaatcttataattatctcactgtaacctcactttggcatcttagttttgcttcaaatgtttacacatttttcagaaccaccttaattcagcaggagagagggctacaaacaaatggttaggtaaataaacataatttttcaaagatgagtggcaatggctttaccatgacatgacttgatatgcctccaagaatagcctccatagcactgggtgtctgccagtgtaggatgagtgttgtcttcatatgaagatggcactatgaatctatcttttaaaatacaatcattcatttttctttttaaaaaatatctgaaaggtttagatagttcattagtcccattattgagtacccctttaataccaagaccttctcctcattgtttcttctcaaaatttatttgtatttctacagggagaaaaaacatcaaggaagtataaaggaatttctagtggaaagcatcatgacctaatgtggaaaatcatttggctttaaaattttttttatttctaagtctcctagaatagatcttaagatagtgttacaatcaattttagctttgtaaagttttacttgagacgtatcagacatagccagataagtcctttcctgagactagttactgtggctaggtatgatagtttccgtcaatcttaagtccccaatattattttagatgtatttctttaaaactacactactattgcattttgagaagaggtaataaaacaacattctgagatcctatatcaaaagtacatctttcatatgtcctctttgaaaatatgcttttaaaattacacacacagaacaaagtgatgtatcggttgtaggcttctcatactgtaatgtattctcatttttttttagggtgaagctggccccactggtccaatgggtgccatgggtcctctggtatgtgctcgttttcttgtttcttaaatttctaaggttatatttccttgccttttagattacaacaagagaatttttaaatgaaaaataaaaataaatggacaacatatgttggctagtaaaataatcttgattaccagctgatagacaagcacaggagagttgagcccttctaacagaaaaggtttcccacatttcactgtttctcttaacggttgaatgcccttattctttttctatactcagtgatcaaatcaagattatcgcagatttagcccattaaagccaggttaagtgaaatctatttatgtaagaggtgataggttatttatctccacatggggatagtttttcaaacccaacattgcccctggaaatactactgcttggtggccaattatcttgaatctcaattggattgagtggggtagtcagactactctacatttcaaattaggtgcttcaagagacatttcttctctatcgtctatagggtccgaggggaatgccaggagagagagggagacttgggccacagggtgctcctgtaagtatatctgcttttacttatactgctgagatgtgtatttcaattcattttcagatttggtttactgaacttgccttttaaatgaaagtaatagtactggtcaccttttttttttttctttttcttttggaataaagtcaggtttacagaaaagttgaaaagaaagtacagagaattcttgaacaaccttccctttgctttaatgttaacatatagccacagtacatttgtcatctactttaatacaaaaattaagaaaataatgaatacatataacagcatggaatatagtccatagaaaaacacaaacttggatatactaatgaaattacaataataggaaacatttatcaagagcttattatatgccaagaattcttccaagcattttatgttcctcatactcctaaaaggtggttactctgagtgcactctttgaaagatgtgagcctcctgatcacctgtccttgattcattttaattatacagattgagaaatactcttgcagactatttatgtaacttgaacctgtataggaggcatattctaattattcttttcgcaattctctgaagatcaggctatgctgactaatatttcagacttatagttcattactttggacctaccttgctttagatagttaaggactgccacctttcctctattatttcaagatccgatcatccccattactattagcaatagcgggtttacactgtctctgctattacctccagcccatagaggacaaccacctcagagctactcaacaataccaaattcagggccctgatttggaaagtgtaagaccctctcaccaggccattctttatcactttagtaagcagagtgtcctaaggggatatagagaatattatagaatatagtcagctattggcttatctaggctaacatcgtctatcaatatagtatgcttacttctctgtgctttcttctactgtctgccaagggaggtctgacatttctgccccagcattggctattgctcttcccacatttctaagaactgtctcccatgtcagcactatttctcagggttcttaccagggtattaaattgcaatatcacgagacagtgtatccacatcattaaaattttccaactttgtattctgtttttttgatacagtatcttcaggaccaagacccatacattctttctcagatcccgcctctacccgatgtttaggtcttataggtgctttggtgtatgatatctttttaaaaaatcaggagtagtgttagttattggtgtggtgtccagaagtgaggcttaagttgtcttccaaattagaggcttaggtatcatcttcaacaagagagaactaccaactattaatggggggaatgggccacttctctaggccaagtgactttagatggacctgagattttaaatttcttttttttcctttaaattttgaggacagggtcttactctgttgcccaggctacagggcagtggcacaatcatagctcactgtagccttgaactcctgggctcaagcgatactctcacccaaatagctgggactacaggtgcatgccaccgttcctggctaattttttttgtagagacagggtctcacattgttgcccaagcttgtctaaaactcctggcttcaagcaatcctcctgtctcagcctcccaaagtgctggaattacaggcatgagtcaccgggcccagctgaagttcttcagtgtgttgacccacatatcctattgccaaatctcagaatccgactcctcccaatccaggaccctgactgtgacataacagactttctaggtttgagaattcagccatcccaagagctctcatagtcttgcattaagccctgtgcttggcctgatattcagctttttcttctctctggttgcagatgagaattaaaataaaatgctgccaaggagtcttactttggtgatttatcaccatcagccttttagtgtctttctccaatagatgcactatacaagacccatgcaattccatcagctttataattgttattttcttaattcttctcaaatgcccgagatattgcattactagcccattcccttaaaatatctctgttcaccattggtgacaatattttccattgtgccatcgcggcatgccaagggtgattcatactccaactgtcaccagctgaccagtgggaaatccagcttacaaatcccactttagagtttgctttcttgtaaccactctgacattaatggtcttagggtcttaggtcaggtttcctaggaaacagcctcaaaaaagtgacttgtatacagtacaggaaatttattggtgagtgctcttagaaactgtatttttgaaggaaggaatgaataaaagcagggtttttcagagggagaaattgaattgtgttgcaattgcaacagagatctcagtcaatttcaggggaactatggagctgagatggctcttgcagacttgtgtcaaataagggccaatgctttgtatccctgcattgaccaaggaaagagcacagtcttgagagagctaattccctttagctgagggcaattcctagggaatgtatcaatagtgagccatcagcaggttatatttccagctggcaggatgaatacttcagtacttaagggagctctgggtgaaacctacagaattcactataacttaatttatctctcttgtgtattttattttctggacattgcttctctgagttaatctggctattaagaatactgaggtgttcaaattttcattgtctctgagttcatatgttagaagatgatacattaaagtaaaagaatcattttaatcagtttcattttctcaatcttgattttattgcttattgctataaggatagatgcatttatgactaccatatcagcttgtgtaaatgtatttatattgctattaactgagtgagggttattgtcagttaactttaatatttattcttcaatttgcaatatggaaattttttataaggcaaataagagaaaatatagtctaaaatgtaatcttatcctgtcttgtctctttttctcttaattagggacaacgaggtgcacatggtatgcctggaaaacctggaccaatggtgagttatattattttcatattaattcattaatttattcatgcattcttccatttgtacattcaaaaacatttacagagcactcaccacatgccagacacttggaataaaaagttgatggacacatagtacttcttcaaaactgttctattaaggaagagagagatattaatattgttgtataacataattgttaactccataatacagtatacaacttcagttatgggaacaactttcaagccaagtcctgaaagataagtatttaatatataaaatgggcaagaatatagcattgtccataggatagatagatgacaaaacacagtgggctcagaaaattctaggaaggtaaaattggattgagaggcgagagctatatcatgaagggttatacttaccatgttaaatggtttttgagctcttttctatagtagttaatgtgcgatcattcagggattttaaacataagaacattatgaccagaggataatctgctggtaatgttgaacatgaaatgaagatggctaagaataaagaatgagtttgaataccactggcataattccagaaagaaattacaaagatgtgaactaaagttattatggtagtaacagaggccgactgcatgtcaatgagctaagaactctcatgggcatggcccagtagatttctggtttaaagtgtttgatggatgatgtaatttatctgaaattggaaataaagaaagaggaacagcataccgtttgtgggtttgagtttagaatgggaataaatgaattcaatttcgtgattagatatgcaagagtggagctcaggatagaaatttgaatttcaaatgtagttttggaaatttttaacatacaggcaataaatacagctgtgggagtaaaaatgtaacatggaatgagaaatgatgaggtctcagtgtgtaccaatattttgtacattgtgcttttttgtgcttggtatggacaaggctattgtattttgcttcagaccatcttgcactatttcataggtaatcctctgtaactatgaacctttaattcacgcttgaagatgaaaatctgaatacttataactagatctagatcataaagggctatacttacttacccatttaaagggtttttgagctcttttctgtaataattagtgtgagatcattcagagattttaaacataggaactttatgaccagaaagatcatctccaggtaatgtggatgatgaaatgaagatggctaagactaaagaatcatctgtaaattataaacatagaatcaaatgtaaattataaacaaaggcaaatattttaaatttgacacatttcaagcatattacctttttaaaattccattacttgcaatagttctcccttgtgaatagcctcaattgctgcccattaactgctgtgttacccagaggtacaaaggatcctaagagatgtgtggaactgaagtagattttaattgtaacagtgctatggatcaaggtctctactattattcagtcaaggacacttaaattatatctctacaagcaaaacaaaactaatttaatttttaaaaagagcttcaagacataaagttattttctgaactttagagcaacttattatacatgtgcttttcccatcaaattatgtgactttaatagtggtgccctgacttttaaaaggaagatgtaatgatatctagaataaattatttcatatattattaacactggttgctagtaaaatgtacatacttatattgtaggcatcatgtagtaaactttatctgttcatcatgaaattagtggttctcaactttggctatacactagaattacctggaaacttaaaaatattgatgtccaatccaatttaaatgtaatctctagaggtagactcagaaatcagtattttttaaagctctacagatgatttcacagggtcatcaatgtggatagctgttgcaggaaaccaagaagtggtgttttgtaatagcacaaatatatttataaaatgttttctatagccattttttaatgtagtaattgagcacaaagttgttactgaaaatgctcctaaataaatagtccatggaacaattttattttgctgcaacaggaaaaactgagtcaagctctacaaggtaaattatgctaacaaaacaccaagaaaagaaaatattatgagggaaagagagaaagtattgtaggaaatattcatgatcaacgtgggccaagactgaacgatcataaaataaaataaatttaaagctattagccaaaagtaaagtataattatagaaattgaaatcatttgccccaaggatcttttctcccttgtttctcataagtaggaaacaaaacataggatgaaaaaatatgtacattttgaaagggcttctattaattgaaaactgatgagactaaagtacaatccttagagttagagtaatctgtactagaattccttttatactcacttcttttaaatttagtcttttaatcaatggtttaaattctatgcatgccttcccaaatgtagggtaatataaatatccataaatatccacttattgcctgaaaaacctctctaaaatatccagatggtttttttttttttttttttttggagatggagtctgactgcaggttggagtgcaatggcgtgatctcagctcactacaacctccacctcccaggttccagcaattctcctgcctcagcctcccaagtagctgggattataggcgccagccactacacccagctaatttttgtatttttagtagagactgggtttcaccacgttggccaggctggtctcgaactcctgacctcaggtgatctgcctgccttggcctcccaaagtgctgggattacaggcatgagccaccgtgcctggcctccagatggttcttaagcatcatttttatagaatgaagtactagattttgatataaaatataactttctaaaaactatattatttgattaacacaaagaaagtacatctctcaagaggcaattgtttgaaacactttatgtttgtgattgacttaatcctatatgctatttgagtaatccaattatgtttaataccttggatatgtcttttagtattactttagattgatgttgaaggtacttataatgaaattagcctattatctttgtaattttaaagtgaaaggcaggttattcttatgtgtctaatacaaaatgacgccaaactctaaaaaatgacctaattagatactaattgaatacatgtctgattacttttctggtttcttttaatagggtcctcttgggataccaggctcttctggttttccaggaaatcctggaatgaaggtaagatgttaatgttaatatacagtatttaacgctacatgattacatgagtcccaaagtgaagaatgacatttaattaattgaaaagtgtgaaagttacttttaactaaggaaagagcctagagtatgctcatttttcattattacatggaaaaagatacattaaaaaataaaattaactgtataaatataattaaaggagaattacttataattgtacccttataatatcaaagaacctgatgtgttaggactctaatgccagccagtcaaaacaactataaggaataggagctttaaactgaataggaactctattctctattcttgaatagagtacctggaagtaataaacagcagaatgttccaaacaataggaggttaggaggttaaaataaattagatgctgtcaaaaggcatctaacattttcacctaacatttgttatcactctgcactcccccagctccacaatccaattctatgaagccattaaaggagtgggcacggagaatatttggctcttcatgtgggaatggattaaagtattctgtgggatgacttaatatttgtagtgaatcacaattggttctttctctcagtactttgggataaattcaaggatgacagtagaaggacattaggattacattagataaactggtgaattaattcagaacacctctttcaaattgtaagcaatataacacatctgatttcccctgatgccatgtttccctttgcaaagacattcttaatcctgaagagattatgcacaagattatgctgtacaaaaatgactgcggtcacggacagtcacctggcccctctaaactttgttttctcatggaattttgttgaggattatgtgacaccatctatgtaaactcatcacatagggccttatgcagaggacaccctcaatgtaagttcgtgcttcttattagttgtgctactcaaattggatttaaacttagaaacaaaccagaagaaaaatgtctgtagctgacatttcagatattccttgaaaatgtgagaatcaccaagtcaaattattctgtaggctctctctaatgacatattcaaacactgtgctatggggatgccgctgctttaaaatagtgccttaattcctttccctgcattcactgagaactcaatgtgaactcaagtgggtgggatcttgttgggttctcctctgaatctgatctgctccctgaagtcctaataatgtcactaccacagactctggcccagactctctatatacccctatcaaaacatgcaaaatcccttccctctttttgtgagaccctccgtccccaaattgagttctggttaaggaaatactcacaaatctatgaattagcagaaagaggtttatactacaactttcatggggtttactttaacttcactagcaatcatagtttacacaaccattcactctggttacttctctctcctcctgggtgtttgtggtactggttgttggctactgaaaactgctcaataaaactcaaatatctagcaaaactgtttctgttagaaattttctgtgttttccttcttgcttctctccaccataaaattcctggatctttgtttttggacaggatcctgcttttcctacaaagttctgccatggtctctgctctctgactaaagaataaatttccaaatccagttctttgcatttcaatgaagtgaaacagagattcaatatgctttactgatactgatgagattcctaaggcttagaattttagttttccaggcctctttaggattagatccacataggtacataataagccagataaaatacagaaaccaagttaagtttgaatttcagatgagcaaagaatacatgtttagtataagtatgcctcaaatattgcatgggaaaaacttatgctaaaagttattgttgtttatatgaatgaaaactcaactaggcatttttatttgccagctggactcactatcttggcttgaaataaagggagctattaagttaccttaaccacttcactctgctcttaatgttgcactttaaaaagtatcttttaattcttatcaaagaagtattgtttctttggtttaaaaatagatggtattttgcttataatgctgccaaaaattaagttgattagacttaaataaagttgtagcccagatgtttttcactttactgataaatgctttcttgaaggtcggtggaactgagtttttacaactcaaatcttatattctgaaatatgatttgttatattgcttatatagcaaggaaacaatttattgttctgtaatgatggtatgaaattttatatagactttttacagtgagtttcacagatttggaaaactattgtctaatcttgcagcacattttagctgatattaggttgttttataaatattggaaaataatatgatttatcctctgatgattgcatgaagctttaattttgtagtaaatttttagacttgaaatatctagctttacattgaacagaaacaacctctttaagcacagtgggttggtcagtttttctccttcatttgatttgtgttaaagagtccgaatgtatacactgtttatacagaaatgggcttgaataacctgagtatttatgtaagaacatactaaaagtaaaccatgtggatttaagaatatctattctttgataaatatcttaaataaaagatatttaagactatcttattctttgagtagactcagtgtgcctgaggtgtagggctgtttctagtttttctttatgaacttagattatctaaactgtttaatatgtaataagtgtaaattctgataggtgtgggaagaaaaatctcagattttgtggaggttcagaggagagggaacttaagctaaccctggtgtagggcttcttcaactggagattggatatggagaatattcctagtgaagaggccaccagcgtcatcccttaagaaggaagtgggaaagtgagtgcgctccttaagcttggttgggcacgcatctcttgtaatcctctttggcctctttcagtatttgggtttcaaatgtaaaattccaaataagcggtcaactttgtacaatgccactctcgtatttttcttaaattaacatttccctttgcacccttttagggagaagcaggtcctacaggggcgcgaggccctgaaggtcctcaggggcagagaggtgaaactgggcccccaggtccagttggctctccaggtcttcctgtaagtttctagcatatttaagaaccagcccagaaagctggacatttcttgtaacatcagaacaaattcaacctatttttttaattgatacataatatttgtacatatttagggggtacctgtaatgttctgttatatgcctaagatgtgtaataatcaagtcagggtatttaagatatccatcccattgagcatatatcacttctatgtgttgggaacattttaagtcctctttttctagctattttgaaatataaaatttaatatattctctgaattctgaatgagtgcttacaactgtgaaaaaatatatttcccttgtcaactctgtaagttttacctattttatgtaaaggagaagtagtcaaaaaagtaatttttatgatataatggtggttgatttttaaaaaatgcttctacttcctttttgaagatggctggacatctgtatactagcacatttgtatctatatattgcttaatatttcattacatacttttaatgtaccttttagggtgcaataggaactgatggtactcctggtgccaaaggcccaacggtgagtactgcatttatggcatgtgaagctcaaatgggcatgattctttagacattggccccagactgctacctgtgtctctacttaccacatcactcttgctgtttaatagggctctccaggtacctctggtcctcctggctcagcagggcctcctggatctccaggacctcagggtagcactggtcctcagggaattcgaggccaaccggtaatgacctttgaaagaactatcatcctttagtgtaatctaactacgagggccaagagtaataacatgtcatgtgatgcaatgaaacatagataacgtgacttatccaaatgtgggaagatgggagtctttgtgaagtgaaagctaaatgttgaggtacaacttagatgtttaaattctaagtggaacattattgcagtatgttaaattttagtgttcttttatttaaaataataaggttataactttatggttcacctcatagaattttatgaataattgaataataaatattatgaaaatattatgcaagccagtgtgaggaatatggagcttcaataggaatttataatgacaattaggctagggttcaacaactatttcttcagagttattgttaaagagtgattcaaatatattaatcagattgaatgtcagattgaatgttttcatattttacagaaattatttattagaaaaaatattttgatgaacccataacaaataaacacattgagaagttgtgcttaatagcttttagcttgatgtataaaaataaatatttaaataaatatttacaattctgttccaagtaatgtggtcatgctgataaattctcttaaagtgctggtgacagatttattaaatcattagtgttgctagtgtcacatttgattttaccaagttctgaattttgcaatccagttcttacaacttaaatttcagttggtatttaaagacacacctacagaaaaccctctaacattccaagagtgaaatgccctatttgaagttgctaaattctcaataaatacggcataaatataaaattattttgattctgggtaaacaagttcacatcctaaaatacagcctaaatgtatttatctatagaaattgtcattgatagttccaattttaattttcaaatttgaataataactcaataattctatttattctactacacatgataaaaaacatgattttaaaaataaatctcttaaagaccactataaattaaatggcttccaaattatactgaattttataaaaatttacacatattaacatattcacatgcattcatttaaaaatgattatattatactactgatgcaaaaccgactcagctggagagaatttttaaagcctatttattgtaactaatttgagcagattggactagctaaatgtcctggttcttacaaatatcaatatatttttttcagggtgatccaggagttccaggtttcaaaggagaagctggcccaaaaggggaaccagtaaggtttcattgttttaatgataagtagaacatagtattgtctggaagtgtacagctcaaaatgctcaagggtttaaaataataatgagaattataatagcttgagatgaaaatatctcattgttccatatactttaaaatttgtgactgacttcgttaaattaggcttccaactataattcactggttggatgggtctttctggtaactgtccttctgtttttaacaggggccacatggtattcagggtccgataggcccacccggtgaagaaggcaaaagaggtcccagaggtgacccaggaacagttggtcctccagggccagtgggagaaagggtaaatttaaataatacaacacattcttacagttgtgagggaattatgtgtgtaagtctgagaacagtaaggaaaactagaacagttaagagaaatgcttgcaggttccctgcacagttcagtacagttatgtgcaaatagaaagagccaactgactaatcattattcatacattcaactaatattggttaaatcactagtctatgccaatttgagccatctgtgcttggaattatatcagtgaacaagaaggctatggtcctagtcctcatgtggagactagtaaatagttgtttattttagtggagaggtaaacaataaacaagtcaatgggtaaataaaaatatatgtacacactttaaaaaatgccatacacacactaagtaaagacatgacacattggagagtaactacacatatatgtcagtgttgtaatgttagattaggtggttaggaaagaggatcctctgagaagatagcattttagctgagacctgaagatgatgataagccagtagaaaacttggaaggaagaacattcttagcagaggaaaaagcaaatgcaaagctgggagggcagaaaggacctggtgattttaaagaccagaagaggtagctgtgactggagcacagtgagacaggtctgaaaagaagaacagtaatctcacatttatctagagctttggagaatgcaaagcgtttcacaaaaatgtcactaatgcatgtcattgttgacattttaattgctatagatggtacctatgcctctcatctctagatatcagttttctctgtttaattttactatgaatcgttagaatatttccttgcttccttccttcctttcttccttttttttttctgacatagtcttgctgtgttgtccaggctggagtgcagtggcaccatcttggctcactgcaacctctgcgtccaaggttcaagaaattcttgtgcctcagccttttgagtagctgggatacaggcacttgccactatacccagctaatttttgtatttttagtagagacaggttttcaccacgttggccaggctggtcttgaactcctgacctcaggtgatctgcctgccttggcctcccaaagtgcagaatatttcttgatttgaggaattatttggctcagtacttatatattcttcaaaattttaaagtttttccatcgagtcagatttttctcatgcatatctatagccatgttggcttgatgatggctcctaaaactttatagtgctaaaaataaaaatcacctattcattacatattgcaaaaatatcaacaacaattaagaatcacattttggtcatttgtagggtgctcctggcaatcgtggttttccaggctctgatggtttacctgggccaaaggtgaggttgccctgtcaatgttgatacttacgtggggggtgctccagaagatgccatttttcagcacggtgatctagctatggcctgcatgggctcagatccagaaaggagatggatacaaataccaggcctaaccccaatcctctcttgtgtaattcctgtattaagaggcataggggggaaggatgctagttggcggaatgtggtgacaaaattttatacgttatatcagtgccttgatttgtatgttatattagtgccttgatttgtaaaacgataattttacttctgcttgcttttgtttttctatactctttttcttcatgcatctgctttgcctcggtacagggtgctcaaggagaacggggtcctgtaggttcttcaggacccaaaggaagccagggggatccaggacgtccaggggaacctgggcttccaggtgctcgggtaagaatatagcaagtgtttgctacatcaaaggggagaagtgctcctgagcatgcattggtcgggtttttgtttgtttttaaatttagtttgtttttacagtttagaacatttctttgtttttatggttttgatccaattcattattttaaaaaatactggtttgttatttttatcatatatagaaaacacggtaacttctagtctctctcaaagcagtatgtattaatagctttatcacttggcatgagaaaaaaatcctgtttgtcaaattttataacttgttagcaagtaaagaatttataaatatttgtaaatatacttttatagcaatatagcaaataaagtaattttggcagagaaattctgaaaaattttaacaatacatcacttaaaaatttatttgatttacagaaatgtcattctattcagttgacaaaaatgcaacactatttttactcttaagaatctttacttcaactgcatatcagcaacaaactgacagttggttttttattttcagggtttgacaggaaatcctggtgttcaaggtcctgaaggaaaacttggacctttggtaagtaatttaaacagaagtccacaaccactaatatttttcaacagacatgcaacttaaatgatatttatttaggttaatgtttttgattatatggatgctggtcatattgacatatttgtaccaacttctggaagcatattcttaggatctattttcaagttgacaaaaatgtagatcaaatttttactaagataaatatttgagattgaattgcttccctgcctgacatcagtgaaaatgttaaaatgatatagtttttaatgttggtgaaatttgtctattagcaatgttctcatttttatatccttctaattttatatgtttaagagataagtaggtatgaattttgacaacttatatattctaagatcttcccttgttctgcaatgtgaaatagaagtcctgaattttcattaccacaaaccagagtaaatgaaagaagaaagatttcccctattaatatgactgtcaggagacatcatgaggaagctcatatctagaataagaataaaatctctcttctagttacttaaaatacttcagtgttttttaaaaaacccattcaactgtcctgattctttaacatgaaaatgcaagataatttaaaatttatgtaacatgatagtaagcaaaggtgacactttgggtgatgctatgtttagaaacaacttacatgaaacttacatggctcctgtcaattctatagggtgcgccaggggaagatggccgtccaggtcctccaggctccataggaatcagagggcagcccgggagcatgggccttccaggccccaaaggtagcagtgtgagtacagtgtataatatgttggccacctcatcatgatcctcatttggaggaggtatgtttttgacaaattgaaggaattatacaaaagtttcatttattctttagggtgaccctgggaaacctggagaagcaggaaatgctggagttcctgggcagagggtaaatatacattttctgctaaagaaaaataatgtaggtactatttaaattatcatagactcacctcacaaatatctgtgtgtgatactagggagctcctggaaaagatggtgaagttggtccttctggtcctgtgggcccgccggtatgtgatttttgtgtgtgtgtgtgtgagaatatatatatacacacattgcattttttcgatgatgtttgttcaagacttatgggtaagtttcagggaaagtgaataagaatgtatgggaatgaagaatttctgttataccttctcttttgatttctgtgagataatgtcttctgcctttttaaatataatgattgatctttttactttaaacttctgtaaaactctgactgcaaaggtttttatatgtcacagttaaggactatatcaactgaagaaaacagtgtgtaacaaatattttataaaatattttatttaaaatatttagatactcaattatttaccttctctcaataatgcatcttataaaaatttatgtaaggccgggcatggtggctcacgcctgtaatcccagcacttagggaggccagggtaggtggattacctgaggtcaggagttcaagaccagcctggccaacatggtgaaaccctgtctctattaaaaatacaaaaattagcctggcatggtggcatgtgcctgtaatcctagctattcaggaggctgaggtaggagaatcacttgaacccgggaggcggaggttgtagtgaaccaaaattacaccgttgcactccagcctgggtggcagagcaagactccatctccaaaaaaaaaaaaaaaattatttaaggtattttttaggacataaaaggaataatacttattctttgaggtctattttcattttaggactttcaaatgaagtgtttatccgaaatattttggcatatttttttgggggggtggggcagtttaaatctttctaaaatgttagctttgctttctttagtcattctgtttttgaagtcttgataaataattcttaagacattcagaaataaactataataaaaatattatgtttttagattacatatacaaaagtaatgggttttcctatattcaatccaatttccccataagtttacaattggctccagacatttaagtttggatcaaaaaataaatacatgttatcagttactggctttagaagatattttctcacctccagagacttcaaacaataccatttggttactattaatactagtttattacctggctaaagagaaaaacatgtgattggaagaaatacaaataaatatcagtacttctagtggttcacgtagagaggaagcagacaaagatctggttatattcacaattattttctccttcacaacttagggtctagctggtgaaagaggagaacaaggacctccaggccccacaggttttcaggtatgcactaattcggttttccatttcatcttccattaactaaaatgctttttttttttaaaaaaaaagatatggtcagaagatttgaaattctacaattttcaaaaagtcatccctcttttagtagatagtatagacatttggataaaatcgaacatttttgttcaaagtaaaggaatgggcttctaaaaaaactgatcaaacctgcaaattatgaacaaaacaaataaaaaataacaaaaaagtaataaaaagatatcaggaataaaatgtttctgatagctcaacaaagtttatgaaaccattttaaggctgattttgttttatcggcacagtgactagaattttttattgaacaaagtttcataatttatctacatatatcagtatgtacattatttaataggaggaagatcataatttgtaaaaaaaactttctggactgactttaaataatattctagcagtctaaaatattgttcacagagccataaaaactctataaatatgaagaagctcctgttacattatctctttttttgctaagtggtgtgcagatgaaaatacaatcctataaattgactagctgttgtgttttattggtagtctttttttaatgcttctgaacaatattttttacttaaaatgtctgaacaatatattttcattgaaaatatagtcttggagaccccatgaattgtaaaaggtaaactgttaacactggtagcctgttaaacttacacagattcacaattttattttcttacttttgttttaggggcttcctggtcctccagggcctcctggagaaggtggaaaaccaggtgatcaagtaagtgtttaaataataataatggcaacactatacattgctggctcaattatcactttttatgtgtgaggctctgttgtgctttcctttacatacattatctctttgagttctcaaagcagccctatgtactaggtactatcattatctccattttgtagatgaggaaaatggggcatacagatgttagataactttcccaaagtcacacagttaatagatttgaacccaggtcatctgcttcccaagatgtgttcttaaccactttatataaacagttatggacaaatactaacaattttattctgtcgttttcctggctcatagatttatttatttttctttgaatgattcatttgttcatttaatcatttaataaatatttgctgaacactctgtgtgcttgcctctacaaagcactggcctgaaccagctgaacaaaatggatttggaccttgctgtccttacagtatagtaggattcagagagtataggacaattacaataatagcatgctctaaatgctataataagggaggtactatgtttatggaaacaaaaaagatgcacctaaataagacttgggggttttaggaaaggttttccagacaaagtaatatcttttatgagatctgagagatgaatgatgataatgatgaaggagggaagataggaaaaacctccaggaaatgagacaagcttacaaatcagagtgggtaatgtaatttggggaaaatagaaagggggctgcagggtgactcaggggcctgattatggagggctttaatttgattctaatttgttcttcatcattagagtaatgggaagctaaggaagagtttttaggctgggcacagtggctcacacctgtaatcccagcactttgggagactgaggcaggtgaatcacttggcatcaggagttcgagaccagcctggccaaccgtctgtactaaaaatacaaaaattacctgggcatggtggcacatgcctgtattcccagctacttgggaggctgaggcaggagaatcactttaatccaggaggtggaggttgcagtgagccaagatcatgccaccattgtactccagcctgggtgatagagcgagacaacgtctcaaaaaaaaaaaaaaaaaaaaaaaaaaccagaaaagaaaaaagaagggtttttaaggaaggagtaatatgataagattagggagatcaggccacagtgaggacagtccatttcggagaataagattggaggcctatttgataaagttatctttatcaaagaaagaaatttcaaattgacaaactttcttttatgtaagaacaaacaaacttttaatttagacatgactgcactggtttgaatgcacaatacctagtagagtgctttgtccatattataggctcaagaaagatttacttaattgagtagaattggattggttctatttaaaagaccaactctttagccctttttatataacttttctttatttaaactttttcatcttccattagtttaaaaaaagacatttagcatgtattttgttgcctctaaaaaactaatgctctatctttgtgaaatagtactttgcatgttctcattgccaaaaatcaaacattcaggtataatacaaagttttttggaaaaatgttttcatctaaaacatgtaatattccctcatttataaaaatatacgtacttttctttctttaaattgttggcttatgcagccttctaatggcacattaatagaaactaggtgtatgaactggaaagttttctgataaatgcctaaactcaaagctcttgttccattaaaaaaaaaaaatgtgtttatagggtgttcctggagatcccggagcagttggcccgttaggacctagagtaagtattttaatcttcatgattaatgttgtttcccactggcttcagttttaaaaggtgtcttttaaaatcttaaactgggatttattttaacctataaattctttgactggataaaaattaattttatgagaaatattttgtgctatgaaactagcatatccttacttcaaatttatttcttatcactaaattagaaaattgagatttagtaatgtctcatttctgaatttttccgcagtagaagccatttctcagaaacattttgacctatttttagatcaagtattgagattatttgacatcccaattttgtgctagggagaacgaggaaatcctggggaaagaggagaacctgggataactggactccctggtgagaagggaatggctggaggacatggtcctgatggcccaaaagtaagtgtcatagtgatctcagtgttttaaaatgctttaaaattactgcttaataaacgcatgatggtgtgagaatgcatttgtcttgtttttgaaagataatttgattatatcattttcttcttccacaaatatttaatgagcgcttactaggctttttccttgcaactaaagtgtcagctaaaaagaagactctcttctttgatggggattgtagtttagtgcacatggtgatagacttccatatacaaacacatttctaatgtttatgtacattttattagtggcttctatgaataaacagaggaaagaaatagaaaattacataatttattaggaggcttttctaataatatgctccattttccttgtctcaggtttcacaattctgcttactacatatgtgaaaatatggaacttttaaaatctgaaaatataatgcatcataaggcagaaatgtgtgccatttagtgattggtagaaaataatgtggccaacttcagtataaacaattgaagtagaatttttcatggtcatgtgacatgagaccccttattattttcagggtttagagtgattgatgcagtctactacaatttagacactatattagcctgaaaaccaggttaatatcaaatatcagtttcattaaagagagaatgaaatatttctctaaatgtaatgtctttctttcttaatatattccattatgttgccaacagagggaaaaaaaggcaactctatcctttttatttgaaatagcgttcaattgcctcttaagagaaaagttaaaaatataaagcagcaatcaaaaacaaaatctggtttttttaatttcaaaatatcaactcactcagagacaactttctcagatgaaaaatataagcactaagttgaactacatgaaattgctgacaactacttttgacccactaaaaagcaatttcattagtttaatcttaatattattggtatggtcacttaatgttggttcattttagggcagtccaggtccatctgggacccctggagatacaggcccaccaggtcttcaaggtatgccgggagaaagaggaattgcaggaactcctggccccaagggtgacagagtaagtcctttttttttttttttttttttcagttcatttattcagactttctgctgaaaatgaaatgatttcttgagcaggcttttatttctaccatcctgagtcactagtcattcatttttcattcttctaataaacatttactgagaaaatgcacagtgtgaggcaccatcccaggctcacctggatacgactaggaaaatgacaattagccttcactctcatgaaacttacacacaagtgtgggaaagagacaattaaatgaatcaattgtattttgtgtgttttcccagggtggcataggagaaaaaggtgctgaaggcacagctggaaatgatggtgcaagagtaagtgaaagtattccttttctagctgggctaggaaccaacattacagtatcatatgagtttccctgaaccttccaaaataaagtcagtcatgtttccttggtagtcaggagttggagaataatggcatgtgagatctgctgtgattcaaccacggtttattcattttgcttaccctgaattaaatgaaacttaaataaaaacatatttattgtgcctatgagataagtgccttaaggggatgggggccctctttatctttctctatcatctttttatttcatacacaaggtttatttctgttaaaatgctaatctagtgagctggccaatacttcattccagcatagacaagtagagctttgtggagtcaccaaagttgtgataaatgtttctcagtatattggatgttggggtgagaaatttactgcacagtgaatcgtcattaatgttatcattaataaacagtttgaacaagcagaatgtccagaaggatggtcaactgcaaagcattgtttaatgtcatgtcagaaattgacatttaacaagcgttaggtctttgaaattagaatgcatttacaattccaaggacaatcagactcgaaggacaatatattttcagacataaatgatttcctcatgtaagagtggctagtcacaatggcttaaacatccatcattttctggaatagtacctgatatttgactaatgatttctgtttcagtatgacatggtttgctgttagttgtcatgtgtgccctggcaattacagttgtaacataataaaagagaactgctatttggttctgcacattgagtcattgttaatacattggttataatagctttagattaaggaaatatagtgaaatgtagtagaaaattttcatcttaagggtaattagtcctttttatgcaaatttaattaaggatgcaccacttcttttaacaaattatgcacaaaagatacaccttgccttttagttaaatctaatatttaatttaatatttcaaaaatagtcaagtaaatctggcatatttttaatattttacatcatggatgtcctggaatgcataagtagtgcagtactatttataggaacgatgcattggcagtttgttttaagggaaaatctaaaatacatatcaattgtgcctatgaactaactttgaaattgcaatgtgataggaccaggatgtaagcaatgactgctttatttttaatgaggacactacattgttgcaggaaagaagcagagcaaagcacttactgcaatctcatagtagggaaaaaatgaataacatgttttctctgtataaaaaatctataaacataagtaatgaagtgatatttatatttcatcaaatcctttaaagaagtatattacataaattattggaatgatatcattccattgtagatccagagactataagaacacagatttcttatgttcttgtcaaatctataaaattaaagtcatttttgttccttaagtttctttagttgtacatacagaaattaaacgatgaaagaatatttgggctgcatatgaagaggcaagacacagttataagatagagaacttgttttaaagaggacttcaatattcccacagtttcaagtttgtgattacctgtcaagaagactcaggttgtgtccccatgtgttagctgtactgtcctctaagtgttagctctcctatgcccataaatctcaaagtagctggggttttaggctgtaaactttagctacttttccttttcatctcaaaagaatgaagaaaactggctgggcgcgatggctcacgcctgtaatcccagcactttgggaggctgaggtgggcggatcatgagggcaggagatcaagaccaccctggctatggtgaaaccccgtctctactaaaaatacaaaaaattagccgggtgtggtggtgacagacgcttgcaatcccagctacttgggaggctgaggtaggagaatggcgcaaacccgggaggcggagcttgcagtgagccgagatggtgccactgcactccagcctaggcgacagagcgagactccgtctcaaaaaaaaaaaaaatgaagaaaactaagtcaggcatagtggcttgtgcctgtagtctcagttactctggagtctgagatgggaggatcacgtgatccagggcaagcgttcaaagatgcatgtgctgtgatcacatctgtgaatggctactgcactccattctgggcaatgtagagtggagaccctgtgccaaaaaaaaaaaaaaaaaaaaaggaaaaaacacctaaaatgccttaacacaatttcaatttttaaaagtaaaaaagtgatattttgctattataatttaagaatataatattatatgcaaaagaaggaaagcctcttttcaatttgtggtcaaatgtccgaataaatattagcaaagctaattatgctaagaaatagaaacatttttgtagcttagcattaatgtagtgctaatgcctgaaaacagttttatgtatgcatgaattaggttgcatgaaagagattaaaacactgtgtggagaaaatatggtggaaatggtattaaactagacagaaaactcttgaaaatatatagattatatcatttattatagataatgatttgcaaaggcagccaaattataacaaaatagtcgtttcttttttgtttgttgatttgctaagcatgaagatttctgtgcattttttacctcaatatgcctatgttctgttaattgacagggtcttccaggtcctttgggccctccaggtccggcaggtcctactggagaaaaggtaagtcacaagttgttaatttgtacactcaaaattatgagtcctgaatagcaggctctttcataaatcttttcattttataacatatggtatctgagcaagatcatttcagagttcttttccactatctcctcctacacagtgaccaatgtcctaaaattatgtttagctactgttttggacagtaaccatctaaaatctgctttctagggtgaacctggtcctcgaggtttagttggccctcctggctcccggggcaatcctgtaagtgacagtattttggtgttctttagtgtgagattgagcaataaaacaattaatcattttgtttttatatttatataaaacaatgcttattggttttaggttatgtataacttcctggtttttagcttttgcttttctaattaaacttaaaaattatctgctatacaatctattaagtgtagttaggcagcttgtttactaactaatttggaggctcctttgagacttctgaccttgggaattttgttctatgacctatatctttatataatccttaaggaccttccttaagcaatatgtgtaatttttctatatttacatgtctaactatcagatttatatgatcatattttaaaatactgttcctgtttaggataatgtgtgaaagctacagtaatctttgtctcctcctagggttctcgaggtgaaaatgggccaactggagctgttggttttgccggaccccaggtataattttcaaatatccctaatttacaaataaacacttatcttgttataataagtttaatgatcattgtcatatgttttgaagtcgtattctggaaaatttacagttttctagacaatattctcattttcaatacatttttttatagactggcacaaaacttgtttgtgctagttgagcttctataattatttgttaaaataaaaatgcagtgggatagcttattttttaggctgttttgaaagatctcatcagagtactttttttcctttagtatgctttaatactgattataaagcactgtttcacaatatatgattaattgatacattagtaataattactctaaagtaatttgtctataagtcttataatcaattgcttgtttgtataattttttatagggtcctgacggacagcctggagtaaaaggtgaacctggagagccaggacagaagggagatgctggttctcctggaccacaaggtttagcaggatcccctggccctcatgtaagttaacaagaaaaaggcataacttgagtcaagtgccccatgtttggagtgtacattcagcctcttttgcttcactatagtgctcttttgtttgtttctattcagggtcctaatggtgttcctggactaaaaggtggtcgaggaacccaaggtccgcctgtaagtttatttgatgctctgcaaagtatgcacagctaattctagttacctagtgcttcctggtcatgtaaaagataattttcatctgagactgaaataacaaattattacctgtatcaactgtactatagtgcaaagggcacttaactcagatggagatttgggttaaaatcaagtttgtaatcttggagacccaggtgcctcacctgtaatgtaagtaacatactacctatataaaagagtaaataaacaatgtgaaagcactttatttaatttgattgtataaaatatcaatgtgattctagtactacctgcatggaaaaaggaaaatagtgcccttcctaccagttaatctagattaattccccaaaatatgggattcgtacgaagaaaaaaaaatattgcttacaacatgaaaggaaatctaaaggcttcagtcttcctgtgaaaaaaaatcccaggaaaatacatgtaactaatttatattaccttaaaaattgcttatatgatattctggttctagggtgctacaggatttcctggttctgcgggcagagttggacctccaggccctgctgtaagtcaacttagtgagacaagtcactgataatgaaataattacacacacacgtatacatttgagttaaatttattattttatttaatttcttaatggtatgttttcttatttaacaactcttattccaataatgcatgctggtatttcagcaaagcaaatcatccttaataatctagtatttcttggaggagctaatttgcaagttctttttagccccaatgttttattattattccgtttaaatactgaatacttacagtattatgtgctaataatcattctcttcagttaagatgcaactatgaaactttctttaataaatgtcattcattataagatcaaatcataagaataaataattatctcagaataaagtattatatattcatcattggagtggagctttaaataagtttgaaaattcaagttagttgcaccactctttaaaaattattcaaagggaattgactgcaaatgatatttagttttccccctggggaatgaatctacagctgtgttttcttttgttttgttttgtttaaatcctatagaatgactgattatctaacaggtaaaatgaacctgcgaggcttggacatctgcatctgaggcagacagcgttatgtcaatcactcttacttgccttccattttgccctccttggtgtttctttctttgttatactagggagctccaggacctgcgggacccctaggggaacccgggaaggagggacctccaggtcttcgtggggaccctggctctcatgggcgtgtgggagatcgaggaccagctggcccccctggtggcccaggagacaaaggggacccaggagaagatgggcaacctgtaagtttggcgtatccgttccagaccaccttcaactgagatatttacaaatagaaacccataatgatcagtgtcacaaaaatgcttaaatattatgctgggcacattcctaaaatttttaaagtgcattaaatctataaggctttaggaaaaacgtgtatatatatagattttaaaaatagcagtaatagatatggtatctaaaaactaaacccaaaaaaattatttgttaaatgttcattgtgtatgaataactttaaaaatatatgtatattatattttatatgcaaatgcctttaaatattgtgtttagataactcttttttccttattgttaaactttctttttgtctttttataaagaagaaaaaatatttctctgaagttacctcttttattgagtcagtattcacattaatcttcagtttctttccaacggatgagctgttttcacctttaaataatgttagaggttctgtgcggattacaatttatgactactcatatgcagtatgattttgagaaacagagaacttctttttcatactgaaaaacctgtaaagctgtacccaacttattgtaaattccttgggtacagttttaccctggatagtttctgattttagtttgtcctcaacattagggtccagatggcccccctggtccagctggaacgaccgggcagagaggaattgttggcatgcctgggcaacgtggagagagaggcatgcccggcctaccaggcccagcggtgagtagctgcatcggtcaatattttatctcatatgtgcaatacaaattgtttagagaattgattttattttttttgcttgatgaatagatttaaacagtattgtagggacattaatttttgagtctcttaaaaatcttttgatcttaaatgtcaaattcttaactaccttacaaagtctttgaaaatatatatttgtttaaccctgagactagaaaagtaggcaaataaggatatggatttttggtgacctttaaatccttcttcaaagattaaaaagatcccggagctagaggagggggataatcttctggtgaataggtagtgtctttttaagtaaacatgcttaacaaaaataccatattttacagtaaaccatcaaagggaagacatagttgagctaaagtaatatttgaggtgaatgtagggggaatgctgaagaaggatctgaaggtaatctcctgttccctggagggtgctttaggattttatattccctggagtatggataaaagtttgattcaaagttagctttgaagagactaaattttattgctaaaagattacagtgcttgaaaaaaattaatgatgttttcatatggaatgtagacagagagatgtatgggatcttagaactgggagacatgtgggttgaaatatgaaaccaacaaagtaggagctaagggatgtcttattgttatcagaagtgagccaagaatgtgaaagtaaaatctctcaagagtgagatcaaagtatcagaatatagaaataaaatgaacagacaaagcagagcggggaaaaaggatgaaagtgatgcaaattccagaagggcagctagaatcacctatggtacacatgattagaacccaaaatgcacacctgtgctggtggcaacagatggttggtttttggtcccttagatacgtcaagaggagtctgataggaggtgggcaggcctctaagaaagcattatgattacatgagtgttgtaagataatgcaaaattattattatagaaggagcccagaggcaccattttgaaaacttagcctttatgggaactagcgttcttcaatttcttcacaagtgtttgacatttatacttctatttcagggaacaccaggaaaagtaggaccaactggtgcaacaggagataaaggtccacctggacctgtggggcccccaggctccaatggtcctgtaggggaacctggaccagaagtgagtactacagtgaaaataactcttctcttgttatctggtgtcatggaaacaatttttttcatttagcaattgatttagaattttattgcatatttgaccttaagaaagtttcttagtaatgttatttgatgtactctacttccctagagagttggctaagtgatgacataaagaaaaggtaataggatcggtgtctttgcactgaccttcatctagtctggagctaagtattttagttcatttaagctgttgccaaactgttttgagggtgaaaggacacatccattcatctttcccttgttattatttcattttgtaatgacatatttatcaaaattgccaagttttttggtgataggattaatatagctattccagcttgtgaaaagggcaaagttagtagagatcattttacttaaatatcactataaagtaacataatggatatcatgttcctttaggcacttttgggaggaaatcagtttttgataggcaatttgagaagttaaaggctggaatatcctctgttcaggattttaaggagtgaatcatcaaacagttaatgtaacattttattgaaagaaagaatcaatagcctttggaacaatttttgatcaaatagcaaagacatatttatgaaaaaaatcacaataaaatagaaaaggaagactatttcttaaagtagtttaatattgaaacagttattttatttcaaaactttaaggatatttgaataatcttaagaagtaaatgtaagaaaagcctttcattgttaatacaagcaaaacataaagtggcaagaatgtaattgttatctatttcaaaatatttgtgggttttttgtttttcaaaataagaaatataaatgaagaatatggattaagtaagaatatgttaattttacagtaattcaaaataatgaaaaagaggtagaaaccgttcttctgctgacatttgcataaatgctaactgacagtttataaaacacaggtgtaaaacatgctgtcattttttgacaattggaatgaggatttttttcattactcagttaagtagtttttcaaaccattattctttatagggtccagctggcaatgatggtaccccaggacgggatggtgctgttggagaacgtgtaagagccatttcacttattataaaatctaaagtcatgcaaatctgaaatctttttaatttacactaaaaactgtcatttttcctgatagttccaatacacttctgatttttctgaataacaactgtttctgtaaagccataatttttatatcttgtaaatgaaatgatatttgaatatgcaacaaattaagatggtattttttcagagcaggaagataaaattgaagccatctttggtttaacataaaggctttggatgaggatatatatgaagtgttctaaattttaaactcattaacaaaagcatgaaagccaaaatagtgctgtgtaatgtctaaatttttccattcaccatctaaagtgaatgccgtatgagaatataagccatgtggctttttaaacactgtatattccatgatgtgttttaaattagaatgtgctgaactgaacatgtccccaactttctctgaagccccagtcccttctggcagttgcacagtcatctcatgctgctgagatgggccactgaaggcaaaatcactccccactccaaagtctgttatgatgtaattaaagctcatcatgtagcagaatgggctttggagccagtcagacttgatttggaatattgtttccctaagtaattagctgtgtaatcttaagcagattttctgaacctccattttcaaatgctttaaatataattaatacatatgccattgggcatttgtatattaaatgacatgtttaaacactccactacaggatagacactcaacctcatattgaaaaaaaaggggaagaaaggatttggaggaagcttgggctaagtcccgctcatctactataatccacagactgcaaattctcttggcaacttgggctttttcctttgtcaatatatactatatagtgcaaccatcttcaaaggttttgctgaagtaattatgaaaatcggtaaatctctctacttattttaagttgccatcgcccttttaaaatcacaagtttaaatagttgcaaaggaggtgattcctggtaaattctaaatgtacaagtgctttaagtatttttttttttttttttgagacagagtcttgctctgttgccaggctggagtgcagtgacacgatctcgtctcgctgcaacctctacctcctgggttcaagtgattctcctgcctcagcctccccagtagctgggactgcaggcatgtgccaccacacccagctaatttttgtatttttaatagagactgggtttcaccacgttggccaggatggtctcgatctcttgacctcatgatccggccgccttggcctcccaaagtgctgggattacagcccactttgtgagccactgtgcccgggcaagtatttttttttttttttcaaaaccttgaagttgccaattcagcttattcaatgtattatgtgtctgttctataacctaattgccaaagtttatctaggttgataaatttatcagtcaaataagacaattttttgtcagaaaatacagtctgactcaatttttcaagtcaaatatttatgtttagacatgttcatataacgcttatctcacctctgacttcttaaggagacaagtaatatttggagccttgtcataattgtgtcatctggataaaataaaaaggagcctctttattttccaaatccttcgtagctttatactcaagtaaactatgcattctggaaaagtcccttagttcagtgcctagaggtatttattccttgggacattgcatcataataagattgcagatggtatgatttctgcttttcttttacaaaatgagagaaggtggattatttaggggaagtaaggaaggataatcaaaatatagttttctgaaagaatacataaggagaggaaaatctagaaggtggtttccttaaaattttctttgttttcacagtctttggaaagtctttgtgtattccaagtataccaatattccagcttaaagattggtgctctagaaaacatgttaaattctggaggtgatcactcctatactccaatgatcttgacgtgcgagcaatagggagtaggtgagggaaaggatgagacttgaaattaggaagaaataactttattcttttcaatttgatttattaattaataaatataagtaaaatagttaaaataataagtaaaaataagttttaaagggtattttttcccattattaatactataagaataacatgaacatatggaatattgttgttttagaataaatgttaaaaaataatatcatggttattcttgttagggtgatcgtggagaccctgggcctgcaggtctgccaggctctcagggtgcccctggaactcctggccctgtgggtgctccaggagatgcaggacaaagaggagatccggtaaggagggagtcaatttcacactgacagttttgcacacccatatgctatgttataagctgcatataggcacacacacatagtcatacatgtgcacttcgttaaggactctaaataatgaatggtaaacagctaattatgaactactatatgtttcttagtctgaaaggcaaaatttcatttctaagagggaatagaagatactgatgctttgacttccatcatctgaaaatgctgtagtttgaaaatgtaataagtatgcatcatgttaaatgtcaatgaataatgtcttactgtattcaactaaggtgatacttattcaatgaagtcaatgaataaaattgaccgtaaaagtgtcattgaagttatagtgaccacagtcttatctacacatggacatttgcctgatttcaattaattaatcataagagtatgcacacacacacacacacacacacatatatatatatgcatccaactataaacgtattgttgacatcctgtatctatgtaatatgtgaatatcttttttacatgccaattttttttgttgtaaatttcttttagggttctcggggtcctataggaccacctggtcgagctgggaaacgtggattacctgtaagttctctttttttgttttttaaaaaatgttttcttatataaaatatactcccaaagaagtataatttaagattcataactgaaaaatatgaaattcctcaagcttgaacaaaaatattaattaaaaattataagtttactcttattttttaaagtaatacgagtttatttttataattttaacacaattcttctgaatttaaccatgaattatatcaataatcatggaggtttttaaagtcacaggtttctcctaaaataataggaattatagtgcatttctctctgagctattctaaaaactacataggaaaatggatttgaaagctctctgtaaacttgaaaagcactattcaaatattatgtttcattttcaactagatttttctttctatgttctgatctttgtgctatttgcaatcagtgactttcaggttaacattattatatagatgtcttaccatgaatgaatcatctcatgtgtaatctaataggtcatatgcttttcatgcccatcaggtaaatcaatgtctgttctcaaaaagaacaattatactttgaaaatcatggccatattattaaataattctcctctttaatttgagcttgactggcaaatattttatagttgcatagcatgtcaagtgaacagtgttttgagcagttatagaaacattgtaattttgttttctatgaataaatacattgtagttaataattcaaataggtgccttctgatttagtttagttttaattatgaaactttgggtcatcccccaaataaaagaacctttcgaacattatgaaaaacttcaggctgattttgatagtatttaaatttatattgttatataaaatatgcaaaagctactgaaatcatcttctttttattataaatgggttcctatactgtatgataattaggaaatataaattcaaaatcaaaacaataagggaaaaattaacctgagagccaattgatttgatgactgcagtcatcttccaaagtcagataaatagggattcagttatcttttgggaaaacactaaaagcaacagaatccggttctatagtagatgactctatgccacttgtcagtttactgtgaaccactcgttccctggagctgtttttaatttcccaggacttaaaacaaaacaaaaccaacaccaccaccaacaataacaaaacatctgagattgatcagataattttcacctcttctctgggtatagcttctatctcaaaataagatccctaactacggctttctttgtagccgtagatcaagcttagcatcaagatcactggatttggttacagatattgcagatatgggataacttagagttgctttgttctttagaggaaagtggcttaaagatgatatttctgtttaatttgttcaagcaagtttttgccaatttcttaatatagttgcagctgtcatagccagctagtttatttgcatatgtaaatttaaaatcatttcattgttacacacggcaagtatgaaatgttttaatttaaaagaatctatatatggtagcaatatttttatataataatatcaactaaatatgtgaagcataatctttaaaaaacatttcagataggctagatcaaacaaaaatatctaattttagtatgaatgtaagataaacatttaaaaaataaatcttcagaaaagtattcttattatatcttttttcagtgatcacctaccattctttgggaaaaataaacagaaatttctaggtctaatactatttttagataagtaaatatattaatccatataaaataccaagttcaaaattgtagtaaatacaattataaaaagtaaaattttagtaaattttagtctcaacaataatatgtagcaagtaattttcatgccatatctctatttctagggaccccaaggacctcgtggtgacaaaggtgatcatggagaccgaggtgacagaggtcagaagggccacagaggctttactggtcttcagggtcttcctggccctcctgtaagttattcctttaagtattattctgccctgtagttgaaaatacacgggtatcttgacacgaacatttatctgtctgtaaaataggtggatatgtttgtatcttattttcagttcaaagaatatcttgatgaataacaagtgataattgccaataataagctataattttgtagggaagaaataaagcaaaagctatatgcactgttactcctacaggtgtctttaacattggtcaactcatgtagacattgcagagattggtgactttatcaaagtagttcatgctgctaaagtcaatgatagcacatttttgagaatggcacaatgcaggatccaaatattttggcaacattttttattgtattcctacttagggtccaaatggtgaacaaggaagtgctggaatccctggaccatttggcccaagagtaagtaacaaaaagtagtaagttgcaggtgtaaataataatgcctttgttgatgtactgctaatgcttgagtatcgttttcctggtattgaagctggagttggctcatcttctctgaggttggcaacacacatatgagacaagctatttagcaattaattttaagtagaaatatcttgaaatatgatatattacctcatgggcccgcaataaaatttattacctagggtttggatatattcctctgttagttcattttgttacattgtgttaatttaaatttctattcaactttcactttttgagatgatgtaatagcatttactatgaagtggagacagattttgaagctaaatatattttgtcttttaagtaatagtgatagttcctcagaagtagtttacataaagctaatttggaagtaaataataaaatgaagccaatatttgaagcttttagaaattctccattagtattaatgttgcttgtaataagtcattgatggcataagacaattggtggacataattatttaggaaaatagaaaatattttgtagaaaaaattagaaaaaataatttaaagaatcttggtatatctgaatacagtgtaaacaaagcatacataaaattcagaataatagtacatgatggcattctgaggcataagcacagaaatttcacttaaacactccaacttctgtcattttcttatttcaagttaattgaatttctaagtttacaatatgtgaggtttaatgaaagttactaccaataaaagtaggtgattagtccattaaagatgtaaactcatatttgtcttttaccatgcatggatgatggaaaattcttatgtgatgaaatcataaatgttacaaagtaccagaagttcatttattaatcagtaagaaaatgaatcttagaaatcactgttacagctccatatgtaaaatagttctttgattagagaaaggcattgtaaaatttttccttcatagaatctaaactacagtctttgtttcttgcagggtcctccaggcccagttggtccttcaggtaaagaaggaaaccctgggccacttgggccaattggacctccaggtgtacgaggcagtgtaggagaagcaggacctgaggtaaagtcacaaaggtttacatgcaagaaatgctatttattcaatagctcagattccgtccaagaaatgtctgtgcagcccgattgacaagagacttaagggaccccgaaaacaaacgtagaagtcacacaagagtataagtaactatttcaagtattttaatacagataagttagagcacataaaatcagagtccaacctacccagacattaacataatgtgatactaacaagagcaaagaacaagttataattgtatttataattaaagttatgaaaatgttgatttgctctcaagggcaatattttaaatgtctgtgaggtatagttattacttcatgaaaactccatagaaatgctggacaatgaagagtatgaaattgaagtttttctccattgaaaacattcagggaggactttgattaaaactttttgtaaaaagtttcagtagtgttgacttgaggatgatacaaagctgtatactatgttagttagatccttgcttctcaggtctgggaaacatcttcatacatcttccatgcacaggtgtactcatgtgcgtgtttgtatatgagcttatgcttctctctctggtgtttcttcctcattggtctttaccttctcttccttacttttcctttgcccttcatagcaatactgttaagccagatatttacttcttatgtggatcaaatagtcttatatttcctatggacaagagatatgttttctactcatttatttctctaattgtgaataggaaacagctagaaaattggaataccttcagcttatgtggctgttgattgactttgtgattcagtgggccttgatatattagaaaaaagtcttttcttttctcttaaaattagtataaaggaacgcatgaactcagtatatgaccttagagacaggaagaaaaaaaaattatgtaacagccctttgagagtgaggaaacattggcactgaaggtaaaagcaacttgtctggagccatataacaagtggcagagccaatagtagaactccagccttctggagagttcttgctcccagatcttgctctctacatgagatgtggactatgtgtctcttcaggttgtcacctggttctttcaagttgctgagttcttccttggggaagtgcagaagggaattaatagagaggatccatttcgtagtctctgccactttttgtgcttatctccctctcatttcagtgtgtcttatttggcaaaaaaaaaaaaaaaaggcaggagggctctttatttatgtcaattcaaaggctaaggctaggaatactgggcaccttggcacacacctgtaattctagctattcaggaggtgaaggtgggaggattgcttgagcccagcagtttgaatccaacttgggcaacatagtagcaagaccctgtctctaaaaaccaatactatttcttcagtttttcttaggacagagaatttttatctgtacaggaattaatgcacataaaaggacttcctgtgtttctctccctctcttttagaagtaggagtataattctcttgtgggtgtttcctgtgggtattttcttgttattgacatgtaatcttatagaaccagcagccactattcccctgcatgctttgttcagcttcatccaaaaataattttaaaacattttggttgtaccttgacgaaaatagtttgcaaatgaacatacatatctgcatgctattaacataaaatatgttgtatcttcaaggtaaacacctgagcaaatattttgtgctttgatctttatttatcttggatgctgacttgaagatatgtttcctgaaaaatgattgagcatcatttctcatccttgaatgttacagcctgttagaccacccccatctagttacaaaagggcgcgagtcatagatctccctttactgtcaaattggagtgtctcattggaactccctatgaaccaagttctaccagttaagtaaaacaaaaacaatgtgttaaatgtctttccaatctctttttaattagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgagtagacagcagcccatttgagcaaaacccgttgtttctgattgtttattctcaactgcattccaaaatatgttactgactttctacttagtgatagatttgagataaaaatagtaaacatatcatggagcttataatttaatggtggaaacagtcaattttgtgaaaacatgaaaaaaatgctcagcatcactaattattagagaaatgaaaatcaaagccatagtgagataccatctcacacgagtcagtatggctgtcattaaaaagtcacaaaacaggccaggtgcggtgtctcacgcctgtaatcccagcactttgggaggccgaggtgggctaatcatgaggtcaggagatcaagaccatcctggctaacatggtgaaaccccgtctctactaaaaatacagaaaattagtcaggcgtggtggcgggtgcctgtagttccagctactcgggaggctgaggcaggagagtggcatgaacccaggagccggagcttgcagtgagttgagatcgcgccactgcctgggcgacagagcgagactgtgtctcaaaaaaataaaaaagtcacaaaacagatactgacaaggctttggagaaaagggaatgcttatacacttattggtgggaatgtaaattagttcagccactgtggaaagcagctggagatttctcaaagaacttaaagcagagctaccatttgacccagcaatcctgtgatttggtatatcccaaaggaaaataaatcgttctaccaaaaagacccatgaattcatgtattcatcactgtgctattcacagtagcaaagacatgaaattgacccagatgcccatcaatggtagattggataaagaaaatgtggtacatatatatgatggaacattatgtggccataaaaaagaatgaaatcatgtcctttgcagcaacatggatgcagcgggaaaccataatcctaagcaaattaatacaggaacagaaaaccaaatatcatatgttctcatttataagtaagagctaatgagcacacatggacataaatatgaaaccataaacactgcaggctactacaggggggagggtgtggatgggagcaagggttgagaaattacctattggatactatgctcactacctgggtgacaggatctgtaccccaaacctcagcatcatacaatatccccatgtaacaaatctgcacaggtaccccttgtatttaaaataaatgttaactttaaaaaaaatgtactataatagatgatatatcctattaataatccagtttcatgatggtagttccattttcatccagaaatcttaaaatattgatatttttgtggaataaaagcatttcgtggaaatgtggaaaatgcttgcttaagtattgttcaaaatatttatttacttgcatgacctataagtgtcttaatgttaacatattgctggatcatcaagcatatatttcccacatttaaatatgtaattcctttcatgtagtttaatgttctatgagtcatacttttggaatctctgctggcaggattatattattatgaggttccaagacattttggaatcaaatagttgttctgccctagttgcatgtaccaggcttaaagtttaccttattctgtcattttaattaatccaatatgacctagagaagagggatcctaagtcacaggagacaaatgagctacaaagagcctaagaatttaagttaactttgaaatgacattgacaggaatagctaaaattattatcattgaagaaagggcaattttattaactctatacattacattccgacactttcatttaaaatgcaattctcacatactatttatataatatacacacaaatatatgtatacacacacccatgtatgcaaatgcatattaaattgtgtatttgactgtatgcctaccaccaggcactgccttggtatttcctattttaagagtctcttatatatgagaagagtaattttaaaaagatctaatgaaatgattcatagcattctaattgtaattcaacttatttattcactttactcatagttttgatgttacattattttattacattatttacattattttgttacactcattctaatttgctttaaaatattggaaacacatctattttggtaaagccgcttactatagattttctcttttcggtatggttttctcatctataaaatgggggtaatgatatttccttcatatggatgttttgagccttaagtacatggtttggcaaagtgccttacaatagcgactagaatgtagaaaggcccccaatgcataccggttacttttttcgtaaggggcactctcacttaaaagaatccttaatcagtgagtgtatattttcaaaccctctgttaattcttttggagacttatagtcatgattgagattgtctttatttagtaaaatttctattttgaaaaataggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcaggtaatttaatatgtttacttaaaattgtattctttactttttactacttattacatatttttgatttatttaggactttgctatttttttaaaccaggcttattttaccatgtttattttgaagtgatatagtctcattagttacaattgtaataccattgcataaacaaggttttgctatgagtgaagttaacataaattttgaattaaaaattttctcatggatgaaatatagaaaagtaattatttttactgtaagttcctctaatgtatgtgacatggactatggagtgtaccagaagtgataaactatagtgccatagttgataaacagttatttctgtatattcagcttcagcagacctggttacctcacggggatcttgtactgactttggggccttataaagtctctgaactttttggagactcagttttgccagtttaaagtaagggtgataatatttattccatagtttccatgtggatataaaattcttagtttagggtctcttgtactatgggatagatggtaaattaatattagataactactataataatgtctaaataattgaatcattttgtaaaatttttaatattatttaaacttaaggcatttttgtaatgttatgaagtcaattgatatttttctgagtcccagtctaccctgtttctatcatggtctggtgttcagacaactgtctggcctttccactgcctgttgcaatgtgaatatttcattctgcatctctttatggcagcctaattgaaattttcttctcacttctgcttctgaccttttcctagaaatcacgttcagaataaacattatgagaacattatgggtgtatacaagataagctagtatctgtcattatttaatgagcacaaaattttaaattttaaatataaatagttgaaatataatttagctaatataatatgtaaaataaaacccccaaatgggagtgctgaaaccaaagctaaagtagaaggtgagtaggaaagagtctctagaaaaatttttttgattatttttgttagcacatggaaaacttttaatatgtatttcctacaattgtgtaatagttggggtcaaaagattttatactactagttaattctaatttttattataattagcaataaaaatgagttatttttgatacatgagtgaagcagatttaaaaatacttatgcttgttctcgtgaattattgttattattggtttcattaccctttgggttaataaggacagaggttcttttgagtattcatagacattttaagatatgtttagatgtacagctagaatagcttactttatgacaagaattaaagtaatactcttcaaaattgatttatctgaaatcaatttatatatttatctatacatgtgtaaggcattatgaaacccttcagtcttgtgtatgacaaagactctttgtttttctagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctgtaagtactttttgatctacattgatctggttgaggaaaaaaaattatttttgttaaaaatactattacagcactagaactgggggcaattttaccttgtatatgagcataatagcagtttgtttatagtcattccttagggtaaatgtgtgtgtgttagcacatgaagcatgatagaggtttgaatccatatagtaaagaaagaactggatccctaagatctgatccagttcttctgcagactttctttggttcttttccaagttatttaacttactgaatctcagtcccatgcttaaaattccttatttctaaaatgcgtaattaatccaagatactttattttttccaccaatttgtaagtaagtctccccgcttgcatattgagatataaaacgaaaataatactaaatggtgaattatagtttcatttgtgaaaaacaaaaaagctttcataatttatgttgctagtgaccatttgggaagctgcagaagaacaaaggaaatttacttaaagcatgaaagaaattctgttacataagtacactaatatttcactttatgttttcattccttttttttaagtagtactctaaaaatcattgcctttacattataaaagtgtctgggaaggttgctgtctaacatacttggaaaaaattgtatgtacatttaacccattgcatcatttaatttcagaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtc

SEQ ID NO: 38698 - DNA, 147248 bp, Homo sapiens; identical to SEQ ID NO: 38697

SEQ ID NO: 38699 - DNA, 18040 bp, Homo sapiens
accttcctccgtcccggccgttagcccagccaagcccagccaagcccagccaagccccgccgatcgcgggcaccggagccagccccgcagcgggtgagtgactgcgcccgcggccgccggcgccctgccccagccacgggcccggacccccgtcccggagcctgccgccgccctccgaccctgccgcgtcccgccccctgacccgtcaggcccccttcccgtcccacccgtgcgggatctctgccccctgactcgcagactgggctgggactctgccctctgacctgtgggaaagtccccttcttccgacaggcggtggacaccaccccctctgacttttgggacacctcatccctgggactagcgtggggaccattaccctctggttagtgtgggcacccctcctctctaattagtgtggggaccattcccctctgattagtgtgggcacctcccccctctgattatgtgactcctccccgctctgattagtgtgggacaccccccttctaattagtttggggaccatccccctctgattactgtggggcacctccccgctctgattagtgtggggaccacccccctctgattcatgtggggcacctccccctctggttagtgtggggaccatccccctctgattagtgtgggacgcctccccgctctggctagtgtggggcacccctcctgggaatgaccccctcccaccaccttctgacttcaaatacccctcctctggtctatgcagggtctccttggactgataagggaattttctccctctgactggcacttggtcaaacctgtaacaggccaaccttccccaccccatcccagtccttgctctccctgccctcatccaatttggagccttcctccaggcacacagctcactctcatcttcctgcatgcaaatgattcgccctccccaccatacctgtctcacacccctactgccatccggtctggattctctcatccttggagactggtacctccttgccagtccatgttgcctggtgcctttgcttctccctccgaatggtctttcccttgccctctgtgtaccctaggcttggcacagagcacctgtgaccactcttccatcagcagacacatctctctcccaaacacctttcccccttagtgacccctggaaaagccgtctcttagtgtcccagctccatttcttattttattcttgaggttgtatgccctatggcctttcctaccacattttcaacaaagcagaggtttggaaatgtgaggctcttggtgtcaagtgaatccggctagctctccagtgtaagggcccaaacttgaaacaagtgtcaggtcgtagaaggctcctaaaaggaagcgggtgccgcagcccttcaggatccgctatctcccagctcttcctccctctccctctgaggagctttgctgagaaaggtccctccaggcctggaccacagaccctccctgcagccccaccgcaggcctctcagcaggacagtctggctggagcctgtggaacggcagtggggctcctcccaggtgctcctccctgctggcctcaatgagccctctatcctagcacacgcccctgctgaaaggcacactgaaggagccaaccctctcccctctggacgtggcaagggtttcctgtcggggcagccccaggcatcttcacggccaggactcaggtgaagcatggatttgtccaggcactgtcatgaggccaccgcagcagtgtggggaccaacttctagtgtcactttttcatgtccaaattaacgtgatcacaaaagagaatgacatgtcacaaggtggtagagggaaccctccactcgcagcgggataggacccctggaccctgggacacctcgctggaggggcacatctgaggcttgacgcttctgattgccagaggtctcctttcttccccttaggctataaccatattttcctagcccatggcagcttagtaaatgtgttggtgtaaaagctcttggtactccagaacgttttcactcacccgtcactgtgcacctggtctgcaggacccccctgagctgcagagtacgtgaggagacccagggtgtggtagcagcagttctcctggccctgtgggtgtttttaccctgccacctggatgtggctttcgaggtgtgtgtgcctgtgcaggctcccccaagtacatatggcccgtcctcggagtctcggtactttctggcaaccgtataggtagataggtagatgtataaatgctgtagtgttttctctttcaaaaacagaagatctgagacttggaactattgtccaggtcctgaaatgggtcagtactatcacaaggaggtcatttttctattgtttgttgaatggtaccagggatgccaaggacacacagcattcattcttttcactcagtgcactctgaactatcgagatttcctggaaagctcttatgaaatgccaatatcaagggaattagaaacttttatattaattcttaagaatgttcatgttgattttccttttactttaatcaagatggttaattaggaaaaaatcatcctggcagtagagaagtctgtttggggagacgttctgttttttgttttggaccctgctcgtctttgtcatgcgtgcagtggtcatgtggagcgcctggttcccaggcaggacgctgctccccgcgttcctctgggatggttttatgggaagtgaagaaggcgttgaagtctggcttaagacttaagacagtgcgtgatgccaccatgtgggagtggggcagaggtgagactgggaccccccagaatggctctgagggtgttgccgggttgagtgaaagtcctggcgattcggcctttgtgtcccgggagccgagcctggaggaaagcgtgaggagagaaggtggcagtaagcaggtgggctcgtgcaggtgccaccgcggtgtggaaggcagccctgatccaggtccatggggcgatgatcccatcccgttattttcacacactctggaaaaggacaccttcccagatgtgtggtgccatttggaatgtgcctttcaactgagaaggtcgccttttggctaaaattcctccaggtgtaacatcgatgatacaaattaagcagacacagcctctttacaaggcagtaactgcaaaccgtagagggttctgaagctgtgcgcccacaccatagacagtgactggtcctggcccttggaaaaacctggaggctctttcccctcttcctcctgtgattggtggaggaacagctccccgagatgtccacgtcctaccttctgagcctgtgaatatgttacattacatggcaaaggggaattaaggttgctgatcagccggccttaaagtagtgagatgatcctggattttcccagggagcccagtgtaatcacagggtccttaagaacagaagagggaagcagaagagccggagggagatgatggccaagagccttggggaagtgcagtgggcgggctttggagggggaggaggggccaccaggcagggaatgtgggtgcctccagaagctggaagaggcatgagaatggagccatggcccgtgtgaggcttctgtcccacaggacggtgcctgctgcctgccgtgtgctggatactaggggcggggacaggtgcagaagtcagtcagatcctgagcttgacctttaaggagcgtgctgtctgtggaggcaggatggcctaaccagactccctgtgaccttcttcctttctggtttccttgtactgcccacccccgaggagatttgccgtggaatttgcaggtacaatagttagccttgcaagtgccaaagcaggaatcaggtaacgttttcaaggagtctggcccatagcaggcattaataagtgtttctttgagatgcgccacccgtgttctctcaggcgctgttagcatgagtgtgtgaaggccttggcttctgccttggctgtgctgaagagtctgtaggtcagtggggtttgctctttaccatggcagtgaacacagtgggcactctgaggcctgcctgcctgctctctgggtgtgggaagggaaaggaaggtagctcttctccagagataaggggttggcgcacctgccacctgcctacccgtcccttccaaggaggtgggggctaggatgtggcggcctcttaacaggatgatgtggcttcctgccctgcctggatcctgaaagggaggagcctggcagccctcagtaaacctgctggttctgccacctgtcctattccactcctgcaggaagctggagaaacaaaccctcttggctgtctgctgtccagggagtcgccactcccttcattatagccttgctcagagtgcagcggcaggcctggggatggcctcgggaggtaggtggcccctgagcccttctcctgggaaagggcagcagcagggagacgcctcctgggtgtgcacagagaaaagcacagtttccctaactccccgctccctaactcctcgctctttaactctcacctccctaactcccccctccctaactcccttctccctaactcccctctccctaactcccttccctaactcccctctccttaactcctctccctaactcccccctccctaaatcccctctccctaactcccttctccctaacccccctctccctaactcccctccctaactcccccttccctaacccccctctccctagctcccctctccctaactcccttctccctaactcccctccctaactcccctctccctaacccccctctccctaactcccatctccctaactcccccctccctaactccttgctccataactcccccccagctcccctctccctaactcccctccctaactcccctctccttaactcctctccctaactcccccctccctaaatcccctctccctaactcccctccctaactcccctccctaactcccccttccctaacccccctctccctagctcccctctccctaactcccttctccctaactcccctccctaactcccctctccctaacccccctctccctaactcccatctccctaactcccccctccctaactccttgctccataactcccccccagctcccctctccctaactcccctctccctaactcccctccctaactcccctctccttaactcctctccctaactcccccctccctaactcccctctccctaactcccctccctaactcccttctccctaacccccctctccctaactcccccctccctaactcccctctccctaactcccctccctaactcccctctccttaactcctctccctaactcccccctccctaactcccctctccctaactcccctccctaactcccttctccctaacccccctctccctaacccccctctccctaactcccctccctaacctccctctccctaactcccctctccctaactcccctccctaactcccccctccctaactcctctccctaactgtcctctccctagctcccctctccctaactctcctctccctaactcccctccctaacctccctctccctaactcccctctccctaacccccctctccctaacacccctccctaactcccccccaactcctctccctaactcccctctccctaactcccctccctaactcccctccctaactcccctctccctaactccccctccctaactccccactcactaactcccctctccctaactcccctcttcctaactcccctccccaattcccccctccctaactcccccccaactccctactccctaactccccgctccctaactcccagctccctcactggtggctcccctgcgctctgggagtgtcctgtgggatggacagatgcctccgtggtgccttgcaagccttgcaggtggttattcctcctgtgagtgctcctgtgagtgctctccaggcagcagcaggggtcctgtccctgtaggcccctgagtctgggagatagctggtttgcagccccactgaacaggagagcctggctggccacagaacccatgactttgctgtagtccctgagtcctcttgttgctgattatctaaaatcaaaccattactctgcaggcactgggtttgtcaatcttttcacaataaagcgagcatttaaactgcttaagctttgaggggtgtagggagaagcctcacacgagccccttctggaaaggactttgtccatcttgtgtcttaccctcgccggttcatttctgttgtttctggctggcaacaaacaaaagagcccccccaccccccacccccgaaaaagaacccagctttttaaagaacatgcaaactcttgcctgcagcaggcgccggcagccaggcaccccggcagccagtggtagctcatacaccagcatgggctgtggcaaaggcatctgatttgaaatttttttgcaaaataaaataattccttggggtcctgaaggagagatgaagcccaagggaaggtgttctggtgctgaagttaaaggaattttctggaaggtacacagagttctcttgtcactagaagcagtcccttgtttaaccaaaggtggctgaggccctggcgtctctgcccctctgttagctctggggaatcagcgtgacctcgaggtaacactgaccacacgggactgttcaaagtctgtctccccaactgtgctgagctcctggaggaaaggcccctgcctccgtcacactgattccccagaggggcagagacgccgggactcagacacctctggttccatgtggtcagaggacatgagcctcccgggtggggagcgtgtgccacggtgtagatgccaggagtctggaataggaaggcgtgcagtgttgcacagcgacctgggagaggtcctgctcctgggagtgcagggggaaaaacccactgaggctttctctgcaggctgagacgtttgtccttcagatggaaggcattgggatctactagacttggaatccagacttgctttttggaaaaattattctgtcagttttgtggagggtgatttgagatggtcttgaccagggatctgtcgagggacagggagtcagtattttcagcctccacagtctgttgcgaccactcaacggtgcagccagactcagcatgccagggaggagtcctagctggctttaatcagccacatctacacaccaggacgtgactacacagcaggccgcgtctacgcaggccgcgtctacacaccaggcagagtctacacaccaagctgcaaccacataccaggccacacaggccgcatctacacactaggcgggagactgcatttggcccacgggtggtagtttgcaaccctcccagcaggcgagagggtacttgtagagtgagtgagaagcagtagcagtcagcccctgtgcacagttctctaaccccatcagcatggctccgggaagtaaactgaggccaagggaagtcccttggctgagcccagatggtctatatcaggggtgtccaatcttttggcttccctgggccacattggaagaagaattgtcttgggccacacataaaatccattgatagctgatgagcttaacaaaaaatctcatctcatcatgttttaagaaagtttacgaatttgtgttggaccacatgttggacaagcttggtctagatcattagaccaagactctgagagtcatcagggtgagatggaactggagccgaggctgtgtggatggggagaagggaagcgagtctcaagctgggtgggacacgtggggctggggagggaggagggttaggacgaattgcttcctgggatggctcctgagggccggcactgccaggacagggagttcctgaggaggacctggtttgcggtgcctgtgggtatcggatgaggaggctcagagactaggtcaggctagaaaggcgtgggggtcttcaccttagagggcaggccctgggagaggtcagtgggctgccagcagtgggggccgagaagacctgcctgggaggaggcccacagagagtgcccccctgcctcgaggagggacactgacaatgtgctcactgggtttgccactggtgaaggcttcaggtggctgcttctgaggattagccagagggaaggagagggtgtaggtgtgggtgctcttgtaccatggtgggcgagggggcctgggcgggggtgggaagggacagaggtgccggggactcagggaagggttttccttcattaacagattcgccatttattcagcagcagttgagtgtctgtgggagtgtggggtctggaggtaaaatggtgacaaggtgggcgacttggggcagcctgtggatggaagggaggaaccagaagagcaggtgcccggcggctggggggactgacctgagtggcaggtgtgagccccacccaggggcctcggctgctgaagttggccacagagtggtctcctgggagaagtgggccggagatttgacaggaatggtgaaggtgaggacagtggctctccggagtgctgagggagttgaacagggaagaacatgggggttccaggggctggtgacgacgacacctcacgatgtctgacagcagtctatgcaggcaccgttgttctgtgctggcaagcaccgtcttcccgggcctgcagctcagatgtggcagctgagcagctcgatctttggggtgcttgatccaggttgtgggttcataatatgcctaaggtggggcccccggtagagtgcagaggggctgttgaagaagtggctaatggctcacctggcatctctttcccttcagccaatgcgtgcagactgtctgctccctgcctggcagtgcgtcaggtgctggggctgtgacagtggccagatccctgccccaggagcagaaataatcacctagccaggcagggacggtgggagagccggagcggcatgggagggagggcgagtgggcaagtcttcccagggagctgatgccccgtaggagagaccgagctgctggtgcgaagagcaggcccgactgttccaggcagggggaactgcaggctctgccagggccagtgtggtcaggggacagaaggaggtctatgtagccagccggcaggcagaggagatggtacagtgtgagggctgagcgggagcagagtgggttcaccccaggacctgaggaagccgctgaagctgggagtgtgccatctgatggatgctacttcatggcaggtggcgagggagtgtcaggggatgttggtggggggcagctggcagggcaacttcatggcggggggtatgggagtgtcaggggcggagaggcaggaggggtggagggaggcagccggcatggcatggtgaggaagggccatggaagaggacagaacctgtccacggagtcaatgctgaggaaggaagacggaggatgaggccagtcaggtttttcgtggtggcagtgccttatgtttttatcgaagtgtatattcacacagaaaagcacatctcccaggatcctgagagagcttgaaccagaccactgtggacacggtggccacccgtcaccactacccttcccaaggggagacgaggagcaagtaggcttgagggaaaagctgcacaggactcgtgtcttgaaatgtctaagacgcatgtcagaaatgcaggtaagggggggtgcgggtgctcgcacctgtgatcccagcactttgggaggctgaggcaggaggatcacttgagcccaggagttcaagactggcctggacaatataacgaggcctcatctctataaaaaaaattaaaaattagctgtgccccaggtgtgttggctcacacctgtaatcctggcactttgggaggccaaggcaggtggatcacctgaggtcaggagttcaagaccagcctgaccaacatggagaaactgcatctctactaaaaatacaaaattagacgggcgtggtggtgcatgcctgtaatcccagctactagggaatctgaggcaggagaatcacttgaacccaggaggcggaggttgcagtgagccgagatcgtgccattgcactccagcctaggcaataagaggaaaactctgtctccaaaaaaaaaaaaaaaaaaaaaaaaaaattcgctgtgcgtggtggcacacgcctgtagtcccagctacttgggaggctgaggtgggaggatcgcttgagcctcagaggttgaggctgcagtgagcgtgatcactgttgcctgggcaacagagcgaggccctatctcagaaaaacaaaaaaagaaatgtaggcgggattggcatagcaggtaagatagagtaattcgagctcagtggagacttcttgggcctggctggggttttgaggccttgggactagaaaaggggcagggcctggatgcagtcagaggaggatgtccagcacggggaaccccagccctgctgccgggaaggccccggtgatcagccctgtgaccacctcagggggtcctgagaggcctgccccttaaagggagcatggagtcttccctgcgggcctggaggaactgctggcagcccccctgtgctgttaggaggatcactctgagcagcaggttccacgtatgtgccttgttcactccttgaacctcaccctggggctaaaacctaggactgtccgaaagttccatgtggaattgtcaccctgtttttgtatcttctcagcccagcaggctgcggcgtggagaagggggtgtctctggtgggggtgtctgttgctggctgccgtgcaccagggcctcgtggtccacatatttggggcccagaattgcacggagccactggagtccccaagcccttcccaggcgccctggcagggaggacagcgtctgcccataaaggcacatgtttgctgctttgttgttttctcaaggaggacccagccagggaagcttctcaggccgggattcactgagctatagttggagggcagagatatggaacctctgcccagggccagtgttctcgatcgaagcaccgggagctgtctccccacgccccactgtggcacttggcggctgtccagagacaggcagctctcaccaaggcggcgcagacgtgggcctggtgccccatggctgcactgagccatcatgctgtatgcccgggaagtgggcttggcgacagcagtgaagggctgcagttcctggccgccaccagcaccctgaccctggggctctgccacagagccacgcctggggtggagggtgagctgggagaggcctgcggccgagccaggccccgcagtgagccgagcagttctttggcgccaaggcacagacacgctggcctccaggcagtcagggcagcgcagactctggtccctgcagtcatttgcattaatagaaaggcgccaggggacagacactgccaaaaacaacaacagatacgaaaaagaaggagtgtttttatttggtttggatgtgtttggtattccaatgctgcaggagcctaacccagaggaagtggagactcctttactgcacatctgtctgctccaggccaggcactgttctaggagccaggatacagaggtggagacagaaacaaacaaaccgataactgtatacaatactctaacgtcaggtggggacaagggccaaggacccagggacggagggtgatgtctgcagcagggcagtcagggagggcttcctggatgaggtggcatttgagtaaaatacagacctgtaccctgtctatgatcctatcccacttcaccccgtcagccttcccctcccacctgactctcctgcgcttctctctttagagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggtaactggaccctgaggttttatggaggtgtgggtggggagtgggagctcagggcctggctggcaaacacaggcacatggtaaagaattcacacacctagaagccagggatgtggtgagggagcacgtctccctcttgctctgacctgcggcccccttacccttagccaggagcatagcctactgtcacttcacactgagcagtttctaggaggaagagcttatcgctagaggcctgtgggagacgtggggaatctctccaagatgttttcggctgtatccgctgctgctctcggagcctctgggaacacgccctttttacaccttcaaaggttctcaagaccacgctaggatgtgcctaccaggagccttgccctgaaagccatggggacagatggttctcactcaaaacccagactttggtttcatgttactgaagggtaaactgctgcccagccctcctctccctgaaccccagcagggggagggcatgtgtgagctgtgccaacccccctggagtggagcctgatgccagcctttttgttcaccagaaaggaggtgctgcttccacagggcagggacaggctttggggaggcacggtggccagtgtcttcctccagagaggagctggggaggtgccaaggacgctggcagaggagctgccagctcctctgagctccgtttgtctgagctggcggtggatccccaccttctagaaagctaaatgccaccgcaggctttctgaggtcaaggaggaactgcactaaacaacggcccacacagttcatggccggccaggccctccccacacccggtgataaaatcttcagtgtttgcccagggctgggcaggggacggacctcacctgaggtatcaactgaggcgttggtcgcctacttcctgcctcgcacttgtcagggttttaggcaaccctagtgtagttctgtccttcccttggatagggaggaaagcggggtacagggagctctggggttgggctgtactcaggtcatccgggagggatggaagaccctggcatggagaatgtctcatcgcacaagcagaccaggagaccgcaggtccctccagggccctgcagagaagctactacagtctcgggcagttcagagggcacagctccagctctcaggggcaagaagctggcaaaatttggggaaagcaaacagaagttagaacaccagggtgtagggatgataagaatacacggtagaacacaggctcccacacagcctgaactgtggcagccttcaaagttaggcttattttaaataaatcagtttaaaaaaagcaaaaacagcttctgaacaaatccattgaaaggaagactgggagccccagcaccaagcccctctccggccactggagttagagtgatgctcggtgagacctcaggtgtggccgagggcagcacccgcactcccctgggacacacgtgccccttcagagtgctgtcacttttcagcttttctagcctttaaggataatcctaaggttggggttacagcttgaggagcggggagttggggatcagaggagacttgagagtggtcactgaaccttcaggagctgaggggagggcagccggccggccctgggcgggagccaggtgcgggccggaggggaggcaggtgtggagccgggcgggagtcaggtgcggggtctaaggacaggtgcggggccgggtgggagccaggtgcaggggtgcggcgggagctgggtgcggggcctaaggacactctgcttggccaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggtaagagacgcctgccccagcccacagtgtggcttccacagcccagtcgctgggaacctgcttcctcctgcatttgcctccaaaaccgttttttattttagacatagtcttgctctgtcaccccggttagagtgcagtggcacgatctcagctcactgcaacctccacctcctgggttcaaacgatttttctgcctcagcctccccagtagctgggactacaggtgtgcaccaccacgcccagctaattgtatttttagtggagacagggtttcaccatgttgcccaggatggtctcgaactcctgacttcgggtgatctggtgatccacctgcctcggcctcccaaagtgctggcattacgggcgcgagccaccacacccagcctccaaggccgtttcttgcttgattttagtgattttggttgcctctgatggtggcttccctcaggccagtggattctggcggcaaatgagctgttttctctttcctgccccactcgccctggcagctggcctcctagcatcccagcctgtggcccggttgtctgcactggtgggtcaggccctgtccctacccctggcgctgggccgtggtgttccacaccaacatagggccagcagcactttggcctccccctagtcaggatggagtaggccttaggtgcctgaggttcaggaggaagtgactgagtctgtgcctggggccccagacgctgtctcctcttccttgcagcctcaaggcagcctccccgccgatgcctccccacatccaatgggggtttgttccctttccttgggttcctctggatcagccccgaggaggctccgatgagcccaaatccctgatgcagctcacaggcagctctcggtggaacgggaggaggcttcaagggagcgggtgctgcaggttccctgcatgggataaccgagaacacagaaccttccagaatcctggagagcagggaggggcgggttgctgtgagctggtgggccctggtggtcgcagccccttgcctgctactgcgcacggcctgatggtgtggggctgggcacaccaggccgcatgcgtgtctgacccgcggtcacccggttcccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgt
